United States Patent 11,725,251 (METHYLATION MARKERS AND TARGETED METHYLATION PROBE PANEL) - sequence listing, part 2

SEQ ID NO: 9765 - DNA, 190 bp, Homo sapiens
  misc_feature 1..190: note = chr8:139508757-139508947
  misc_feature 1..190: note = hyper
  source 1..190: mol_type = genomic DNA
gagactggggaaaatcgagggagataaaccacattttgcggcggaatcgctgttccgtgacagaaagccatccaactggcaaccacgcttgcagaagcgtcactaccaccgacgagagagttttgcagctgccgaccccgaagcgctctcacctacctgtctccactgcagggctcccctctctctcccc

SEQ ID NO: 9766 - DNA, 30 bp, Homo sapiens
  misc_feature 1..30: note = chr8:139926700-139926730
  misc_feature 1..30: note = hyper
  source 1..30: mol_type = genomic DNA
ctttgggaagtttggcgccaccagggggcc

SEQ ID NO: 9767 - DNA, 293 bp, Homo sapiens; identical to SEQ ID NO: 840
  misc_feature 1..293: note = chr8:140714570-140714863
  misc_feature 1..293: note = hyper
  source 1..293: mol_type = genomic DNA

SEQ ID NO: 9768 - DNA, 369 bp, Homo sapiens
  misc_feature 1..369: note = chr8:140715219-140715588
  misc_feature 1..369: note = hyper
  source 1..369: mol_type = genomic DNA
cgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcggctggcggggcaggggcggcgcgggcccgggctcagccgagaaggcggacaggcacaggaggctgctcgagcgccggggccaggcgtccgggaaccccgacaccctgcgccagacccggc

SEQ ID NO: 9769 - DNA, 75 bp, Homo sapiens
  misc_feature 1..75: note = chr8:140715859-140715934
  misc_feature 1..75: note = hyper
  source 1..75: mol_type = genomic DNA
gggaggaaaagtttgcgaagtggcggtgtctctggagtcccctgcaagcggggagggggccgagcaggtgcagcg

SEQ ID NO: 9770 - DNA, 197 bp, Homo sapiens
  misc_feature 1..197: note = chr8:140716694-140716891
  misc_feature 1..197: note = hyper
  source 1..197: mol_type = genomic DNA
cccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccac

SEQ ID NO: 9771 - DNA, 30 bp, Homo sapiens
  misc_feature 1..30: note = chr8:140717104-140717134
  misc_feature 1..30: note = hyper
  source 1..30: mol_type = genomic DNA
gacatcgcaatcccccgacccagtaacctc

SEQ ID NO: 9772 - DNA, 145 bp, Homo sapiens
  misc_feature 1..145: note = chr8:142528462-142528607
  misc_feature 1..145: note = hyper
  source 1..145: mol_type = genomic DNA
tcacgctgcccttcccgttcgcctggccgccggggtccgaccccgcctgcgggccgctcttctacgacccccgcgaccgcgcagacttcgacttcctgctgcgcggccccggagcttcgcccccagcgctgctgcggcccctgca

SEQ ID NO: 9773 - DNA, 112 bp, Homo sapiens
  misc_feature 1..112: note = chr8:142528670-142528782
  misc_feature 1..112: note = hyper
  source 1..112: mol_type = genomic DNA
cgcgcggggcccgggcccggcctcgtcctgctgctgcccggccccgccgccgccttcccggagcccgaggccagcgcttccagcgacggcacccccaggctggcccaggccc

SEQ ID NO: 9774 - DNA, 128 bp, Homo sapiens
  misc_feature 1..128: note = chr8:142528834-142528962
  misc_feature 1..128: note = hyper
  source 1..128: mol_type = genomic DNA
cgcgcccggcgcttttctgcacacactccgacaggcctgggcggctgggcccggcggggaaggggggcggtgggacggtgggacggtggaccaggaacccaactgggacaccgggccaggccgggcag

SEQ ID NO: 9775 - DNA, 15 bp, Homo sapiens
  misc_feature 1..15: note = chr8:142529027-142529042
  misc_feature 1..15: note = hyper
  source 1..15: mol_type = genomic DNA
cggaggcaggccctc

SEQ ID NO: 9776 - DNA, 177 bp, Homo sapiens
  misc_feature 1..177: note = chr8:143530536-143530713
  misc_feature 1..177: note = hyper
  source 1..177: mol_type = genomic DNA
gtgtgtccgtcctgccgtccaccatccatcatccagccagccagtggggccactcccctgctcctggagaaggccgagagcaggaacccaactcttggcttctctgctgcgcggggcaggcaccgggctctcctaggtgtgcgcgcgtgtgtgcattttatccgcccccccttatct

SEQ ID NO: 9777 - DNA, 352 bp, Homo sapiens
  misc_feature 1..352: note = chr8:143531062-143531414
  misc_feature 1..352: note = hyper
  source 1..352: mol_type = genomic DNA
agcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggattt

SEQ ID NO: 9778 - DNA, 125 bp, Homo sapiens
  misc_feature 1..125: note = chr8:143531646-143531771
  misc_feature 1..125: note = hyper
  source 1..125: mol_type = genomic DNA
ccctgccttctccagcggtggcgatggaatgtggcaggtccccgcgagcccgcattgggcaggctgaggagggggcgaccctggacgcaggagaggctcctcggcgccgccgcctcctccccatc

SEQ ID NO: 9779 - DNA, 191 bp, Homo sapiens
  misc_feature 1..191: note = chr8:143532041-143532232
  misc_feature 1..191: note = hyper
  source 1..191: mol_type = genomic DNA
ccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcg

SEQ ID NO: 9780 - skipped

SEQ ID NO: 9781 - DNA, 958 bp, Homo sapiens; identical to SEQ ID NO: 3374
  misc_feature 1..958: note = chr8:143532541-143533499
  misc_feature 1..958: note = hyper
  source 1..958: mol_type = genomic DNA

SEQ ID NO: 9782 - DNA, 141 bp, Homo sapiens; identical to SEQ ID NO: 3375
  misc_feature 1..141: note = chr8:143533500-143533641
  misc_feature 1..141: note = hyper
  source 1..141: mol_type = genomic DNA

SEQ ID NO: 9783 - DNA, 343 bp, Homo sapiens; identical to SEQ ID NO: 3376
  misc_feature 1..343: note = chr8:143533708-143534051
  misc_feature 1..343: note = hyper
  source 1..343: mol_type = genomic DNA

SEQ ID NO: 9784 - DNA, 195 bp, Homo sapiens
  misc_feature 1..195: note = chr8:143591612-143591807
  misc_feature 1..195: note = hyper
  source 1..195: mol_type = genomic DNA
gcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggag

SEQ ID NO: 9785 - DNA, 17 bp, Homo sapiens
  misc_feature 1..17: note = chr8:143591888-143591905
  misc_feature 1..17: note = hyper
  source 1..17: mol_type = genomic DNA
cgcgcccctccgggcct

SEQ ID NO: 9786 - DNA, 146 bp, Homo sapiens
  misc_feature 1..146: note = chr8:143592126-143592272
  misc_feature 1..146: note = hyper
  source 1..146: mol_type = genomic DNA
cctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcc

SEQ ID NO: 9787 - DNA, 24 bp, Homo sapiens
  misc_feature 1..24: note = chr8:143592663-143592687
  misc_feature 1..24: note = hyper
  source 1..24: mol_type = genomic DNA
cgggacccccggaaagtggctgat

SEQ ID NO: 9788 - DNA, 45 bp, Homo sapiens
  misc_feature 1..45: note = chr8:143859143-143859188
  misc_feature 1..45: note = hyper
  source 1..45: mol_type = genomic DNA
gcagtgattccctggcgaccctcagactcacgtgttcagcccgga

SEQ ID NO: 9789 - DNA, 153 bp, Homo sapiens; identical to SEQ ID NO: 3377
  misc_feature 1..153: note = chr8:144241281-144241434
  misc_feature 1..153: note = hyper
  source 1..153: mol_type = genomic DNA

SEQ ID NO: 9790 - DNA, 87 bp, Homo sapiens; identical to SEQ ID NO: 3378
  misc_feature 1..87: note = chr8:144241435-144241522
  misc_feature 1..87: note = hyper
  source 1..87: mol_type = genomic DNA

SEQ ID NO: 9791 - DNA, 292 bp, Homo sapiens; identical to SEQ ID NO: 3379
  misc_feature 1..292: note = chr8:144241871-144242163
  misc_feature 1..292: note = hyper
  source 1..292: mol_type = genomic DNA

SEQ ID NO: 9792 - DNA, 317 bp, Homo sapiens; identical to SEQ ID NO: 3380
  misc_feature 1..317: note = chr8:144328254-144328571
  misc_feature 1..317: note = hyper
  source 1..317: mol_type = genomic DNA

SEQ ID NO: 9793 - DNA, 87 bp, Homo sapiens
  misc_feature 1..87: note = chr8:144503405-144503492
  misc_feature 1..87: note = hyper
  source 1..87: mol_type = genomic DNA
cccatacctgagcctcgtgccgcccgggattgcggcgcccgcgccaccacgctggggtaatggtcccagcaccgctgccctgcgtcc

SEQ ID NO: 9794 - DNA, 30 bp, Homo sapiens
  misc_feature 1..30: note = chr8:144509088-144509118
  misc_feature 1..30: note = hyper
  source 1..30: mol_type = genomic DNA
ggtcctgtactttctcggccagggaaaggc

SEQ ID NO: 9795 - DNA, 30 bp, Homo sapiens
  misc_feature 1..30: note = chr8:144509520-144509550
  misc_feature 1..30: note = hyper
  source 1..30: mol_type = genomic DNA
tcctccaggtctctccgcttgaaacgataa

SEQ ID NO: 9796 - DNA, 568 bp, Homo sapiens
  misc_feature 1..568: note = chr8:144509993-144510561
  misc_feature 1..568: note = hyper
  source 1..568: mol_type = genomic DNA
tccccaaaagcccctcggccttctttgccgagggcagacgcagagggcacaggtctgcggggtgcaggccggctaacgctgcctcgctgctcagtttctccctggtcctgccgtcacccagggcccgtccgtcacccagggccagcacaaagcccaatgcagggccctcctcttccttcaattcagggagaaacacggcaaaactgaaagccaccgaccaaccagccaggctgcggtgacttggatctgaacagatttattttgtgtatttttttctttttctcagtttcgtagcaaatgaaaaaagaactcaacgaaaaccaactacacaacaaaactttcaacgagtcggcgcgccttccactccgagtgctcaggggaggggtgtggagcggctggaatcccactgatggcccctgagggcctccgaaaacgggcagatcccccaggcgcctggcccagcctacagggcctggagcacccgcctcctcgccctctctcccggctagtccaaagagcgacgaagcattaaagaaagattccacaaacaaaacgaaacacaatttaa

SEQ ID NO: 9797 - DNA, 65 bp, Homo sapiens
  misc_feature 1..65: note = chr8:144510915-144510980
  misc_feature 1..65: note = hyper
  source 1..65: mol_type = genomic DNA
ggggcaggcaggggccgggcccctcctggcgagcgactcatgctgtgactcgcgactgagggcgg

SEQ ID NO: 9798 - DNA, 933 bp, Homo sapiens; identical to SEQ ID NO: 3381
  misc_feature 1..933: note = chr8:144511184-144512117
  misc_feature 1..933: note = hyper
  source 1..933: mol_type = genomic DNA

SEQ ID NO: 9799 - DNA, 118 bp, Homo sapiens
  misc_feature 1..118: note = chr8:144651780-144651898
  misc_feature 1..118: note = hyper
  source 1..118: mol_type = genomic DNA
gcacctgctgggactcggggtcagcctcttgcagacctcgccgcgaccgggccaagcccctctccacccctccccttctctcacaccttcctgcgattcagcgcgaggtggcccaggc

SEQ ID NO: 9800 - DNA, 65 bp, Homo sapiens
  misc_feature 1..65: note = chr8:145700341-145700406
  misc_feature 1..65: note = hyper
  source 1..65: mol_type = genomic DNA
gcggtgttctgcagccggagcgcctcagctgggatcaggctcacgtcgaccgcccagaagttgcc

SEQ ID NO: 9801 - DNA, 30 bp, Homo sapiens
  misc_feature 1..30: note = chr8:145806218-145806248
  misc_feature 1..30: note = hyper
  source 1..30: mol_type = genomic DNA
cccgccctcacctgccgctgtcctccttca

SEQ ID NO: 9802 - DNA, 40 bp, Homo sapiens
  misc_feature 1..40: note = chr9:73266-73306
  misc_feature 1..40: note = hyper
  source 1..40: mol_type = genomic DNA
ccggatgaagttgggcgggtagctgcgctggccctggaag

SEQ ID NO: 9803 - DNA, 93 bp, Homo sapiens
  misc_feature 1..93: note = chr9:113420-113513
  misc_feature 1..93: note = hyper
  source 1..93: mol_type = genomic DNA
cgcagcccagcttcccgggcaggctccacgctaccggggtccagtgcgcggcgacgaagcggagagctgtgtccagactccggagagaaactc

SEQ ID NO: 9804 - skipped

SEQ ID NO: 9805 - DNA, 380 bp, Homo sapiens
  misc_feature 1..380: note = chr9:113774-114154
  misc_feature 1..380: note = hyper
  source 1..380: mol_type = genomic DNA
ccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggag

SEQ ID NO: 9806 - DNA, 102 bp, Homo sapiens
  misc_feature 1..102: note = chr9:114750-114852
  misc_feature 1..102: note = hyper
  source 1..102: mol_type = genomic DNA
cggacccctccaagccgcctgggagcttccaaacaggtggacccgaagctcctgtttgatcggagaataacgttcaatttactccgccgctgaactgatggt

SEQ ID NO: 9807 - DNA, 84 bp, Homo sapiens; identical to SEQ ID NO: 841
  misc_feature 1..84: note = chr9:117876-117960
  misc_feature 1..84: note = hyper
  source 1..84: mol_type = genomic DNA

SEQ ID NO: 9808 - DNA, 144 bp, Homo sapiens; identical to SEQ ID NO: 3383
  misc_feature 1..144: note = chr9:841706-841850
  misc_feature 1..144: note = hyper
  source 1..144: mol_type = genomic DNA

SEQ ID NO: 9809 - DNA, 181 bp, Homo sapiens; identical to SEQ ID NO: 3384
  misc_feature 1..181: note = chr9:841851-842032
  misc_feature 1..181: note = hyper
  source 1..181: mol_type = genomic DNA

SEQ ID NO: 9810 - skipped

SEQ ID NO: 9811 - DNA, 43 bp, Homo sapiens
  misc_feature 1..43: note = chr9:842922-842965
  misc_feature 1..43: note = hyper
  source 1..43: mol_type = genomic DNA
agtcttcaggatcttcgctcccgccctccgaggtgaggctaga

SEQ ID NO: 9812 - DNA, 141 bp, Homo sapiens
  misc_feature 1..141: note = chr9:843219-843360
  misc_feature 1..141: note = hyper
  source 1..141: mol_type = genomic DNA
gccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctg

SEQ ID NO: 9813 - DNA, 187 bp, Homo sapiens
  misc_feature 1..187: note = chr9:969799-969986
  misc_feature 1..187: note = hyper
  source 1..187: mol_type = genomic DNA
gacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttg

SEQ ID NO: 9814 - DNA, 30 bp, Homo sapiens; identical to SEQ ID NO: 842
  misc_feature 1..30: note = chr9:970195-970225
  misc_feature 1..30: note = hyper
  source 1..30: mol_type = genomic DNA

SEQ ID NO: 9815 - DNA, 59 bp, Homo sapiens
  misc_feature 1..59: note = chr9:970533-970592
  misc_feature 1..59: note = hyper
  source 1..59: mol_type = genomic DNA
taagagtgcgcagaacgcgtgtgttcaagtgtgggcgtggcaggcgtcgtgtgctcgcc

SEQ ID NO: 9816 - DNA, 42 bp, Homo sapiens
  misc_feature 1..42: note = chr9:971138-971180
  misc_feature 1..42: note = hyper
  source 1..42: mol_type = genomic DNA
gcagctcccggccaccgggcgccggtggctcacgcctgtaat

SEQ ID NO: 9817 - DNA, 56 bp, Homo sapiens
  misc_feature 1..56: note = chr9:972016-972072
  misc_feature 1..56: note = hyper
  source 1..56: mol_type = genomic DNA
gctgggaggggaaagcggggcgtgtctggggggcggggccccgagcactccggaag

SEQ ID NO: 9818 - DNA, 414 bp, Homo sapiens; identical to SEQ ID NO: 843
  misc_feature 1..414: note = chr9:972345-972759
  misc_feature 1..414: note = hyper
  source 1..414: mol_type = genomic DNA

SEQ ID NO: 9819 - DNA, 67 bp, Homo sapiens
  misc_feature 1..67: note = chr9:973183-973250
  misc_feature 1..67: note = hyper
  source 1..67: mol_type = genomic DNA
cggtatccccgggccggtgaccccggggttcagtcgtctccccgaccccaagcggcctctgctttcc

SEQ ID NO: 9820 - DNA, 136 bp, Homo sapiens
  misc_feature 1..136: note = chr9:975809-975945
  misc_feature 1..136: note = hyper
  source 1..136: mol_type = genomic DNA
agtagctgctgggagcgagggaagaggatatcggtaactttgggggcgccaatgtggcttctgtgtctgccccttgaaagtttatacccggcgcttaacaaatcctttacaggagcacgtacgtccctgacctttc

SEQ ID NO: 9821 - DNA, 52 bp, Homo sapiens
  misc_feature 1..52: note = chr9:976147-976199
  misc_feature 1..52: note = hyper
  source 1..52: mol_type = genomic DNA
aactccacccaggtccggggtgcaaccgcaacactcccgtaggttcgagttc

SEQ ID NO: 9822 - DNA, 255 bp, Homo sapiens
  misc_feature 1..255: note = chr9:976435-976690
  misc_feature 1..255: note = hyper
  source 1..255: mol_type = genomic DNA
cttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtc

SEQ ID NO: 9823 - DNA, 96 bp, Homo sapiens
  misc_feature 1..96: note = chr9:977422-977518
  misc_feature 1..96: note = hyper
  source 1..96: mol_type = genomic DNA
ccggggctctgcaggcgcagctcgccaagccaggtaagagcgtctgaggtgcgggagtttggccgggcgcgggggcaacttcggagtgccagctgc

SEQ ID NO: 9824 - DNA, 46 bp, Homo sapiens
  misc_feature 1..46: note = chr9:981797-981843
  misc_feature 1..46: note = hyper
  source 1..46: mol_type = genomic DNA
ctgagcccagcttctcgccgcctgctggggacggctctttccttgg

SEQ ID NO: 9825 - DNA, 175 bp, Homo sapiens; identical to SEQ ID NO: 3388
  misc_feature 1..175: note = chr9:1042326-1042501
  misc_feature 1..175: note = hyper
  source 1..175: mol_type = genomic DNA

SEQ ID NO: 9826 - DNA, 328 bp, Homo sapiens; identical to SEQ ID NO: 3389
  misc_feature 1..328: note = chr9:1042615-1042943
  misc_feature 1..328: note = hyper
  source 1..328: mol_type = genomic DNA

SEQ ID NO: 9827 - DNA, 274 bp, Homo sapiens; identical to SEQ ID NO: 844
  misc_feature 1..274: note = chr9:1052044-1052318
  misc_feature 1..274: note = hyper
  source 1..274: mol_type = genomic DNA

SEQ ID NO: 9828 - DNA, 307 bp, Homo sapiens
  misc_feature 1..307: note = chr9:3181573-3181880
  misc_feature 1..307: note = hyper
  source 1..307: mol_type = genomic DNA
tcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagcacacaagtttggagagcgcgcgaggcacctgaaagtggttggggtttggaagcaaaagggtgacacctgctgttcgctgggaccgctctgcgggtgtgggcgtcggtttggaaacgtcctttgcctgag

SEQ ID NO: 9829 - DNA, 30 bp, Homo sapiens
  misc_feature 1..30: note = chr9:4299034-4299064
  misc_feature 1..30: note = hyper
  source 1..30: mol_type = genomic DNA
ccgtgcgtcctgtaacgtgccctgattgtg

SEQ ID NO: 9830 - DNA, 58 bp, Homo sapiens
  misc_feature 1..58: note = chr9:4299348-4299406
  misc_feature 1..58: note = hyper
  source 1..58: mol_type = genomic DNA
ccccacactctcaagcgcccggtttctcctcgtctctcgcctgcgagcaaagttccta

SEQ ID NO: 9831 - DNA, 30 bp, Homo sapiens
  misc_feature 1..30: note = chr9:4299642-4299672
  misc_feature 1..30: note = hyper
  source 1..30: mol_type = genomic DNA
ctgcgagggcagcggcggcagggggaggag

SEQ ID NO: 9832 - DNA, 94 bp, Homo sapiens
  misc_feature 1..94: note = chr9:4299969-4300063
  misc_feature 1..94: note = hyper
  source 1..94: mol_type = genomic DNA
gggctgcccgggcggcgcagtgtggacgcggctgcagggagaggggaagggggaagagggagggaggaaggcagccgggcgaggagtgtggatg

SEQ ID NO: 9833 - DNA, 263 bp, Homo sapiens; identical to SEQ ID NO: 3391
  misc_feature 1..263: note = chr9:6412587-6412850
  misc_feature 1..263: note = hyper
  source 1..263: mol_type = genomic DNA

SEQ ID NO: 9834 - DNA, 17 bp, Homo sapiens
  misc_feature 1..17: note = chr9:6644351-6644368
  misc_feature 1..17: note = hyper
  source 1..17: mol_type = genomic DNA
aacgcaggggaagctcg

SEQ ID NO: 9835 - DNA, 268 bp, Homo sapiens; identical to SEQ ID NO: 845
  misc_feature 1..268: note = chr9:6645065-6645333
  misc_feature 1..268: note = hyper
  source 1..268: mol_type = genomic DNA

SEQ ID NO: 9836 - DNA, 433 bp, Homo sapiens
  misc_feature 1..433: note = chr9:6645594-6646027
  misc_feature 1..433: note = hyper
  source 1..433: mol_type = genomic DNA
gcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctg

SEQ ID NO: 9837 - DNA, 30 bp, Homo sapiens
  misc_feature 1..30: note = chr9:8857443-8857473
  misc_feature 1..30: note = hyper
  source 1..30: mol_type = genomic DNA
gagaggacctctgcccgaggaggtccagag

SEQ ID NO: 9838 - DNA, 47 bp, Homo sapiens
  misc_feature 1..47: note = chr9:8858369-8858416
  misc_feature 1..47: note = hyper
  source 1..47: mol_type = genomic DNA
gcctgggaaagggcccgagcagagtcgagggccgggaggtggggtgg

SEQ ID NO: 9839 - DNA, 183 bp, Homo sapiens
  misc_feature 1..183: note = chr9:13278748-13278931
  misc_feature 1..183: note = hyper
  source 1..183: mol_type = genomic DNA
accggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctg

SEQ ID NO: 9840 - DNA, 32 bp, Homo sapiens
  misc_feature 1..32: note = chr9:13279717-13279749
  misc_feature 1..32: note = hyper
  source 1..32: mol_type = genomic DNA
cggcggggcggcgggcgcgccttggccaatca

SEQ ID NO: 9841 - DNA, 345 bp, Homo sapiens; identical to SEQ ID NO: 3394
  misc_feature 1..345: note = chr9:14348107-14348452
  misc_feature 1..345: note = hyper
  source 1..345: mol_type = genomic DNA

SEQ ID NO: 9842 - DNA, 43 bp, Homo sapiens
  misc_feature 1..43: note = chr9:16870864-16870907
  misc_feature 1..43: note = hyper
  source 1..43: mol_type = genomic DNA
cactcgcgccggggtcgcgctcgcgccccgagtcccagccggc

SEQ ID NO: 9843 - DNA, 42 bp, Homo sapiens
  misc_feature 1..42: note = chr9:17135632-17135674
  misc_feature 1..42: note = hyper
  source 1..42: mol_type = genomic DNA
cggccagacaggcttcgcctccgcgcccgggtttggttttgg

SEQ ID NO: 9844 - DNA, 48 bp, Homo sapiens
  misc_feature 1..48: note = chr9:17578826-17578874
  misc_feature 1..48: note = hyper
  source 1..48: mol_type = genomic DNA
gctgccaatctgcagcgacccgtccgcagcccccgggggcaggaacac

SEQ ID NO: 9845 - DNA, 63 bp, Homo sapiens
  misc_feature 1..63: note = chr9:17579090-17579153
  misc_feature 1..63: note = hyper
  source 1..63: mol_type = genomic DNA
tgtcccgctaggctccgcgccctcgcgcccatagccccggcggcggcacgaccagaggcggcc

SEQ ID NO: 9846 - DNA, 223 bp, Homo sapiens
  misc_feature 1..223: note = chr9:17579476-17579699
  misc_feature 1..223: note = hyper
  source 1..223: mol_type = genomic DNA
gcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggat

SEQ ID NO: 9847 - DNA, 51 bp, Homo sapiens
  misc_feature 1..51: note = chr9:17906058-17906109
  misc_feature 1..51: note = hyper
  source 1..51: mol_type = genomic DNA
gaaaagctccatgagcgcccaggggacaagtccccacggacaaacatgtca

SEQ ID NO: 9848 - DNA, 29 bp, Homo sapiens
  misc_feature 1..29: note = chr9:17906404-17906433
  misc_feature 1..29: note = hyper
  source 1..29: mol_type = genomic DNA
ataaatagaagccagcgcgcagccccgct

SEQ ID NO: 9849 - DNA, 210 bp, Homo sapiens
  misc_feature 1..210: note = chr9:17906460-17906670
  misc_feature 1..210: note = hyper
  source 1..210: mol_type = genomic DNA
cgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctcca

SEQ ID NO: 9850 - DNA, 22 bp, Homo sapiens
  misc_feature 1..22: note = chr9:17907450-17907472
  misc_feature 1..22: note = hyper
  source 1..22: mol_type = genomic DNA
cggacgccggaccaggtgggct

SEQ ID NO: 9851 - DNA, 30 bp, Homo sapiens
  misc_feature 1..30: note = chr9:19127231-19127261
  misc_feature 1..30: note = hyper
  source 1..30: mol_type = genomic DNA
ccaggacctggaagccgcgaggcgagcggg

SEQ ID NO: 9852 - DNA, 30 bp, Homo sapiens
  misc_feature 1..30: note = chr9:19788506-19788536
  misc_feature 1..30: note = hyper
  source 1..30: mol_type = genomic DNA
aatctaaaggacagacgccccacctgtgag

SEQ ID NO: 9853 - DNA, 153 bp, Homo sapiens; identical to SEQ ID NO: 846
  misc_feature 1..153: note = chr9:19789107-19789260
  misc_feature 1..153: note = hyper
  source 1..153: mol_type = genomic DNA

SEQ ID NO: 9854 - DNA, 294 bp, Homo sapiens
  misc_feature 1..294: note = chr9:21031479-21031773
  misc_feature 1..294: note = hyper
  source 1..294: mol_type = genomic DNA
gcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttggggaagagatgaaaacgaagttctcgaagtttctgcagc

SEQ ID NO: 9855 - DNA, 46 bp, Homo sapiens
  misc_feature 1..46: note = chr9:21396004-21396050
  misc_feature 1..46: note = hyper
  source 1..46: mol_type = genomic DNA
acactgactacggcacgatctgattttgagccgtcagtcccctcaa

SEQ ID NO: 9856 - DNA, 38 bp, Homo sapiens
  misc_feature 1..38: note = chr9:21396276-21396314
  misc_feature 1..38: note = hyper
  source 1..38: mol_type = genomic DNA
tggtgggtccgttaccgctggtccggcgccctctgtcg

SEQ ID NO: 9857 - DNA, 556 bp, Homo sapiens; identical to SEQ ID NO: 3397
  misc_feature 1..556: note = chr9:21402590-21403146
  misc_feature 1..556: note = hyper
  source 1..556: mol_type = genomic DNA

SEQ ID NO: 9858 - DNA, 83 bp, Homo sapiens
  misc_feature 1..83: note = chr9:21965057-21965140
  misc_feature 1..83: note = hyper
  source 1..83: mol_type = genomic DNA
ttggtgctggaggcccggccaaaggaagggctgctctcccgtcccgcgggctccgaggtcgccgcacccgggcgcgcctgggc

SEQ ID NO: 9859 - DNA, 191 bp, Homo sapiens
  misc_feature 1..191: note = chr9:21965569-21965760
  misc_feature 1..191: note = hyper
  source 1..191: mol_type = genomic DNA
cgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaa

SEQ ID NO: 9860 - DNA, 225 bp, Homo sapiens
  misc_feature 1..225: note = chr9:21968456-21968681
  misc_feature 1..225: note = hyper
  source 1..225: mol_type = genomic DNA
cgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggc

SEQ ID NO: 9861 - DNA, 19 bp, Homo sapiens
  misc_feature 1..19: note = chr9:21969231-21969250
  misc_feature 1..19: note = hyper
  source 1..19: mol_type = genomic DNA
acaaacaaacccaggcgtc

SEQ ID NO: 9862 - DNA, 30 bp, Homo sapiens
  misc_feature 1..30: note = chr9:21970999-21971029
  misc_feature 1..30: note = hyper
  source 1..30: mol_type = genomic DNA
cctcagccaggtccacgggcagacggcccc

SEQ ID NO: 9863 - DNA, 913 bp, Homo sapiens; identical to SEQ ID NO: 3398
  misc_feature 1..913: note = chr9:21974204-21975117
  misc_feature 1..913: note = hyper
  source 1..913: mol_type = genomic DNA

SEQ ID NO: 9864 - DNA, 418 bp, Homo sapiens; identical to SEQ ID NO: 3399
  misc_feature 1..418: note = chr9:21975190-21975608
  misc_feature 1..418: note = hyper
  source 1..418: mol_type = genomic DNA

SEQ ID NO: 9865 - DNA, 56 bp, Homo sapiens
  misc_feature 1..56: note = chr9:22447029-22447085
  misc_feature 1..56: note = hyper
  source 1..56: mol_type = genomic DNA
tccacttgggactcccggccagaaatttctcgggaatggagcggtcacagtgtggc

SEQ ID NO: 9866 - DNA, 30 bp, Homo sapiens
  misc_feature 1..30: note = chr9:23822576-23822606
  misc_feature 1..30: note = hyper
  source 1..30: mol_type = genomic DNA
tcagacccggccccacggctggaagtcaaa

SEQ ID NO: 9867 - DNA, 462 bp, Homo sapiens
  misc_feature 1..462: note = chr9:23824129-23824591
  misc_feature 1..462: note = hyper
  source 1..462: mol_type = genomic DNA
aaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataattta

SEQ ID NO: 9868 - DNA, 39 bp, Homo sapiens
  misc_feature 1..39: note = chr9:23826326-23826365
  misc_feature 1..39: note = hyper
  source 1..39: mol_type = genomic DNA
gccaggctcctatcccgggcagcacgcgcggaagtatac

SEQ ID NO: 9869 - DNA, 30 bp, Homo sapiens
  misc_feature 1..30: note = chr9:23831139-23831169
  misc_feature 1..30: note = hyper
  source 1..30: mol_type = genomic DNA
tatgcttccgatgctcggaggctctttctt

SEQ ID NO: 9870 - DNA, 15 bp, Homo sapiens
  misc_feature 1..15: note = chr9:23831450-23831465
  misc_feature 1..15: note = hyper
  source 1..15: mol_type = genomic DNA
cgggccacggtgaca

SEQ ID NO: 9871 - DNA, 97 bp, Homo sapiens
  misc_feature 1..97: note = chr9:29212210-29212307
  misc_feature 1..97: note = hyper
  source 1..97: mol_type = genomic DNA
cggaagcgcgccgggactgccgctcacgtcccccgcccctgccgcgcgggctccgccaccccgcgagcacgctggctctccgcgctcaccccgccgc

SEQ ID NO: 9872 - DNA, 51 bp, Homo sapiens
  misc_feature 1..51: note = chr9:29212731-29212782
  misc_feature 1..51: note = hyper
  source 1..51: mol_type = genomic DNA
tctggcttcctgcctcgcagctgggcagcgccgcaccggctactccctgac

SEQ ID NO: 9873 - DNA, 30 bp, Homo sapiens
  misc_feature 1..30: note = chr9:29213181-29213211
  misc_feature 1..30: note = hyper
  source 1..30: mol_type = genomic DNA
tattcagttttcttccgtaaccccacagac

SEQ ID NO: 9874 - DNA, 111 bp, Homo sapiens
  misc_feature 1..111: note = chr9:29213524-29213635
  misc_feature 1..111: note = hyper
  source 1..111: mol_type = genomic DNA
ggctgcaaggcgggacgcaggatagccggctggggcttggcagccgggctcagagctcgggctgcgcacacacacaggcgcgcacacccgcgcgcgcgcagctacacacgc

SEQ ID NO: 9875 - DNA, 54 bp, Homo sapiens
  misc_feature 1..54: note = chr9:29214035-29214089
  misc_feature 1..54: note = hyper
  source 1..54: mol_type = genomic DNA
gcctacacatcgcttcgtgaacataatcccctcgcatcccgtctttacctgccc

SEQ ID NO: 9876 - DNA, 70 bp, Homo sapiens
  misc_feature 1..70: note = chr9:29214360-29214430
  misc_feature 1..70: note = hyper
  source 1..70: mol_type = genomic DNA
ttctttttcttccctcgacggtcgggagggatcactgggtgctacaccgctggggcgtcccaggcaggag

SEQ ID NO: 9877 - DNA, 32 bp, Homo sapiens
  misc_feature 1..32: note = chr9:29214681-29214713
  misc_feature 1..32: note = hyper
  source 1..32: mol_type = genomic DNA
tgccctctggggcttcgcgaatatctatggct

SEQ ID NO: 9878 - DNA, 93 bp, Homo sapiens; identical to SEQ ID NO: 847
  misc_feature 1..93: note = chr9:29214993-29215086
  misc_feature 1..93: note = hyper
  source 1..93: mol_type = genomic DNA

SEQ ID NO: 9879 - DNA, 256 bp, Homo sapiens; identical to SEQ ID NO: 3401
  misc_feature 1..256: note = chr9:32782680-32782936
  misc_feature 1..256: note = hyper
  source 1..256: mol_type = genomic DNA

SEQ ID NO: 9880 - DNA, 138 bp, Homo sapiens; identical to SEQ ID NO: 3402
  misc_feature 1..138: note = chr9:32783083-32783221
  misc_feature 1..138: note = hyper
  source 1..138: mol_type = genomic DNA

SEQ ID NO: 9881 - DNA, 161 bp, Homo sapiens; identical to SEQ ID NO: 3403
  misc_feature 1..161: note = chr9:32783259-32783420
  misc_feature 1..161: note = hyper
  source 1..161: mol_type = genomic DNA

SEQ ID NO: 9882 - DNA, 48 bp, Homo sapiens; identical to SEQ ID NO: 3404
  misc_feature 1..48: note = chr9:32783590-32783638
  misc_feature 1..48: note = hyper
  source 1..48: mol_type = genomic DNA

SEQ ID NO: 9883 - DNA, 95 bp, Homo sapiens
  misc_feature 1..95: note = chr9:33523986-33524081
  misc_feature 1..95: note = hyper
  source 1..95: mol_type = genomic DNA
gaaccgaccctcagccccatccccgcggacggtccctggagcggccccgatctctcttcggagaagaggggcgggagtcacggccaggcgggaag

SEQ ID NO: 9884 - DNA, 194 bp, Homo sapiens
  misc_feature 1..194: note = chr9:33524499-33524693
  misc_feature 1..194: note = hyper
  source 1..194: mol_type = genomic DNA
ctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacag

SEQ ID NO: 9885 - DNA, 614 bp, Homo sapiens
  misc_feature 1..614: note = chr9:33676771-33677385
  misc_feature 1..614: note = hyper
  source 1..614: mol_type = genomic DNA
tgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggc

SEQ ID NO: 9886 - DNA, 195 bp, Homo sapiens
  misc_feature 1..195: note = chr9:34589062-34589257
  misc_feature 1..195: note = hyper
  source 1..195: mol_type = genomic DNA
acacgcgcgcgcgggcgcgcggattcacacggacacacatgcactggcagacgcgcaaccgtcggttcgcatccccgggcgctttgaagtccagatttctgcccgagaaagaagccacctttgggcgcgcaaaggccactacgaacctccccaaacccaggaatttttccagaccccgcgcgtgcagctgagggg

SEQ ID NO: 9887 - DNA, 30 bp, Homo sapiens
  misc_feature 1..30: note = chr9:34590193-34590223
  misc_feature 1..30: note = hyper
  source 1..30: mol_type = genomic DNA
cccgctcccctagggcggctgggcgcgcac

SEQ ID NO: 9888 - DNA, 154 bp, Homo sapiens
  misc_feature 1..154: note = chr9:35675494-35675648
  misc_feature 1..154: note = hyper
  source 1..154: mol_type = genomic DNA
ggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcc

SEQ ID NO: 9889 - DNA, 294 bp, Homo sapiens
  misc_feature 1..294: note = chr9:35675837-35676131
  misc_feature 1..294: note = hyper
  source 1..294: mol_type = genomic DNA
gccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctg

SEQ ID NO: 9890 - DNA, 65 bp, Homo sapiens
  misc_feature 1..65: note = chr9:35728859-35728924
  misc_feature 1..65: note = hyper
  source 1..65: mol_type = genomic DNA
agggctcccagtccacgagatgagtgaataagccaagtacagaatcacaacggagggcaggatgt

SEQ ID NO: 9891 - DNA, 308 bp, Homo sapiens
  misc_feature 1..308: note = chr9:36037287-36037595
  misc_feature 1..308: note = hyper
  source 1..308: mol_type = genomic DNA
ccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacatt

SEQ ID NO: 9892 - DNA, 261 bp, Homo sapiens
  misc_feature 1..261: note = chr9:36258385-36258646
  misc_feature 1..261: note = hyper
  source 1..261: mol_type = genomic DNA
acgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccg

SEQ ID NO: 9893 - DNA, 321 bp, Homo sapiens
  misc_feature 1..321: note = chr9:36258697-36259018
  misc_feature 1..321: note = hyper
  source 1..321: mol_type = genomic DNA
cgtcctcctccactggcgacacacgcactgaagcccgagtcttcccgctgggtagttgttttggtcttgcacccaaggagggatttcttgcgcctcttgttccctcagttatttcataaaccaggaccgcaactatactgtcgtgtagcgcggccaccccacagcggtccctgacgttaacccttgccgtgactgctagaagacactggtggagtgtgaattgatgaccaaggcatggcagagcctctctcatctttataatcagttcagcggcggcctccactacagggaactcccagccagtcccgaggcctagggaca

SEQ ID NO: 9894 - DNA, 148 bp, Homo sapiens; identical to SEQ ID NO: 3405
  misc_feature 1..148: note = chr9:36739852-36740000
  misc_feature 1..148: note = hyper
  source 1..148: mol_type = genomic DNA

SEQ ID NO: 9895 - skipped

SEQ ID NO: 9896 - DNA, 171 bp, Homo sapiens; identical to SEQ ID NO: 3407
  misc_feature 1..171: note = chr9:37002818-37002989
  misc_feature 1..171: note = hyper
  source 1..171: mol_type = genomic DNA

SEQ ID NO: 9897 - DNA, 1046 bp, Homo sapiens; identical to SEQ ID NO: 3408
  misc_feature 1..1046: note = chr9:37025306-37026352
  misc_feature 1..1046: note = hyper
  source 1..1046: mol_type = genomic DNA

SEQ ID NO: 9898 - DNA, 839 bp, Homo sapiens; identical to SEQ ID NO: 3409
  misc_feature 1..839: note = chr9:37026433-37027272
  misc_feature 1..839: note = hyper
  source 1..839: mol_type = genomic DNA

SEQ ID NO: 9899 - DNA, 60 bp, Homo sapiens; identical to SEQ ID NO: 3410
  misc_feature 1..60: note = chr9:37027324-37027384
  misc_feature 1..60: note = hyper
  source 1..60: mol_type = genomic DNA

SEQ ID NO: 9900 - DNA, 444 bp, Homo sapiens; identical to SEQ ID NO: 3411
  misc_feature 1..444: note = chr9:37027385-37027829
  misc_feature 1..444: note = hyper
  source 1..444: mol_type = genomic DNA

SEQ ID NO: 9901 - DNA, 30 bp, Homo sapiens
  misc_feature 1..30: note = chr9:37028470-37028500
  misc_feature 1..30: note = hyper
  source 1..30: mol_type = genomic DNA
agttagtaactggggcgcaccagggcgcac

SEQ ID NO: 9902 - DNA, 43 bp, Homo sapiens
  misc_feature 1..43: note = chr9:37029348-37029391
  misc_feature 1..43: note = hyper
  source 1..43: mol_type = genomic DNA
cagtagacaagtttccggcgctgacacccgtccccacccccca

SEQ ID NO: 9903 - DNA, 874 bp, Homo sapiens; identical to SEQ ID NO: 848
  misc_feature 1..874: note = chr9:37029893-37030767
  misc_feature 1..874: note = hyper
  source 1..874: mol_type = genomic DNA

SEQ ID NO: 9904 - DNA, 647 bp, Homo sapiens
  misc_feature 1..647: note = chr9:37034217-37034864
  misc_feature 1..647: note = hyper
  source 1..647: mol_type = genomic DNA
taggtggaaaaaaagcgtccgaaggcaccgtgaaatgattaaggaactaaagagcttctcgccatgtgagatcatgtcctgttctcgccaacatcacaagatgtccccagacacgccgcgcccccagcgcgccgccccacactgccggcccggagcgaggaaagggtaggcgctgcgcggccgggcctgctcagcgcgccagacgtggcggacccggcccggccggagtagagcgggaagccgggagagcagcagtgctgctgccgcgccgccccagacttttataggggttggggggagggaaggaaggcttcagcctgcgccgggcgctagccagcgcacctacgggaaggggcagaccgaagcggagcccgggagcccgggtcttccagccgcaccttctattaagacatgcgcttgggggtcgcggccctctgcgctgtgcgcggggcctgtgacatctccatgtgcaaaccccgctgcttagacgagcgcaggccgggtttttgtttttgaagaaattaactgctcggccaagcaggtgcttttgaaaggggttgcaaaggctggcagtgttgccaggcaccgaggcgacgttccggtttactccgattcacccctagggcggcgcccgaccccagggttcc

SEQ ID NO: 9905 - DNA, 246 bp, Homo sapiens
  misc_feature 1..246: note = chr9:37035534-37035780
  misc_feature 1..246: note = hyper
  source 1..246: mol_type = genomic DNA
gaagagcctagagctcgaggaaaggggggcccccggcggcaactggacatcacatatccactgagcagatttcgccacaatcggaaatgtggctgtggattcccgggcggcccccccaccaagtggtctgcgcagttccccagcgccgcctcctccctgcagcctgcgggcccgtgtccctaccccgagatttgatttttggccatctccgagtgctcgactctttccctccgcagcccagcccca

SEQ ID NO: 9906 - DNA, 432 bp, Homo sapiens; identical to SEQ ID NO: 3413
  misc_feature 1..432: note = chr9:37036462-37036894
  misc_feature 1..432: note = hyper
  source 1..432: mol_type = genomic DNA

SEQ ID NO: 9907 - DNA, 812 bp, Homo sapiens; identical to SEQ ID NO: 849
  misc_feature 1..812: note = chr9:37037453-37038265
  misc_feature 1..812: note = hyper
  source 1..812: mol_type = genomic DNA

SEQ ID NO: 9908 - DNA, 54 bp, Homo sapiens
  misc_feature 1..54: note = chr9:38424355-38424409
  misc_feature 1..54: note = hyper
  source 1..54: mol_type = genomic DNA
cagcggcggcagcagcggcagcagcagcagaagcagcagcggcaagagcagaga

SEQ ID NO: 9909 - DNA, 30 bp, Homo sapiens
  misc_feature 1..30: note = chr9:38621877-38621907
  misc_feature 1..30: note = hyper
  source 1..30: mol_type = genomic DNA
acatctgcccacagccgcagcctcctgcac

SEQ ID NO: 9910 - DNA, 42 bp, Homo sapiens
  misc_feature 1..42: note = chr9:38622559-38622601
  misc_feature 1..42: note = hyper
  source 1..42: mol_type = genomic DNA
gcccgagagacagcacgtcaccgtcaccgtcaccgcctagcg

SEQ ID NO: 9911 - DNA, 25 bp, Homo sapiens
  misc_feature 1..25: note = chr9:66458550-66458575
  misc_feature 1..25: note = hyper
  source 1..25: mol_type = genomic DNA
gggcggcctcctttccgcccacgct

SEQ ID NO: 9912 - DNA, 34 bp, Homo sapiens
  misc_feature 1..34: note = chr9:66494123-66494157
  misc_feature 1..34: note = hyper
  source 1..34: mol_type = genomic DNA
ctgctggaatgcttgcgctcgaggcctgagggac

SEQ ID NO: 9913 - DNA, 166 bp, Homo sapiens
  misc_feature 1..166: note = chr9:71788978-71789144
  misc_feature 1..166: note = hyper
  source 1..166: mol_type = genomic DNA
tcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaa

SEQ ID NO: 9914 - DNA, 78 bp, Homo sapiens
  misc_feature 1..78: note = chr9:74061681-74061759
  misc_feature 1..78: note = hyper
  source 1..78: mol_type = genomic DNA
tctccgcgttgtcctcgcggtcggagcagccccgctccatttccgccgcatccctccacttcttccccatgagaagtt

SEQ ID NO: 9915 - DNA, 304 bp, Homo sapiens
  misc_feature 1..304: note = chr9:74061787-74062091
  misc_feature 1..304: note = hyper
  source 1..304: mol_type = genomic DNA
cgccgagcgctctcgctggctcctcgccgcgggtctccctccagcctgcgcgcggctctcggttggcgctgcctttgcctccgccggctcctgccagagccccgcgctccgttaccgccgccgccaccaggctgcgcttgcgcccgcgattggctcaactgtgggctggggctgcgagcgccacctgcgcccgagccagctttcttttgcgtccccaaattgctctccacccggcagccgccgccttctctggagagtgcagggcccacgcctgaggctgttgatgcgccgcagggtagcgctc

SEQ ID NO: 9916 - DNA, 49 bp, Homo sapiens
  misc_feature 1..49: note = chr9:74764314-74764363
  misc_feature 1..49: note = hyper
  source 1..49: mol_type = genomic DNA
cggcctgcagggtaccggcaaccgcccgggtaagcgggggcaggacaag

SEQ ID NO: 9917 - DNA, 80 bp, Homo sapiens
  misc_feature 1..80: note = chr9:77111763-77111843
  misc_feature 1..80: note = hyper
  source 1..80: mol_type = genomic DNA
caaaccacctgcccacggaaacccccgccggagaccgaagtttacccaaatagcgctcggcaaagcgctgccataaattc

SEQ ID NO: 9918 - DNA, 69 bp, Homo sapiens
  misc_feature 1..69: note = chr9:77112827-77112896
  misc_feature 1..69: note = hyper
  source 1..69: mol_type = genomic DNA
gggctctccggggttcgggctgggagcagcttcatgactacgcggagcgggagagcggccacaccatgc

SEQ ID NO: 9919 - DNA, 436 bp, Homo sapiens
  misc_feature 1..436: note = chr9:77112897-77113333
  misc_feature 1..436: note = hyper
  source 1..436: mol_type = genomic DNA
aggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcaggg

SEQ ID NO: 9920 - DNA, 45 bp, Homo sapiens
  misc_feature 1..45: note = chr9:77113664-77113709
  misc_feature 1..45: note = hyper
  source 1..45: mol_type = genomic DNA
tgtcagataaagggccggtagtggaaggaggtgctggtgcaccct

SEQ ID NO: 9921 - DNA, 20 bp, Homo sapiens
  misc_feature 1..20: note = chr9:77113805-77113825
  misc_feature 1..20: note = hyper
  source 1..20: mol_type = genomic DNA
cgttacgcttgctccggctg

SEQ ID NO: 9922 - DNA, 124 bp, Homo sapiens
  misc_feature 1..124: note = chr9:77114745-77114869
  misc_feature 1..124: note = hyper
  source 1..124: mol_type = genomic DNA
ttcatactttctgaacgtcgtaaactatgcgccacctcagctcggacccagcactaggacctagggcataaaatccgctcactccttacatcgtagaaggagtgcggcgcggggtggggatggg

SEQ ID NO: 9923 - DNA, 30 bp, Homo sapiens; identical to SEQ ID NO: 3415
  misc_feature 1..30: note = chr9:77115417-77115447
  misc_feature 1..30: note = hyper
  source 1..30: mol_type = genomic DNA

SEQ ID NO: 9924 - DNA, 522 bp, Homo sapiens; identical to SEQ ID NO: 850
  misc_feature 1..522: note = chr9:79626876-79627398
  misc_feature 1..522: note = hyper
  source 1..522: mol_type = genomic DNA

SEQ ID NO: 9925 - DNA, 35 bp, Homo sapiens
  misc_feature 1..35: note = chr9:79628238-79628273
  misc_feature 1..35: note = hyper
  source 1..35: mol_type = genomic DNA
tggatcaacaacatccgccccgcccccccaactcc

SEQ ID NO: 9926 - DNA, 199 bp, Homo sapiens; identical to SEQ ID NO: 851
  misc_feature 1..199: note = chr9:79629207-79629406
  misc_feature 1..199: note = hyper
  source 1..199: mol_type = genomic DNA

SEQ ID NO: 9927 - DNA, 54 bp, Homo sapiens
  misc_feature 1..54: note = chr9:79631016-79631070
  misc_feature 1..54: note = hyper
  source 1..54: mol_type = genomic DNA
gtcggaattaacctccggggaagtaggggaagaggagagcgcgcccccctcccc

SEQ ID NO: 9928 - DNA, 36 bp, Homo sapiens
  misc_feature 1..36: note = chr9:79631555-79631591
  misc_feature 1..36: note = hyper
  source 1..36: mol_type = genomic DNA
gccgcaagtgcccaacgggcacggtcccagagctgc

SEQ ID NO: 9929 - DNA, 43 bp, Homo sapiens
  misc_feature 1..43: note = chr9:79631911-79631954
  misc_feature 1..43: note = hyper
  source 1..43: mol_type = genomic DNA
tctcaagtgtctcagcggacaaaaatcgcgcagaaactcctat

SEQ ID NO: 9930 - DNA, 30 bp, Homo sapiens
  misc_feature 1..30: note = chr9:79632823-79632853
  misc_feature 1..30: note = hyper
  source 1..30: mol_type = genomic DNA
ccccagctcagacatcgccatcccagagaa

SEQ ID NO: 9931 - DNA, 350 bp, Homo sapiens; identical to SEQ ID NO: 3418
  misc_feature 1..350: note = chr9:79633334-79633684
  misc_feature 1..350: note = hyper
  source 1..350: mol_type = genomic DNA

SEQ ID NO: 9932 - DNA, 531 bp, Homo sapiens; identical to SEQ ID NO: 3419
  misc_feature 1..531: note = chr9:79634237-79634768
  misc_feature 1..531: note = hyper
  source 1..531: mol_type = genomic DNA

SEQ ID NO: 9933 - DNA, 400 bp, Homo sapiens; identical to SEQ ID NO: 3420
  misc_feature 1..400: note = chr9:79635049-79635449
  misc_feature 1..400: note = hyper
  source 1..400: mol_type = genomic DNA

SEQ ID NO: 9934 - DNA, 131 bp, Homo sapiens; identical to SEQ ID NO: 852
  misc_feature 1..131: note = chr9:79635834-79635965
  misc_feature 1..131: note = hyper
  source 1..131: mol_type = genomic DNA

SEQ ID NO: 9935 - DNA, 295 bp, Homo sapiens; identical to SEQ ID NO: 853
  misc_feature 1..295: note = chr9:79636258-79636553
  misc_feature 1..295: note = hyper
  source 1..295: mol_type = genomic DNA

SEQ ID NO: 9936 - DNA, 106 bp, Homo sapiens
  misc_feature 1..106: note = chr9:79636847-79636953
  misc_feature 1..106: note = hyper
  source 1..106: mol_type = genomic DNA
aatgcaggaaaaactcggcacatcactcgacaatattgctcttaacgcttgcagaaacgttccatggctgttcccttccagtctcctcggacggaagcaaggggac

SEQ ID NO: 9937 - DNA, 135 bp, Homo sapiens
  misc_feature 1..135: note = chr9:79637184-79637319
  misc_feature 1..135: note = hyper
  source 1..135: mol_type = genomic DNA
gctctaagtcacctccgcctcttgtccgcgccgcgttcgggttgtgactttgtttatgtctgctggtgttgtacgcggtgttctctattaaagcttctctctggatatctatgctagccccgtgtgaaggtgttt

SEQ ID NO: 9938 - DNA, 230 bp, Homo sapiens; identical to SEQ ID NO: 854
  misc_feature 1..230: note = chr9:79637659-79637889
  misc_feature 1..230: note = hyper
  source 1..230: mol_type = genomic DNA

SEQ ID NO: 9939 - DNA, 46 bp, Homo sapiens; identical to SEQ ID NO: 855
  misc_feature 1..46: note = chr9:79638136-79638182
  misc_feature 1..46: note = hyper
  source 1..46: mol_type = genomic DNA

SEQ ID NO: 9940 - DNA, 40 bp, Homo sapiens
  misc_feature 1..40: note = chr9:80263460-80263500
  misc_feature 1..40: note = hyper
  source 1..40: mol_type = genomic DNA
gtttgctgtaatctgcgcgtctggccgccaggcaccgggt

SEQ ID NO: 9941 - DNA, 30 bp, Homo sapiens
  misc_feature 1..30: note = chr9:86152387-86152417
  misc_feature 1..30: note = hyper
  source 1..30: mol_type = genomic DNA
atccctcaaggctggcgcccagggcagccc

SEQ ID NO: 9942 - DNA, 107 bp, Homo sapiens; identical to SEQ ID NO: 3425
  misc_feature 1..107: note = chr9:86755532-86755639
  misc_feature 1..107: note = hyper
  source 1..107: mol_type = genomic DNA

SEQ ID NO: 9943 - DNA, 268 bp, Homo sapiens
  misc_feature 1..268: note = chr9:87283035-87283303
  misc_feature 1..268: note = hyper
  source 1..268: mol_type = genomic DNA
cgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgt

SEQ ID NO: 9944 - DNA, 30 bp, Homo sapiens
  misc_feature 1..30: note = chr9:87283616-87283646
  misc_feature 1..30: note = hyper
  source 1..30: mol_type = genomic DNA
tagctggatgcatatcgtgctccgggcagc

SEQ ID NO: 9945 - DNA, 30 bp, Homo sapiens
  misc_feature 1..30: note = chr9:87284009-87284039
  misc_feature 1..30: note = hyper
  source 1..30: mol_type = genomic DNA
cccctccaaaaccaccgatccccaaatagg

SEQ ID NO: 9946 - DNA, 439 bp, Homo sapiens
  misc_feature 1..439: note = chr9:87284555-87284994
  misc_feature 1..439: note = hyper
  source 1..439: mol_type = genomic DNA
ttgtgtgtgtatgagcgtgtgtgtgtttttggatttcagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcat

SEQ ID NO: 9947 - DNA, 254 bp, Homo sapiens
  misc_feature 1..254: note = chr9:87285279-87285533
  misc_feature 1..254: note = hyper
  source 1..254: mol_type = genomic DNA
gtttgtcctcagcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggact

SEQ ID NO: 9948 - DNA, 30 bp, Homo sapiens; identical to SEQ ID NO: 3426
  misc_feature 1..30: note = chr9:88137696-88137726
  misc_feature 1..30: note = hyper
  source 1..30: mol_type = genomic DNA

SEQ ID NO: 9949 - DNA, 240 bp, Homo sapiens; identical to SEQ ID NO: 3427
  misc_feature 1..240: note = chr9:88137874-88138114
  misc_feature 1..240: note = hyper
  source 1..240: mol_type = genomic DNA

SEQ ID NO: 9950 - DNA, 50 bp, Homo sapiens
  misc_feature 1..50: note = chr9:89560715-89560765
  misc_feature 1..50: note = hyper
  source 1..50: mol_type = genomic DNA
ggggcgccaagcggccgccgccgccgctgctcctgcgcccaggcccatag

SEQ ID NO: 9951 - DNA, 35 bp, Homo sapiens
  misc_feature 1..35: note = chr9:89560977-89561012
  misc_feature 1..35: note = hyper
  source 1..35: mol_type = genomic DNA
catgttctccttgaccgactcgcagatgggccgct

SEQ ID NO: 9952 - skipped

SEQ ID NO: 9953 - DNA, 165 bp, Homo sapiens
  misc_feature 1..165: note = chr9:91150170-91150335
  misc_feature 1..165: note = hyper
  source 1..165: mol_type = genomic DNA
tgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggc

SEQ ID NO: 9954 - DNA, 97 bp, Homo sapiens; identical to SEQ ID NO: 3428
  misc_feature 1..97: note = chr9:91606004-91606101
  misc_feature 1..97: note = hyper
  source 1..97: mol_type = genomic DNA

SEQ ID NO: 9955 - DNA, 38 bp, Homo sapiens
  misc_feature 1..38: note = chr9:91606320-91606358
  misc_feature 1..38: note = hyper
  source 1..38: mol_type = genomic DNA
gcggagcgcgggtcccgccccggcgggccgctggaaaa

SEQ ID NO: 9956 - DNA, 30 bp, Homo sapiens
  misc_feature 1..30: note = chr9:91792357-91792387
  misc_feature 1..30: note = hyper
  source 1..30: mol_type = genomic DNA
tgagaaagtaaagcccgtcgaagagaaagc

SEQ ID NO: 9957 - DNA, 50 bp, Homo sapiens
  misc_feature 1..50: note = chr9:91793476-91793526
  misc_feature 1..50: note = hyper
  source 1..50: mol_type = genomic DNA
ggagagtgggggccccgggacagccttctggagaacgagagcagagcaag

SEQ ID NO: 9958 - DNA, 30 bp, Homo sapiens
  misc_feature 1..30: note = chr9:91849779-91849809
  misc_feature 1..30: note = hyper
  source 1..30: mol_type = genomic DNA
agaaacccctgaaatcggaaatactctaac

SEQ ID NO: 9959 - DNA, 67 bp, Homo sapiens
  misc_feature 1..67: note = chr9:94183858-94183925
  misc_feature 1..67: note = hyper
  source 1..67: mol_type = genomic DNA
cagaccccaccggcccgcaggagggagcggcgcactgggggccgcacggactcgccattggagatcg

SEQ ID NO: 9960 - DNA, 30 bp, Homo sapiens
  misc_feature 1..30: note = chr9:94711494-94711524
  misc_feature 1..30: note = hyper
  source 1..30: mol_type = genomic DNA
tcggccaccccagagcggtgggggagagga

SEQ ID NO: 9961 - DNA, 120 bp, Homo sapiens; identical to SEQ ID NO: 3429
  misc_feature 1..120: note = chr9:94712294-94712414
  misc_feature 1..120: note = hyper
  source 1..120: mol_type = genomic DNA

SEQ ID NO: 9962 - DNA, 70 bp, Homo sapiens
  misc_feature 1..70: note = chr9:94713007-94713077
  misc_feature 1..70: note = hyper
  source 1..70: mol_type = genomic DNA
aaaactgccaggggtcgagctgcgtggagggagccctcgggagcgcgatgctatccgaagccaccgcggc

SEQ ID NO: 9963 - DNA, 517 bp, Homo sapiens
  misc_feature 1..517: note = chr9:95569984-95570501
  misc_feature 1..517: note = hyper
  source 1..517: mol_type = genomic DNA
tgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccgcgtctgctgcttctccgacgccagggcgccgccaggatgacaggtgcaggagactgtggctgtgggcagatgtggtttccagccccaggtccccgcggcccctggcttcccagcgcgctgtcctgtgagcaagaagatgaaaaaagccacccgatcaacaggtcagctgccccgcctggcagcccagccagacaaggcaaccgaagttcatcctctctgagttgacttcgtgcgggcagcgggccggcgcccag

SEQ ID NO: 9964 - DNA, 387 bp, Homo sapiens
  misc_feature 1..387: note = chr9:95571544-95571931
  misc_feature 1..387: note = hyper
  source 1..387: mol_type = genomic DNA
ctcgggagcggtttccggagtccgagctggcgctgagctgcaggcgcgagcctaaaggcttagccggggcccacgctgtctgagagatcggagcgttcagctacaggcacgcgcttaacggcttcgtggagctcactcggtctgagaggtcggaggctgcgagtgtcgctgctgaaggctgtggtggaccaggctggatcgcggattctgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtc

SEQ ID NO: 9965 - DNA, 109 bp, Homo sapiens
  misc_feature 1..109: note = chr9:95572141-95572250
  misc_feature 1..109: note = hyper
  source 1..109: mol_type = genomic DNA
agaaaagacaggtatcgggggctcagcctgcggtgggagggggccccaggcccggcttccctgcagcccctggggcgggggccttggagggccccgggcaccctcggag

SEQ ID NO: 9966 - DNA, 65 bp, Homo sapiens
  misc_feature 1..65: note = chr9:96588857-96588922
  misc_feature 1..65: note = hyper
  source 1..65: mol_type = genomic DNA
cggggcgggttgccgcccctcccgggagtacgggcggaggcaggggcgggcgggggctttcagca

SEQ ID NO: 9967 - DNA, 129 bp, Homo sapiens
  misc_feature 1..129: note = chr9:96708329-96708458
  misc_feature 1..129: note = hyper
  source 1..129: mol_type = genomic DNA
attgcctggtggaagcggagctgccgcgggggctggggcggcagcgcgtgcgggcggagttgcgttcggcagggcggacttggggcggctgtcaggggctctcccgggccaaggcgcaagagcaagacg

SEQ ID NO: 9968 - DNA, 651 bp, Homo sapiens; identical to SEQ ID NO: 3430
  misc_feature 1..651: note = chr9:96710796-96711447
  misc_feature 1..651: note = hyper
  source 1..651: mol_type = genomic DNA

SEQ ID NO: 9969 - DNA, 83 bp, Homo sapiens; identical to SEQ ID NO: 3431
  misc_feature 1..83: note = chr9:96711534-96711617
  misc_feature 1..83: note = hyper
  source 1..83: mol_type = genomic DNA

SEQ ID NO: 9970 - DNA, 266 bp, Homo sapiens
  misc_feature 1..266: note = chr9:96713627-96713893
  misc_feature 1..266: note = hyper
  source 1..266: mol_type = genomic DNA
gaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctg

SEQ ID NO: 9971 - DNA, 524 bp, Homo sapiens; identical to SEQ ID NO: 3432
  misc_feature 1..524: note = chr9:96716904-96717428
  misc_feature 1..524: note = hyper
  source 1..524: mol_type = genomic DNA

SEQ ID NO: 9972 - DNA, 85 bp, Homo sapiens; identical to SEQ ID NO: 3433
  misc_feature 1..85: note = chr9:96717449-96717534
  misc_feature 1..85: note = hyper
  source 1..85: mol_type = genomic DNA

SEQ ID NO: 9973 - DNA, 220 bp, Homo sapiens; identical to SEQ ID NO: 3434
  misc_feature 1..220: note = chr9:96717979-96718199
  misc_feature 1..220: note = hyper
  source 1..220: mol_type = genomic DNA

SEQ ID NO: 9974 - skipped

SEQ ID NO: 9975 - DNA, 366 bp, Homo sapiens; identical to SEQ ID NO: 857
  misc_feature 1..366: note = chr9:96721102-96721468
  misc_feature 1..366: note = hyper
  source 1..366: mol_type = genomic DNA

SEQ ID NO: 9976 - DNA, 114 bp, Homo sapiens; identical to SEQ ID NO: 858
  misc_feature 1..114: note = chr9:96721688-96721802
  misc_feature 1..114: note = hyper
  source 1..114: mol_type = genomic DNA

SEQ ID NO: 9977 - DNA, 212 bp, Homo sapiens; identical to SEQ ID NO: 859
  misc_feature 1..212: note = chr9:98111349-98111561
  misc_feature 1..212: note = hyper
  source 1..212: mol_type = genomic DNA

SEQ ID NO: 9978 - DNA, 264 bp, Homo sapiens; identical to SEQ ID NO: 860
  misc_feature 1..264: note = chr9:98111894-98112158
  misc_feature 1..264: note = hyper
  source 1..264: mol_type = genomic DNA

SEQ ID NO: 9979 - DNA, 52 bp, Homo sapiens; identical to SEQ ID NO: 861
  misc_feature 1..52: note = chr9:98112343-98112395
  misc_feature 1..52: note = hyper
  source 1..52: mol_type = genomic DNA

SEQ ID NO: 9980 - DNA, 47 bp, Homo sapiens
  misc_feature 1..47: note = chr9:98783352-98783399
  misc_feature 1..47: note = hyper
  source 1..47: mol_type = genomic DNA
cgggcacagggaggccgttcggctttccccctcgcgcccattactct

SEQ ID NO: 9981 - DNA, 33 bp, Homo sapiens
  misc_feature 1..33: note = chr9:98784201-98784234
  misc_feature 1..33: note = hyper
  source 1..33: mol_type = genomic DNA
atggaatcagggccccggcgcccccacgccgct

SEQ ID NO: 9982 - DNA, 30 bp, Homo sapiens
  misc_feature 1..30: note = chr9:98784772-98784802
  misc_feature 1..30: note = hyper
  source 1..30: mol_type = genomic DNA
gcacagaggggcactcggcttgtaagcaac

SEQ ID NO: 9983 - DNA, 306 bp, Homo sapiens; identical to SEQ ID NO: 3441
  misc_feature 1..306: note = chr9:98789707-98790013
  misc_feature 1..306: note = hyper
  source 1..306: mol_type = genomic DNA

SEQ ID NO: 9984 - DNA, 40 bp, Homo sapiens
  misc_feature 1..40: note = chr9:99449297-99449337
  misc_feature 1..40: note = hyper
  source 1..40: mol_type = genomic DNA
gcacagcgtcagaggcggggacgcgcgctggtctattttt

SEQ ID NO: 9985 - DNA, 432 bp, Homo sapiens; identical to SEQ ID NO: 862
  misc_feature 1..432: note = chr9:99639601-99640033
  misc_feature 1..432: note = hyper
  source 1..432: mol_type = genomic DNA

SEQ ID NO: 9986 - DNA, 30 bp, Homo sapiens
  misc_feature 1..30: note = chr9:99983140-99983170
  misc_feature 1..30: note = hyper
  source 1..30: mol_type = genomic DNA
aaattatccaccaagcgctacaggcgggaa

SEQ ID NO: 9987 - DNA, 27 bp, Homo sapiens
  misc_feature 1..27: note = chr9:99983988-99984015
  misc_feature 1..27: note = hyper
  source 1..27: mol_type = genomic DNA
tcgcgcaggacatcccggaatcgcagg

SEQ ID NO: 9988 - DNA, 422 bp, Homo sapiens
  misc_feature 1..422: note = chr9:100503515-100503937
  misc_feature 1..422: note = hyper
  source 1..422: mol_type = genomic DNA
cggaactagaacaggcgggccccactgcctgcagcctgcgaggagacgccagggctgcaagcccccccgccctcctccgcccctgccgggacagtcagccgctaggggattaggaacgggcccagcgcccattcaagccattcagcgagacaggaagccaagcgcgctcctgcccgcccgcctctgccgggcaggtctgcgggatgacgcgcattgtgctggggactcgcccaaagggaggcccagccgtggggaaaaccgcgtcccgcgggaatccgacgcccggtgacgggggcacctgcaaggcttcagggcgaatccctgactcccagcccggggctgagtcctcgtggggccgcctccgcgctgcccagtgctgccggttatctgctcacagcgggtggctccgggccttcaggagc

SEQ ID NO: 9989 - DNA, 40 bp, Homo sapiens; identical to SEQ ID NO: 3444
  misc_feature 1..40: note = chr9:100610095-100610135
  misc_feature 1..40: note = hyper
  source 1..40: mol_type = genomic DNA

SEQ ID NO: 9990 - DNA, 121 bp, Homo sapiens; identical to SEQ ID NO: 3445
  misc_feature 1..121: note = chr9:100610200-100610321
  misc_feature 1..121: note = hyper
  source 1..121: mol_type = genomic DNA

SEQ ID NO: 9991 - DNA, 92 bp, Homo sapiens; identical to SEQ ID NO: 863
  misc_feature 1..92: note = chr9:100610725-100610817
  misc_feature 1..92: note = hyper
  source 1..92: mol_type = genomic DNA

SEQ ID NO: 9992 - DNA, 516 bp, Homo sapiens; identical to SEQ ID NO: 864
  misc_feature 1..516: note = chr9:100611124-100611640
  misc_feature 1..516: note = hyper
  source 1..516: mol_type = genomic DNA

SEQ ID NO: 9993 - DNA, 38 bp, Homo sapiens
  misc_feature 1..38: note = chr9:100613747-100613785
  misc_feature 1..38: note = hyper
  source 1..38: mol_type = genomic DNA
agttactgagagccacgaaatcccgtattaaaaggtgc

SEQ ID NO: 9994 - DNA, 10 bp, Homo sapiens
  misc_feature 1..10: note = chr9:100613990-100614000
  misc_feature 1..10: note = hyper
  source 1..10: mol_type = genomic DNA
ttccacacac

SEQ ID NO: 9995 - DNA, 133 bp, Homo sapiens; identical to SEQ ID NO: 3449
  misc_feature 1..133: note = chr9:100614192-100614325
  misc_feature 1..133: note = hyper
  source 1..133: mol_type = genomic DNA

SEQ ID NO: 9996 - DNA, 243 bp, Homo sapiens
  misc_feature 1..243: note = chr9:100614584-100614827
  misc_feature 1..243: note = hyper
  source 1..243: mol_type = genomic DNA
cactcccccattacccgcagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttga

SEQ ID NO: 9997 - DNA, 133 bp, Homo sapiens; identical to SEQ ID NO: 3450
  misc_feature 1..133: note = chr9:100615068-100615201
  misc_feature 1..133: note = hyper
  source 1..133: mol_type = genomic DNA

SEQ ID NO: 9998 - DNA, 834 bp, Homo sapiens; identical to SEQ ID NO: 3451
  misc_feature 1..834: note = chr9:100615202-100616036
  misc_feature 1..834: note = hyper
  source 1..834: mol_type = genomic DNA

SEQ ID NO: 9999 - DNA, 199 bp, Homo sapiens; identical to SEQ ID NO: 3452
  misc_feature 1..199: note = chr9:100616270-100616469
  misc_feature 1..199: note = hyper
  source 1..199: mol_type = genomic DNA

SEQ ID NO: 10000 - DNA, 49 bp, Homo sapiens
  misc_feature 1..49: note = chr9:100617316-100617365
  misc_feature 1..49: note = hyper
  source 1..49: mol_type = genomic DNA
gagccagcgtagggacgaaaactcatagacacatcggctgttcacacgt

SEQ ID NO: 10001 - DNA, 37 bp, Homo sapiens
  misc_feature 1..37: note = chr9:100617675-100617712
  misc_feature 1..37: note = hyper
  source 1..37: mol_type = genomic DNA
ccttccatgtgctgccggaactcgggcctttttacgc

SEQ ID NO: 10002 - DNA, 295 bp, Homo sapiens
  misc_feature 1..295: note = chr9:100619802-100620097
  misc_feature 1..295: note = hyper
  source 1..295: mol_type = genomic DNA
gtcatgataaagccccgggaaggagaaagacagggtgggaaagagcggacattttcgtcccccattctacttgtcaacttgcgggacaggtaagattgtgccaaaggcgagggtcagcatcaggagagagaggacgctgcggggagggacctggttgtgtgcttcaggtgccccaagggacacggagacgcgcgagggttgggatcaaggcgttgaagacagagcgacagcccttctcggcctcccaccggccgacgacaccaagagctcgcgcaccggccgggccaggtgggaa

SEQ ID NO: 10003 - DNA, 426 bp, Homo sapiens; identical to SEQ ID NO: 3453
  misc_feature 1..426: note = chr9:100620357-100620783
  misc_feature 1..426: note = hyper
  source 1..426: mol_type = genomic DNA

SEQ ID NO: 10004 - DNA, 47 bp, Homo sapiens
  misc_feature 1..47: note = chr9:101469203-101469250
  misc_feature 1..47: note = hyper
  source 1..47: mol_type = genomic DNA
gataggaatgtcattcggaaatgatttcacaccgggttagccctgca

SEQ ID NO: 10005 - DNA, 315 bp, Homo sapiens
  misc_feature 1..315: note = chr9:101469527-101469842
  misc_feature 1..315: note = hyper
  source 1..315: mol_type = genomic DNA
ggactccagcagaagcgcccggagagtcccaggaagccaggatcaagcccagcgcctcggccccgttccgcgcgatggaagaggcgccaaccgagcgtactgcacaggaaatcactgcccccttcaggccgcgtctcagacgctgcggtcggagcacaggggctcgctcggtccggaaaaactcgcaaacccgaccttgcgcggccagcgatcgctcctccagacccgctccgcgcgctccagccccggcctggcggtgaaggtccgctctggggcttcaggcagaacccaaaccgagggcgtggggaggggtct

SEQ ID NO: 10006 - DNA, 134 bp, Homo sapiens
  misc_feature 1..134: note = chr9:101470116-101470250
  misc_feature 1..134: note = hyper
  source 1..134: mol_type = genomic DNA
ggccccacacttgcccgcgcggagcgggctcagagctgctggcgcgcaccaggcgcccagccacgctgcacgctcaagccccttgggttccggagccttccggacctcaaagcgcggctcggcttccctggggg

SEQ ID NO: 10007 - DNA, 369 bp, Homo sapiens
  misc_feature 1..369: note = chr9:101470868-101471237
  misc_feature 1..369: note = hyper
  source 1..369: mol_type = genomic DNA
gcggcggccggggggcgccccgcgcccagccccaggccccgggcgccagaggcagcagcagcggcagcagcagtagcagtagcaggcgcgcgggcggcggtggcggcggcggcggcggcccgggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtg

SEQ ID NO: 10008 - DNA, 47 bp, Homo sapiens
  misc_feature 1..47: note = chr9:101471465-101471512
  misc_feature 1..47: note = hyper
  source 1..47: mol_type = genomic DNA
tgctcaggggcggctcgggccgcctccagggacggggacgagccgtg

SEQ ID NO: 10009 - DNA, 87 bp, Homo sapiens; identical to SEQ ID NO: 3454
  misc_feature 1..87: note = chr9:101706109-101706196
  misc_feature 1..87: note = hyper
  source 1..87: mol_type = genomic DNA

SEQ ID NO: 10010 - DNA, 467 bp, Homo sapiens; identical to SEQ ID NO: 3455
  misc_feature 1..467: note = chr9:101706312-101706779
  misc_feature 1..467: note = hyper
  source 1..467: mol_type = genomic DNA

SEQ ID NO: 10011 - DNA, 92 bp, Homo sapiens
  misc_feature 1..92: note = chr9:102586697-102586789
  misc_feature 1..92: note = hyper
  source 1..92: mol_type = genomic DNA
gggagacgggaagcacgtgctacagccgtgggaagatccgcttctacccgcgctacatcgagcgcaagctttccgtccgagcagctccagct

SEQ ID NO: 10012 - DNA, 30 bp, Homo sapiens
  misc_feature 1..30: note = chr9:103790612-103790642
  misc_feature 1..30: note = hyper
  source 1..30: mol_type = genomic DNA
cgcatctcggttgcccgcagggtagaaagc

SEQ ID NO: 10013 - DNA, 46 bp, Homo sapiens
  misc_feature 1..46: note = chr9:104248563-104248609
  misc_feature 1..46: note = hyper
  source 1..46: mol_type = genomic DNA
cctcagtttcccacccgtaggccgagctgaccgtctccatcgctgc

SEQ ID NO: 10014 - DNA, 61 bp, Homo sapiens
  misc_feature 1..61: note = chr9:104500256-104500317
  misc_feature 1..61: note = hyper
  source 1..61: mol_type = genomic DNA
ctcattactgagacccgcagggagaaagcgcgccccctcctgcgcccggctcgcccctctg

SEQ ID NO: 10015 - DNA, 174 bp, Homo sapiens
  misc_feature 1..174: note = chr9:104500856-104501030
  misc_feature 1..174: note = hyper
  source 1..174: mol_type = genomic DNA
tctctgcctttctttcgttatttttccaccgagtcgccaccgccgcttgcttcctcggaggagcaacgcgactggccagcaaagggtggctctgctccgagcgccaaagttctccccgcctcagccggcgcctccctgttgctgagccctggcgcctgcctgtcgcttggctgc

SEQ ID NO: 10016 - DNA, 193 bp, Homo sapiens
  misc_feature 1..193: note = chr9:104501031-104501224
  misc_feature 1..193: note = hyper
  source 1..193: mol_type = genomic DNA
ctaaacgcccactgttggtgagattcccgagtggcacatcccgcgcccctggaaagtcctctcccctcaaaggctgggcgtcatagtttgcaaaattccctaaaacctaagaaggaaaataggactatgagccggtgagaattctgaattcagagtcgcacctgagggatctgaaattcggtggttcactgaa

SEQ ID NO: 10017 - DNA, 460 bp, Homo sapiens
  misc_feature 1..460: note = chr9:108418487-108418947
  misc_feature 1..460: note = hyper
  source 1..460: mol_type = genomic DNA
ggtgtcctataaaggcggcggcggcggcggcgcggtgtccaggcgagggcgcacacggccggcgagggcgacggctacggcgacgacgcgggctctttgcgaggaggtgcgtggactccggggggacatgggcgcaaccagggccgggctcgtgggcctgcgggtctctcgctgagccatactcacccgggagagcaggaatgcggcggagacttggtagcggccaccgagccaattcggtgggaagaccgggggactttccgcggggcaggggcggtggctcagctccgggggtgctaggccgactctctagcgtgttggcgggcccgcgtcgcttttatgcgtgatgccggggacccccttgtaccgctctcggcggcgcatctcccagagcccttcaaggagctcgcgcgtccccgagcgactcccggacacctggcagattcgaaacttcagccac

SEQ ID NO: 10018 - DNA, 153 bp, Homo sapiens
  misc_feature 1..153: note = chr9:109623063-109623216
  misc_feature 1..153: note = hyper
  source 1..153: mol_type = genomic DNA
cgctcagacaccccccgggtcccggtggggaggagctcggggcaggaggacttccctaggtccctccgggcactcggaagggggagtcctcccaaagccgcacaaagccgggatcatttcaatccggaacagcctcagcgtcctcctcctctc

SEQ ID NO: 10019 - DNA, 170 bp, Homo sapiens
  misc_feature 1..170: note = chr9:110227815-110227985
  misc_feature 1..170: note = hyper
  source 1..170: mol_type = genomic DNA
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagca

SEQ ID NO: 10020 - DNA, 432 bp, Homo sapiens; identical to SEQ ID NO: 3456
  misc_feature 1..432: note = chr9:110228200-110228632
  misc_feature 1..432: note = hyper
  source 1..432: mol_type = genomic DNA

SEQ ID NO: 10021 - DNA, 30 bp, Homo sapiens
  misc_feature 1..30: note = chr9:111929340-111929370
  misc_feature 1..30: note = hyper
  source 1..30: mol_type = genomic DNA
gcaggcggcgggccccgtcagtagcagcag

SEQ ID NO: 10022 - DNA, 86 bp, Homo sapiens
  misc_feature 1..86: note = chr9:112402752-112402838
  misc_feature 1..86: note = hyper
  source 1..86: mol_type = genomic DNA
cttctccccaggctccgcgccgcgccgccagtcccaggggagccgccggcgcacctggcgcctagggcgcacggcactgcgcgctg

SEQ ID NO: 10023 - DNA, 79 bp, Homo sapiens
  misc_feature 1..79: note = chr9:112403209-112403288
  misc_feature 1..79: note = hyper
  source 1..79: mol_type = genomic DNA
gcggcaggcagatcccgctcgggtccgcgtccaggatgggtgtttaatttcagccccgtgtgtacgcctggtgtttcta

SEQ ID NO: 10024 - DNA, 99 bp, Homo sapiens
  misc_feature 1..99: note = chr9:112542259-112542358
  misc_feature 1..99: note = hyper
  source 1..99: mol_type = genomic DNA
agccgtgcgccccagcggctcgccgtgcgcccgcgccccaggtgcccactggctcgcgcgccctccgtctgcgccttggagacccgcggcggcgatcgc

SEQ ID NO: 10025 - DNA, 100 bp, Homo sapiens
  misc_feature 1..100: note = chr9:113341522-113341622
  misc_feature 1..100: note = hyper
  source 1..100: mol_type = genomic DNA
tgcggaagttgacttcgcccacgctggacgaatcatccaccaggaagacaagctccaggcgctcgctgagctcccgcagcagccgcacgcgtcgccggaa

SEQ ID NO: 10026 - DNA, 78 bp, Homo sapiens
  misc_feature 1..78: note = chr9:113341679-113341757
  misc_feature 1..78: note = hyper
  source 1..78: mol_type = genomic DNA
cgcggggatactcccgggggccccgggcgcggtctcggggaagaggcggaagctgaaattgcgcgacggggacatctg

SEQ ID NO: 10027 - DNA, 30 bp, Homo sapiens
  misc_feature 1..30: note = chr9:113801304-113801334
  misc_feature 1..30: note = hyper
  source 1..30: mol_type = genomic DNA
aaactttccagaaggcgcaaagtttctccc

SEQ ID NO: 10028 - DNA, 136 bp, Homo sapiens
  misc_feature 1..136: note = chr9:114287491-114287627
  misc_feature 1..136: note = hyper
  source 1..136: mol_type = genomic DNA
tctggaagctctttgcggtggcgttggtgctgtttgcggatgctgatgcaggtactggtcgtcccgggccccgagtttcggggccgtggccgggtcgccggctccgagggcgcacttggggcgggatgggggccgg

SEQ ID NO: 10029 - DNA, 96 bp, Homo sapiens
  misc_feature 1..96: note = chr9:114288004-114288100
  misc_feature 1..96: note = hyper
  source 1..96: mol_type = genomic DNA
taaactccctgtagacggagccgagtgtcttagtcatcgcggagccccaggtgctcagcacggcgccaggtacgtggtgggcgcctaatatttggc

SEQ ID NO: 10030 - DNA, 517 bp, Homo sapiens
  misc_feature 1..517: note = chr9:115653040-115653557
  misc_feature 1..517: note = hyper
  source 1..517: mol_type = genomic DNA
ctcaggtttcagtcccggagcgcgagtgtgctccgtgcgccgggagcgcgagtgtgctccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 10031 - DNA, 147 bp, Homo sapiens
  misc_feature 1..147: note = chr9:118916648-118916795
  misc_feature 1..147: note = hyper
  source 1..147: mol_type = genomic DNA
cggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgcc

SEQ ID NO: 10032 - DNA, 30 bp, Homo sapiens
  misc_feature 1..30: note = chr9:118917350-118917380
  misc_feature 1..30: note = hyper
  source 1..30: mol_type = genomic DNA
ggacttagaagtcctcgaagtgccccaaag

SEQ ID NO: 10033 - DNA, 268 bp, Homo sapiens
  misc_feature 1..268: note = chr9:120175564-120175832
  misc_feature 1..268: note = hyper
  source 1..268: mol_type = genomic DNA
cggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagct

SEQ ID NO: 10034 - DNA, 30 bp, Homo sapiens
  misc_feature 1..30: note = chr9:120176040-120176070
  misc_feature 1..30: note = hyper
  source 1..30: mol_type = genomic DNA
gctgcaaggacaaaccggctctctgcctgg

SEQ ID NO: 10035 - DNA, 496 bp, Homo sapiens
  misc_feature 1..496: note = chr9:120176825-120177321
  misc_feature 1..496: note = hyper
  source 1..496: mol_type = genomic DNA
tgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccagga

SEQ ID NO: 10036 - DNA, 95 bp, Homo sapiens; identical to SEQ ID NO: 3457
  misc_feature 1..95: note = chr9:120177898-120177993
  misc_feature 1..95: note = hyper
  source 1..95: mol_type = genomic DNA

SEQ ID NO: 10037 - DNA, 30 bp, Homo sapiens
  misc_feature 1..30: note = chr9:122131178-122131208
  misc_feature 1..30: note = hyper
  source 1..30: mol_type = genomic DNA
gagaagacttggaggcggcggggcggccag

SEQ ID NO: 10038 - DNA, 188 bp, Homo sapiens
  misc_feature 1..188: note = chr9:122131838-122132026
  misc_feature 1..188: note = hyper
  source 1..188: mol_type = genomic DNA
gagggaggagctgaacgccggggttgcttccgaggagtgttttgtacatctttaggcggaggaggaggagaagcgagaggaggagagacgggaggccgcctcgagggaagggcggcccgggtgggctggggctgagccgtagggagtttcgtgggtctggggcgtgtagggtgttgtgtctatgcgca

SEQ ID NO: 10039 - DNA, 112 bp, Homo sapiens
  misc_feature 1..112: note = chr9:122132051-122132163
  misc_feature 1..112: note = hyper
  source 1..112: mol_type = genomic DNA
cgcgcaaacccggaatcctggtgcccttaagcgtgactgtactgtgtgtgtcgcgagtacctgagtgtttctggggcggcaggtgtttccacggccgcgtggatccatcgag

SEQ ID NO: 10040 - DNA, 36 bp, Homo sapiens
  misc_feature 1..36: note = chr9:124990570-124990606
  misc_feature 1..36: note = hyper
  source 1..36: mol_type = genomic DNA
cggcgcgccgggtaccggccccgcgtcgggattctc

SEQ ID NO: 10041 - DNA, 710 bp, Homo sapiens
  misc_feature 1..710: note = chr9:126770648-126771358
  misc_feature 1..710: note = hyper
  source 1..710: mol_type = genomic DNA
aagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgt

SEQ ID NO: 10042 - DNA, 65 bp, Homo sapiens
  misc_feature 1..65: note = chr9:126771675-126771740
  misc_feature 1..65: note = hyper
  source 1..65: mol_type = genomic DNA
gggggagtggaaagtcgcagggtgtgtttccacgtttcttgagcagcccgcggcaagagttgctg

SEQ ID NO: 10043 - DNA, 286 bp, Homo sapiens
  misc_feature 1..286: note = chr9:126773494-126773780
  misc_feature 1..286: note = hyper
  source 1..286: mol_type = genomic DNA
cccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcc

SEQ ID NO: 10044 - DNA, 51 bp, Homo sapiens
  misc_feature 1..51: note = chr9:126774198-126774249
  misc_feature 1..51: note = hyper
  source 1..51: mol_type = genomic DNA
cttcagggtgaaccccgaccgcagccgtcgccgcctcgggcagagtttgcg

SEQ ID NO: 10045 - DNA, 66 bp, Homo sapiens; identical to SEQ ID NO: 3458
  misc_feature 1..66: note = chr9:126774554-126774620
  misc_feature 1..66: note = hyper
  source 1..66: mol_type = genomic DNA

SEQ ID NO: 10046 - DNA, 92 bp, Homo sapiens; identical to SEQ ID NO: 3459
  misc_feature 1..92: note = chr9:126777655-126777747
  misc_feature 1..92: note = hyper
  source 1..92: mol_type = genomic DNA

SEQ ID NO: 10047 - DNA, 46 bp, Homo sapiens
  misc_feature 1..46: note = chr9:126778450-126778496
  misc_feature 1..46: note = hyper
  source 1..46: mol_type = genomic DNA
cggaagcgagccccccgggcggggacgagaccggagcaggcctggc

SEQ ID NO: 10048 - DNA, 423 bp, Homo sapiens; identical to SEQ ID NO: 3460
  misc_feature 1..423: note = chr9:126779621-126780044
  misc_feature 1..423: note = hyper
  source 1..423: mol_type = genomic DNA

SEQ ID NO: 10049 - DNA, 31 bp, Homo sapiens; identical to SEQ ID NO: 3461
  misc_feature 1..31: note = chr9:126780284-126780315
  misc_feature 1..31: note = hyper
  source 1..31: mol_type = genomic DNA

SEQ ID NO: 10050 - DNA, 30 bp, Homo sapiens
  misc_feature 1..30: note = chr9:126780564-126780594
  misc_feature 1..30: note = hyper
  source 1..30: mol_type = genomic DNA
aggagagagaaagcccgggtcctccccctc

SEQ ID NO: 10051 - DNA, 87 bp, Homo sapiens
  misc_feature 1..87: note = chr9:126780811-126780898
  misc_feature 1..87: note = hyper
  source 1..87: mol_type = genomic DNA
ttttctctactcccccgccaataacggcttcggaaaaggcctcccccgcagggaccgggtctcccggagccccgggattcagctcgg

SEQ ID NO: 10052 - DNA, 30 bp, Homo sapiens
  misc_feature 1..30: note = chr9:126781276-126781306
  misc_feature 1..30: note = hyper
  source 1..30: mol_type = genomic DNA
ggcccaaagataccccgtagggaggctgcc

SEQ ID NO: 10053 - DNA, 83 bp, Homo sapiens
  misc_feature 1..83: note = chr9:126783416-126783499
  misc_feature 1..83: note = hyper
  source 1..83: mol_type = genomic DNA
gtgaccagccatacccgagcagccagaagaccaagcgcatgcgcacgtccttcaagcaccaccagcttcggaccatgaagtct

SEQ ID NO: 10054 - DNA, 133 bp, Homo sapiens
  misc_feature 1..133: note = chr9:126785171-126785304
  misc_feature 1..133: note = hyper
  source 1..133: mol_type = genomic DNA
agccgagggagggagcgtcggccaatgggatgccgatgcgcccctctgggcccgcccctccctcatggtctgttttgctttggagtcccagtggcctgagctcctggtggatggagaacgtgactacactggc

SEQ ID NO: 10055 - DNA, 108 bp, Homo sapiens; identical to SEQ ID NO: 865
  misc_feature 1..108: note = chr9:127212898-127213006
  misc_feature 1..108: note = hyper
  source 1..108: mol_type = genomic DNA

SEQ ID NO: 10056 - DNA, 150 bp, Homo sapiens; identical to SEQ ID NO: 3463
  misc_feature 1..150: note = chr9:127265875-127266025
  misc_feature 1..150: note = hyper
  source 1..150: mol_type = genomic DNA

SEQ ID NO: 10057 - DNA, 242 bp, Homo sapiens
  misc_feature 1..242: note = chr9:127266346-127266588
  misc_feature 1..242: note = hyper
  source 1..242: mol_type = genomic DNA
agagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgc

SEQ ID NO: 10058 - DNA, 219 bp, Homo sapiens
  misc_feature 1..219: note = chr9:127266628-127266847
  misc_feature 1..219: note = hyper
  source 1..219: mol_type = genomic DNA
cggacccagacgggggcccgggccgcaggaggcggaaaacgacggcgccgggaccgagagcccgaaaacgcagagccgccgggaccccctccccgggggagacaaagccgcagcagcgacggcaacgggaggcgcagcccgagccgccgctgccaccgggacgtcgggcggggagacctcgggcgggggtcggcgggctccgggaagccgagcccgagg

SEQ ID NO: 10059 - DNA, 172 bp, Homo sapiens
  misc_feature 1..172: note = chr9:127266865-127267037
  misc_feature 1..172: note = hyper
  source 1..172: mol_type = genomic DNA
cggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccgg

SEQ ID NO: 10060 - DNA, 91 bp, Homo sapiens
  misc_feature 1..91: note = chr9:127267360-127267451
  misc_feature 1..91: note = hyper
  source 1..91: mol_type = genomic DNA
cgccggcaccctctccgcagtccagctcgagtcttcgccctcatcctccaggccccccagccgcagcccggctccccggaccccgagcgcg

SEQ ID NO: 10061 - DNA, 324 bp, Homo sapiens
  misc_feature 1..324: note = chr9:128651926-128652250
  misc_feature 1..324: note = hyper
  source 1..324: mol_type = genomic DNA
taaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagca

SEQ ID NO: 10062 - DNA, 236 bp, Homo sapiens
  misc_feature 1..236: note = chr9:129276667-129276903
  misc_feature 1..236: note = hyper
  source 1..236: mol_type = genomic DNA
gggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtg

SEQ ID NO: 10063 - DNA, 36 bp, Homo sapiens
  misc_feature 1..36: note = chr9:129372722-129372758
  misc_feature 1..36: note = hyper
  source 1..36: mol_type = genomic DNA
ggcagctcatagagccgtgctcgagggaggcgggta

SEQ ID NO: 10064 - DNA, 30 bp, Homo sapiens
  misc_feature 1..30: note = chr9:129373250-129373280
  misc_feature 1..30: note = hyper
  source 1..30: mol_type = genomic DNA
cgaaggacccgagaccggccaactcagctg

SEQ ID NO: 10065 - DNA, 85 bp, Homo sapiens
  misc_feature 1..85: note = chr9:129377159-129377244
  misc_feature 1..85: note = hyper
  source 1..85: mol_type = genomic DNA
tagcaatcaccttggcgagcttgggagaggcgcaaggtcacctggggtgggggagattctaagagaaaaacgtctccctggtcac

SEQ ID NO: 10066 - DNA, 44 bp, Homo sapiens
  misc_feature 1..44: note = chr9:129377592-129377636
  misc_feature 1..44: note = hyper
  source 1..44: mol_type = genomic DNA
ggtgcgaccgggacgccggggctgggccgggcggcgctgacggc

SEQ ID NO: 10067 - DNA, 188 bp, Homo sapiens
  misc_feature 1..188: note = chr9:129377772-129377960
  misc_feature 1..188: note = hyper
  source 1..188: mol_type = genomic DNA
cggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggc

SEQ ID NO: 10068 - DNA, 15 bp, Homo sapiens
  misc_feature 1..15: note = chr9:129386182-129386197
  misc_feature 1..15: note = hyper
  source 1..15: mol_type = genomic DNA
tccaggcccacctct

SEQ ID NO: 10069 - skipped

SEQ ID NO: 10070 - DNA, 438 bp, Homo sapiens; identical to SEQ ID NO: 3464
  misc_feature 1..438: note = chr9:129387866-129388304
  misc_feature 1..438: note = hyper
  source 1..438: mol_type = genomic DNA

SEQ ID NO: 10071 - DNA, 201 bp, Homo sapiens; identical to SEQ ID NO: 3465
  misc_feature 1..201: note = chr9:129389016-129389217
  misc_feature 1..201: note = hyper
  source 1..201: mol_type = genomic DNA

SEQ ID NO: 10072 - DNA, 187 bp, Homo sapiens; identical to SEQ ID NO: 3466
  misc_feature 1..187: note = chr9:129400940-129401127
  misc_feature 1..187: note = hyper
  source 1..187: mol_type = genomic DNA

SEQ ID NO: 10073 - DNA, 93 bp, Homo sapiens; identical to SEQ ID NO: 3467
  misc_feature 1..93: note = chr9:129445473-129445566
  misc_feature 1..93: note = hyper
  source 1..93: mol_type = genomic DNA

SEQ ID NO: 10074 - DNA, 95 bp, Homo sapiens
  misc_feature 1..95: note = chr9:129445783-129445878
  misc_feature 1..95: note = hyper
  source 1..95: mol_type = genomic DNA
tctagcagcagcagccgtgacccccagagtgtctagggtcctgtcgcctagctcctgtgaactgcagctcatccttcagccggcatcatcagagc

SEQ ID NO: 10075 - DNA, 240 bp, Homo sapiens
  misc_feature 1..240: note = chr9:130461691-130461931
  misc_feature 1..240: note = hyper
  source 1..240: mol_type = genomic DNA
tgggcttggggaggccgggcttccggggctagtaagcgtctactagccgggctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 10076 - DNA, 319 bp, Homo sapiens
  misc_feature 1..319: note = chr9:131872526-131872845
  misc_feature 1..319: note = hyper
  source 1..319: mol_type = genomic DNA
ttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtc

SEQ ID NO: 10077 - DNA, 30 bp, Homo sapiens
  misc_feature 1..30: note = chr9:131872856-131872886
  misc_feature 1..30: note = hyper
  source 1..30: mol_type = genomic DNA
cgccgcggctggggtcggtgggtccttgct

SEQ ID NO: 10078 - DNA, 69 bp, Homo sapiens; identical to SEQ ID NO: 3468
  misc_feature 1..69: note = chr9:132382286-132382355
  misc_feature 1..69: note = hyper
  source 1..69: mol_type = genomic DNA

SEQ ID NO: 10079 - DNA, 173 bp, Homo sapiens; identical to SEQ ID NO: 3469
  misc_feature 1..173: note = chr9:132382634-132382807
  misc_feature 1..173: note = hyper
  source 1..173: mol_type = genomic DNA

SEQ ID NO: 10080 - DNA, 181 bp, Homo sapiens
  misc_feature 1..181: note = chr9:132428476-132428657
  misc_feature 1..181: note = hyper
  source 1..181: mol_type = genomic DNA
ggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattc

SEQ ID NO: 10081 - DNA, 106 bp, Homo sapiens; identical to SEQ ID NO: 3470
  misc_feature 1..106: note = chr9:133308867-133308973
  misc_feature 1..106: note = hyper
  source 1..106: mol_type = genomic DNA

SEQ ID NO: 10082 - DNA, 350 bp, Homo sapiens
  misc_feature 1..350: note = chr9:133534583-133534933
  misc_feature 1..350: note = hyper
  source 1..350: mol_type = genomic DNA
gtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcc

SEQ ID NO: 10083 - DNA, 174 bp, Homo sapiens
  misc_feature 1..174: note = chr9:133535311-133535485
  misc_feature 1..174: note = hyper
  source 1..174: mol_type = genomic DNA
cgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgc

SEQ ID NO: 10084 - DNA, 125 bp, Homo sapiens; identical to SEQ ID NO: 3471
  misc_feature 1..125: note = chr9:133535809-133535934
  misc_feature 1..125: note = hyper
  source 1..125: mol_type = genomic DNA

SEQ ID NO: 10085 - DNA, 149 bp, Homo sapiens; identical to SEQ ID NO: 3472
  misc_feature 1..149: note = chr9:133535971-133536120
  misc_feature 1..149: note = hyper
  source 1..149: mol_type = genomic DNA

SEQ ID NO: 10086 - DNA, 196 bp, Homo sapiens; identical to SEQ ID NO: 3473
  misc_feature 1..196: note = chr9:133536149-133536345
  misc_feature 1..196: note = hyper
  source 1..196: mol_type = genomic DNA

SEQ ID NO: 10087 - DNA, 160 bp, Homo sapiens; identical to SEQ ID NO: 3474
  misc_feature 1..160: note = chr9:133536346-133536506
  misc_feature 1..160: note = hyper
  source 1..160: mol_type = genomic DNA

SEQ ID NO: 10088 - DNA, 92 bp, Homo sapiens
  misc_feature 1..92: note = chr9:133536777-133536869
  misc_feature 1..92: note = hyper
  source 1..92: mol_type = genomic DNA
tcaagtcctacgagccgcccacaatggaccgatatactgagggcctctctattaacgcccatgaatattaaagagatcgccaagtggcggcc

SEQ ID NO: 10089 - DNA, 299 bp, Homo sapiens
  misc_feature 1..299: note = chr9:133537070-133537369
  misc_feature 1..299: note = hyper
  source 1..299: mol_type = genomic DNA
caccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagca

SEQ ID NO: 10090 - DNA, 264 bp, Homo sapiens
  misc_feature 1..264: note = chr9:133537606-133537870
  misc_feature 1..264: note = hyper
  source 1..264: mol_type = genomic DNA
aactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacc

SEQ ID NO: 10091 - DNA, 238 bp, Homo sapiens; identical to SEQ ID NO: 3475
  misc_feature 1..238: note = chr9:133538169-133538407
  misc_feature 1..238: note = hyper
  source 1..238: mol_type = genomic DNA

SEQ ID NO: 10092 - DNA, 525 bp, Homo sapiens; identical to SEQ ID NO: 3476
  misc_feature 1..525: note = chr9:133538655-133539180
  misc_feature 1..525: note = hyper
  source 1..525: mol_type = genomic DNA

SEQ ID NO: 10093 - DNA, 37 bp, Homo sapiens
  misc_feature 1..37: note = chr9:133540453-133540490
  misc_feature 1..37: note = hyper
  source 1..37: mol_type = genomic DNA
gcagcccacccggctcaaggaccgaccccggcgaccc

SEQ ID NO: 10094 - DNA, 357 bp, Homo sapiens
  misc_feature 1..357: note = chr9:133541108-133541465
  misc_feature 1..357: note = hyper
  source 1..357: mol_type = genomic DNA
gcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggc

SEQ ID NO: 10095 - DNA, 742 bp, Homo sapiens; identical to SEQ ID NO: 866
  misc_feature 1..742: note = chr9:133541665-133542407
  misc_feature 1..742: note = hyper
  source 1..742: mol_type = genomic DNA

SEQ ID NO: 10096 - DNA, 394 bp, Homo sapiens
  misc_feature 1..394: note = chr9:134151976-134152370
  misc_feature 1..394: note = hyper
  source 1..394: mol_type = genomic DNA
tgacttcctgccctccggccttccgcacgcgctccctccgggccccgcacccgcacccgcccggcgcggtcgaatcaattgcagagcagtttgtgttcacccggccgaggtcccggcgccctcggggcgagcgccgacccgcggcttccaggaggcgagctcagggctccggccgctcgccggtgacgggggagcgcggcgcgggtccccgtcggcgcccactcgcgggcgcgggccggacgtccccacgcaggggcgccgcgtcccttcgccgctgtcgctgccggccgccgtgcagggtcccggggctgcgctccggccgccgccgcctgcttcgccgcggccgccgaggacctggtgggaggtggaagggacagcgcgtcaaggccagcct

SEQ ID NO: 10097 - DNA, 34 bp, Homo sapiens
  misc_feature 1..34: note = chr9:135285831-135285865
  misc_feature 1..34: note = hyper
  source 1..34: mol_type = genomic DNA
tcagaaccctctcatcgtcaaggtgagcacccca

SEQ ID NO: 10098 - DNA, 169 bp, Homo sapiens
  misc_feature 1..169: note = chr9:135285880-135286049
  misc_feature 1..169: note = hyper
  source 1..169: mol_type = genomic DNA
cgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcct

SEQ ID NO: 10099 - DNA, 107 bp, Homo sapiens
  misc_feature 1..107: note = chr9:135455044-135455151
  misc_feature 1..107: note = hyper
  source 1..107: mol_type = genomic DNA
agagtaaatttcaaacgaaataaatcgcacagcacattttagatgataatagacggcggtaactcaatactaatgatagtgtactgacaacccgctaatagtcttgg

SEQ ID NO: 10100 - DNA, 617 bp, Homo sapiens; identical to SEQ ID NO: 3478
  misc_feature 1..617: note = chr9:135455407-135456024
  misc_feature 1..617: note = hyper
  source 1..617: mol_type = genomic DNA

SEQ ID NO: 10101 - DNA, 83 bp, Homo sapiens
  misc_feature 1..83: note = chr9:135456827-135456910
  misc_feature 1..83: note = hyper
  source 1..83: mol_type = genomic DNA
ctacatgggaaacaccgagagcccaacagaaatgccgcaaacaacataacttgaattttcttccccacactagaaaaggggtt

SEQ ID NO: 10102 - DNA, 383 bp, Homo sapiens
  misc_feature 1..383: note = chr9:135456970-135457353
  misc_feature 1..383: note = hyper
  source 1..383: mol_type = genomic DNA
cacacttcttcctccgctggttttagtccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcaccccc

SEQ ID NO: 10103 - DNA, 122 bp, Homo sapiens; identical to SEQ ID NO: 3479
  misc_feature 1..122: note = chr9:135458477-135458599
  misc_feature 1..122: note = hyper
  source 1..122: mol_type = genomic DNA

SEQ ID NO: 10104 - DNA, 91 bp, Homo sapiens; identical to SEQ ID NO: 3480
  misc_feature 1..91: note = chr9:135460069-135460160
  misc_feature 1..91: note = hyper
  source 1..91: mol_type = genomic DNA

SEQ ID NO: 10105 - DNA, 271 bp, Homo sapiens; identical to SEQ ID NO: 3481
  misc_feature 1..271: note = chr9:135461541-135461812
  misc_feature 1..271: note = hyper
  source 1..271: mol_type = genomic DNA

SEQ ID NO: 10106 - DNA, 275 bp, Homo sapiens; identical to SEQ ID NO: 867
  misc_feature 1..275: note = chr9:135462647-135462922
  misc_feature 1..275: note = hyper
  source 1..275: mol_type = genomic DNA

SEQ ID NO: 10107 - DNA, 141 bp, Homo sapiens; identical to SEQ ID NO: 3483
  misc_feature 1..141: note = chr9:135464798-135464939
  misc_feature 1..141: note = hyper
  source 1..141: mol_type = genomic DNA

SEQ ID NO: 10108 - DNA, 178 bp, Homo sapiens
  misc_feature 1..178: note = chr9:135465887-135466065
  misc_feature 1..178: note = hyper
  source 1..178: mol_type = genomic DNA
ccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccggg

SEQ ID NO: 10109 - DNA, 15 bp, Homo sapiens
  misc_feature 1..15: note = chr9:135466117-135466132
  misc_feature 1..15: note = hyper
  source 1..15: mol_type = genomic DNA
cgcccagcgtccggc

SEQ ID NO: 10110 - DNA, 109 bp, Homo sapiens
  misc_feature 1..109: note = chr9:135466344-135466453
  misc_feature 1..109: note = hyper
  source 1..109: mol_type = genomic DNA
ctggctgccccagaccgcagctctagcatctcaggggagaggggtttaagtcccgagtcagactcgaggcttccagttcacgtccaaagggccacggtcacctgagact

SEQ ID NO: 10111 - DNA, 64 bp, Homo sapiens
  misc_feature 1..64: note = chr9:135646011-135646075
  misc_feature 1..64: note = hyper
  source 1..64: mol_type = genomic DNA
agagacctggggcagcgcggtgggcagcgggctgggccgagatcgagaccgggacaaggcaggg

SEQ ID NO: 10112 - DNA, 31 bp, Homo sapiens
  misc_feature 1..31: note = chr9:136474561-136474592
  misc_feature 1..31: note = hyper
  source 1..31: mol_type = genomic DNA
cgcgcgcgcagtcgtcgggggatgccgggag

SEQ ID NO: 10113 - DNA, 37 bp, Homo sapiens
  misc_feature 1..37: note = chr9:137299217-137299254
  misc_feature 1..37: note = hyper
  source 1..37: mol_type = genomic DNA
gctggcaggctgcagcgggaagcgcctgtgggtcctc

SEQ ID NO: 10114 - DNA, 144 bp, Homo sapiens; identical to SEQ ID NO: 3484
  misc_feature 1..144: note = chr9:137533823-137533967
  misc_feature 1..144: note = hyper
  source 1..144: mol_type = genomic DNA

SEQ ID NO: 10115 - DNA, 87 bp, Homo sapiens; identical to SEQ ID NO: 3485
  misc_feature 1..87: note = chr9:137534065-137534152
  misc_feature 1..87: note = hyper
  source 1..87: mol_type = genomic DNA

SEQ ID NO: 10116 - DNA, 136 bp, Homo sapiens
  misc_feature 1..136: note = chr9:137534360-137534496
  misc_feature 1..136: note = hyper
  source 1..136: mol_type = genomic DNA
gtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggcc

SEQ ID NO: 10117 - DNA, 110 bp, Homo sapiens
  misc_feature 1..110: note = chr9:137979517-137979627
  misc_feature 1..110: note = hyper
  source 1..110: mol_type = genomic DNA
ccggacggcgcttcccggtggcggcggaggagcccggagggacgcagccgggcaaggcagggcgcagggcgggcggcgcgaggcgcagggcgcggcgggcagaggccacc

SEQ ID NO: 10118 - DNA, 220 bp, Homo sapiens
  misc_feature 1..220: note = chr9:137980258-137980478
  misc_feature 1..220: note = hyper
  source 1..220: mol_type = genomic DNA
agcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctggga

SEQ ID NO: 10119 - DNA, 246 bp, Homo sapiens
  misc_feature 1..246: note = chr9:137980714-137980960
  misc_feature 1..246: note = hyper
  source 1..246: mol_type = genomic DNA
ccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgt

SEQ ID NO: 10120 - DNA, 95 bp, Homo sapiens; identical to SEQ ID NO: 3486
  misc_feature 1..95: note = chr9:138606154-138606249
  misc_feature 1..95: note = hyper
  source 1..95: mol_type = genomic DNA

SEQ ID NO: 10121 - DNA, 200 bp, Homo sapiens
  misc_feature 1..200: note = chr9:138628543-138628743
  misc_feature 1..200: note = hyper
  source 1..200: mol_type = genomic DNA
cggcgccgcagcccccgaggagcctcacgggctcagcccgctgctgccggcccgcggcgggggctccgtgggcagcgacgtgggccagaggtaggggcgcgcgggcctgggaccccgcttgtcaaatcgcgcttgcatcctgctcgggctgcgctggctgggctgcacctgcgttgcctgcagcccggggaaggggggag

SEQ ID NO: 10122 - DNA, 142 bp, Homo sapiens; identical to SEQ ID NO: 3487
  misc_feature 1..142: note = chr9:139024749-139024891
  misc_feature 1..142: note = hyper
  source 1..142: mol_type = genomic DNA

SEQ ID NO: 10123 - DNA, 54 bp, Homo sapiens
  misc_feature 1..54: note = chr9:139025663-139025717
  misc_feature 1..54: note = hyper
  source 1..54: mol_type = genomic DNA
gagccaggctggcaccggacgcctcccgtggagacagcgcggggtcccggttcc

SEQ ID NO: 10124 - DNA, 408 bp, Homo sapiens
  misc_feature 1..408: note = chr9:139084662-139085070
  misc_feature 1..408: note = hyper
  source 1..408: mol_type = genomic DNA
aaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggagga

SEQ ID NO: 10125 - DNA, 36 bp, Homo sapiens
  misc_feature 1..36: note = chr9:139085315-139085351
  misc_feature 1..36: note = hyper
  source 1..36: mol_type = genomic DNA
ggctccccccaggcccgcgcggggcggaaccgggta

SEQ ID NO: 10126 - DNA, 161 bp, Homo sapiens
  misc_feature 1..161: note = chr9:139085372-139085533
  misc_feature 1..161: note = hyper
  source 1..161: mol_type = genomic DNA
cgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgc

SEQ ID NO: 10127 - DNA, 73 bp, Homo sapiens
  misc_feature 1..73: note = chr9:139089123-139089196
  misc_feature 1..73: note = hyper
  source 1..73: mol_type = genomic DNA
caggggcagctccctcgtgtgaggtgcagggtggagccgggcctgggtcagaactgagcgtggtctacctcat

SEQ ID NO: 10128 - DNA, 44 bp, Homo sapiens
  misc_feature 1..44: note = chr9:139089415-139089459
  misc_feature 1..44: note = hyper
  source 1..44: mol_type = genomic DNA
caccgtaggggctgccgggacgcagctctcggtactgctctggg

SEQ ID NO: 10129 - skipped

SEQ ID NO: 10130 - DNA, 156 bp, Homo sapiens
  misc_feature 1..156: note = chr9:139090586-139090742
  misc_feature 1..156: note = hyper
  source 1..156: mol_type = genomic DNA
cggaaatactgcccccagcgctgccggccggcgtccttcttcagcctcttctccttggcccggcggttctggaaccaaacctgggggcggggcggggtgagcggccgcccggctctgcgggggcccccaaggccgcgggcgggagggaagcagggg

SEQ ID NO: 10131 - DNA, 454 bp, Homo sapiens
  misc_feature 1..454: note = chr9:139091071-139091525
  misc_feature 1..454: note = hyper
  source 1..454: mol_type = genomic DNA
cgggcagcacccgggctggggtggagggggcgccggcggagggcgggttctgccgcgggggcgggggcggcgccttccctaaaatcgcacctccacggcgcccccgccttcagccttggctcccttctccaagcaccctgatttccccgcgggctcccctttattctaagggtgtgggtatggcccagccttcgcggccaagaatttagggcgataattccgaccaggggcgaaaagccgcacacttcggaccgaacgaagcggttcgggacgcgggtctgtccgtgactccgccgttcccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacct

SEQ ID NO: 10132 - DNA, 100 bp, Homo sapiens
  misc_feature 1..100: note = chr9:139093823-139093923
  misc_feature 1..100: note = hyper
  source 1..100: mol_type = genomic DNA
cgccccagcccaccccgcgccgcgcccgcgaccccagccttacgctgcatggcgactccagccctggcgggggctcctgtgtcagggatggcggggtcgg

SEQ ID NO: 10133 - DNA, 37 bp, Homo sapiens
  misc_feature 1..37: note = chr9:139094162-139094199
  misc_feature 1..37: note = hyper
  source 1..37: mol_type = genomic DNA
cggctccagctggcccgggagtcgaggagaactgccc

SEQ ID NO: 10134 - DNA, 79 bp, Homo sapiens
  misc_feature 1..79: note = chr9:139094654-139094733
  misc_feature 1..79: note = hyper
  source 1..79: mol_type = genomic DNA
caggcgcggacgttccggggtcctcgcgcccactcccgcccagatcctctagctcctgccagcctccgcggccaggccc

SEQ ID NO: 10135 - skipped

SEQ ID NO: 10136 - DNA, 200 bp, Homo sapiens
  misc_feature 1..200: note = chr9:139095285-139095485
  misc_feature 1..200: note = hyper
  source 1..200: mol_type = genomic DNA
ctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccgatcccagatgcta

SEQ ID NO: 10137 - DNA, 445 bp, Homo sapiens
  misc_feature 1..445: note = chr9:139096598-139097043
  misc_feature 1..445: note = hyper
  source 1..445: mol_type = genomic DNA
gcgtcaggccctccccgccaccctgggatctggaaactcactctctgcagtttccatctctgtgtcccgcctgcagagcggcgggactttctttgcctggccgctggccctgcacgcacccccttcctcgcgcctctgccgcccttgccgtttctgtcctcagtgtcctgctggggcttaccccgagtcccgcccaaggtgcagacggcggcggccccgggcctcgctcggtcgcgctcgagccccgtttccagcagcatcgcggccaccaggccgagtggcgcgagacgcgctcctcctaggtcagcgtcccctggagggttcggggctcccaagtcccgccgcgtcgtgcggggcagggagcccgggagccactgggcctggcgctgtccgcggtgctgaaggaggcgcccgctgcccgccccgcccgcgcgcccgcccacct

SEQ ID NO: 10138 - DNA, 183 bp, Homo sapiens
  misc_feature 1..183: note = chr9:139606480-139606663
  misc_feature 1..183: note = hyper
  source 1..183: mol_type = genomic DNA
gaagtgtcctcccggcgagtggccaaggcgcggggtctcagccaggagggaagggtcggaccccggggcgggctgcaggctcggccagcccagggctccgcgcgtctgaccccatcctgaggacccaggggaaggaccagccctggctctgcggcctcgaaccgggggcgcgcgtggggagcc

SEQ ID NO: 10139 - DNA, 34 bp, Homo sapiens
  misc_feature 1..34: note = chr9:140024989-140025023
  misc_feature 1..34: note = hyper
  source 1..34: mol_type = genomic DNA
ccctgccgaacctcacgcgcggcccctccctcat

SEQ ID NO: 10140 - DNA, 23 bp, Homo sapiens
  misc_feature 1..23: note = chr9:140033468-140033491
  misc_feature 1..23: note = hyper
  source 1..23: mol_type = genomic DNA
gcgctccgacacacacgctcacg

SEQ ID NO: 10141 - skipped

SEQ ID NO: 10142 - DNA, 382 bp, Homo sapiens; identical to SEQ ID NO: 3490
  misc_feature 1..382: note = chr9:140033762-140034144
  misc_feature 1..382: note = hyper
  source 1..382: mol_type = genomic DNA

SEQ ID NO: 10143 - DNA, 141 bp, Homo sapiens
  misc_feature 1..141: note = chr9:140050956-140051097
  misc_feature 1..141: note = hyper
  source 1..141: mol_type = genomic DNA
tcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcc

SEQ ID NO: 10144 - DNA, 272 bp, Homo sapiens
  misc_feature 1..272: note = chr9:140051219-140051491
  misc_feature 1..272: note = hyper
  source 1..272: mol_type = genomic DNA
cgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggt

SEQ ID NO: 10145 - DNA, 91 bp, Homo sapiens; identical to SEQ ID NO: 3491
  misc_feature 1..91: note = chr9:140772120-140772211
  misc_feature 1..91: note = hyper
  source 1..91: mol_type = genomic DNA

SEQ ID NO: 10146 - DNA, 545 bp, Homo sapiens; identical to SEQ ID NO: 868
  misc_feature 1..545: note = chr9:140772756-140773301
  misc_feature 1..545: note = hyper
  source 1..545: mol_type = genomic DNA

SEQ ID NO: 10147 - DNA, 40 bp, Homo sapiens
  misc_feature 1..40: note = chr10:1778568-1778608
  misc_feature 1..40: note = hyper
  source 1..40: mol_type = genomic DNA
gagtttgtcagtggccgctgtcagccggctgcttttcctg

SEQ ID NO: 10148 - DNA, 239 bp, Homo sapiens; identical to SEQ ID NO: 3493
  misc_feature 1..239: note = chr10:1778844-1779083
  misc_feature 1..239: note = hyper
  source 1..239: mol_type = genomic DNA

SEQ ID NO: 10149 - DNA, 29 bp, Homo sapiens
  misc_feature 1..29: note = chr10:1779111-1779140
  misc_feature 1..29: note = hyper
  source 1..29: mol_type = genomic DNA
cggagcagccatcccgccagcaccccaaa

SEQ ID NO: 10150 - DNA, 398 bp, Homo sapiens
  misc_feature 1..398: note = chr10:1779437-1779835
  misc_feature 1..398: note = hyper
  source 1..398: mol_type = genomic DNA
ttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggcc

SEQ ID NO: 10151 - DNA, 195 bp, Homo sapiens
  misc_feature 1..195: note = chr10:1779836-1780031
  misc_feature 1..195: note = hyper
  source 1..195: mol_type = genomic DNA
cttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaa

SEQ ID NO: 10152 - DNA, 30 bp, Homo sapiens
  misc_feature 1..30: note = chr10:3109104-3109134
  misc_feature 1..30: note = hyper
  source 1..30: mol_type = genomic DNA
gctcggcccccacaacggcccgagcggccg

SEQ ID NO: 10153 - DNA, 121 bp, Homo sapiens; identical to SEQ ID NO: 869
  misc_feature 1..121: note = chr10:7450069-7450190
  misc_feature 1..121: note = hyper
  source 1..121: mol_type = genomic DNA

SEQ ID NO: 10154 - DNA, 1772 bp, Homo sapiens; identical to SEQ ID NO: 870
  misc_feature 1..1772: note = chr10:7450490-7452262
  misc_feature 1..1772: note = hyper
  source 1..1772: mol_type = genomic DNA

SEQ ID NO: 10155 - DNA, 446 bp, Homo sapiens; identical to SEQ ID NO: 3497
  misc_feature 1..446: note = chr10:7452546-7452992
  misc_feature 1..446: note = hyper
  source 1..446: mol_type = genomic DNA

SEQ ID NO: 10156 - DNA, 605 bp, Homo sapiens; identical to SEQ ID NO: 3498
  misc_feature 1..605: note = chr10:7453052-7453657
  misc_feature 1..605: note = hyper
  source 1..605: mol_type = genomic DNA

SEQ ID NO: 10157 - DNA, 93 bp, Homo sapiens; identical to SEQ ID NO: 3499
  misc_feature 1..93: note = chr10:7453902-7453995
  misc_feature 1..93: note = hyper
  source 1..93: mol_type = genomic DNA

SEQ ID NO: 10158 - DNA, 100 bp, Homo sapiens
  misc_feature 1..100: note = chr10:7454472-7454572
  misc_feature 1..100: note = hyper
  source 1..100: mol_type = genomic DNA
ccgtgaggccccctgcgccgccagtatgggaagatcctgcctccttacaccttggagaacgctgggcgacgactaaagcgccttccgccggcctgtcact

SEQ ID NO: 10159 - DNA, 188 bp, Homo sapiens
  misc_feature 1..188: note = chr10:7708669-7708857
  misc_feature 1..188: note = hyper
  source 1..188: mol_type = genomic DNA
cggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 10160 - DNA, 15 bp, Homo sapiens
  misc_feature 1..15: note = chr10:7708954-7708969
  misc_feature 1..15: note = hyper
  source 1..15: mol_type = genomic DNA
cgcggtcccagcccg

SEQ ID NO: 10161 - DNA, 15 bp, Homo sapiens
  misc_feature 1..15: note = chr10:8075930-8075945
  misc_feature 1..15: note = hyper
  source 1..15: mol_type = genomic DNA
gctggcagccaactt

SEQ ID NO: 10162 - DNA, 124 bp, Homo sapiens; identical to SEQ ID NO: 3501
  misc_feature 1..124: note = chr10:8076053-8076177
  misc_feature 1..124: note = hyper
  source 1..124: mol_type = genomic DNA

SEQ ID NO: 10163 - DNA, 39 bp, Homo sapiens; identical to SEQ ID NO: 3502
  misc_feature 1..39: note = chr10:8076448-8076487
  misc_feature 1..39: note = hyper
  source 1..39: mol_type = genomic DNA

SEQ ID NO: 10164 - DNA, 389 bp, Homo sapiens
  misc_feature 1..389: note = chr10:8076705-8077094
  misc_feature 1..389: note = hyper
  source 1..389: mol_type = genomic DNA
cccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggc

SEQ ID NO: 10165 - DNA, 96 bp, Homo sapiens; identical to SEQ ID NO: 3503
  misc_feature 1..96: note = chr10:8077922-8078018
  misc_feature 1..96: note = hyper
  source 1..96: mol_type = genomic DNA

SEQ ID NO: 10166 - DNA, 376 bp, Homo sapiens; identical to SEQ ID NO: 871
  misc_feature 1..376: note = chr10:8085599-8085975
  misc_feature 1..376: note = hyper
  source 1..376: mol_type = genomic DNA

SEQ ID NO: 10167 - DNA, 81 bp, Homo sapiens
  misc_feature 1..81: note = chr10:8090494-8090575
  misc_feature 1..81: note = hyper
  source 1..81: mol_type = genomic DNA
aagatgtccaaagcccgggagacccagggacgccggctgggctgcctccaccccttcttttcctcccgtggcacccacctg

SEQ ID NO: 10168 - DNA, 52 bp, Homo sapiens
  misc_feature 1..52: note = chr10:8091858-8091910
  misc_feature 1..52: note = hyper
  source 1..52: mol_type = genomic DNA
cacggcccggtcctccggcttctctcctttgaacaggcgctggggacctccg

SEQ ID NO: 10169 - skipped

SEQ ID NO: 10170 - DNA, 38 bp, Homo sapiens
  misc_feature 1..38: note = chr10:8093787-8093825
  misc_feature 1..38: note = hyper
  source 1..38: mol_type = genomic DNA
gcgcctggcctggcccggacccccgcagcccggctctc

SEQ ID NO: 10171 - DNA, 105 bp, Homo sapiens
  misc_feature 1..105: note = chr10:8093859-8093964
  misc_feature 1..105: note = hyper
  source 1..105: mol_type = genomic DNA
cgctcccttcccccttccttccccgtgggtcccgaggccgacctcggccctccctcctcggcatccccctcccatccttttcccttccccgctgccctgtgctcc

SEQ ID NO: 10172 - skipped

SEQ ID NO: 10173 - DNA, 72 bp, Homo sapiens
  misc_feature 1..72: note = chr10:8095387-8095459
  misc_feature 1..72: note = hyper
  source 1..72: mol_type = genomic DNA
gcattttcgggccagcggctgcagccacccgggcgccgctaggggatgcagtggctcaaaggaccgagcggg

SEQ ID NO: 10174 - DNA, 186 bp, Homo sapiens
  misc_feature 1..186: note = chr10:8095492-8095678
  misc_feature 1..186: note = hyper
  source 1..186: mol_type = genomic DNA
cgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggg

SEQ ID NO: 10175 - DNA, 73 bp, Homo sapiens
  misc_feature 1..73: note = chr10:8096204-8096277
  misc_feature 1..73: note = hyper
  source 1..73: mol_type = genomic DNA
taataatgatccatgcgtgcctattttttaaaagtctgaaaaagaaaattctgcccatcgaaatgaacttcat

SEQ ID NO: 10176 - DNA, 89 bp, Homo sapiens; identical to SEQ ID NO: 3505
  misc_feature 1..89: note = chr10:8097108-8097197
  misc_feature 1..89: note = hyper
  source 1..89: mol_type = genomic DNA

SEQ ID NO: 10177 - DNA, 41 bp, Homo sapiens
  misc_feature 1..41: note = chr10:8374499-8374540
  misc_feature 1..41: note = hyper
  source 1..41: mol_type = genomic DNA
tggtcatgaggagagcggcagcatctcggtagtgatgggaa

SEQ ID NO: 10178 - DNA, 172 bp, Homo sapiens; identical to SEQ ID NO: 3506
  misc_feature 1..172: note = chr10:11059492-11059664
  misc_feature 1..172: note = hyper
  source 1..172: mol_type = genomic DNA

SEQ ID NO: 10179 - DNA, 120 bp, Homo sapiens; identical to SEQ ID NO: 3507
  misc_feature 1..120: note = chr10:11059932-11060052
  misc_feature 1..120: note = hyper
  source 1..120: mol_type = genomic DNA

SEQ ID NO: 10180 - DNA, 121 bp, Homo sapiens
  misc_feature 1..121: note = chr10:11060314-11060435
  misc_feature 1..121: note = hyper
  source 1..121: mol_type = genomic DNA
ggcggtgcagggcgcggggcttcccggagggacgagcggagcgcggcgtcccggggaccgggcggggtccgcgagtccgggtgaggaccagcgggccgagcgcggcgtcccgggtccccgc

SEQ ID NO: 10181 - DNA, 217 bp, Homo sapiens
  misc_feature 1..217: note = chr10:13043317-13043534
  misc_feature 1..217: note = hyper
  source 1..217: mol_type = genomic DNA
ggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgc

SEQ ID NO: 10182 - DNA, 33 bp, Homo sapiens; identical to SEQ ID NO: 3508
  misc_feature 1..33: note = chr10:13933506-13933539
  misc_feature 1..33: note = hyper
  source 1..33: mol_type = genomic DNA

SEQ ID NO: 10183 - DNA, 339 bp, Homo sapiens; identical to SEQ ID NO: 3509
  misc_feature 1..339: note = chr10:13933596-13933935
  misc_feature 1..339: note = hyper
  source 1..339: mol_type = genomic DNA

SEQ ID NO: 10184 - DNA, 14 bp, Homo sapiens
  misc_feature 1..14: note = chr10:13933982-13933996
  misc_feature 1..14: note = hyper
  source 1..14: mol_type = genomic DNA
cgccaccgcccgcc

SEQ ID NO: 10185 - DNA, 129 bp, Homo sapiens; identical to SEQ ID NO: 3511
  misc_feature 1..129: note = chr10:13933997-13934126
  misc_feature 1..129: note = hyper
  source 1..129: mol_type = genomic DNA

SEQ ID NO: 10186 - DNA, 75 bp, Homo sapiens; identical to SEQ ID NO: 3512
  misc_feature 1..75: note = chr10:13934168-13934243
  misc_feature 1..75: note = hyper
  source 1..75: mol_type = genomic DNA

SEQ ID NO: 10187 - DNA, 125 bp, Homo sapiens
  misc_feature 1..125: note = chr10:14215748-14215873
  misc_feature 1..125: note = hyper
  source 1..125: mol_type = genomic DNA
ggctgtctaatcaaccgagaggcgaactcatttactgaggttcccattgtccacgctgacagatggctcgctcccctctctgctctccccttcccctcagatcgcgctgccgtgcaggcaagcct

SEQ ID NO: 10188 - DNA, 858 bp, Homo sapiens; identical to SEQ ID NO: 872
  misc_feature 1..858: note = chr10:15760996-15761854
  misc_feature 1..858: note = hyper
  source 1..858: mol_type = genomic DNA

SEQ ID NO: 10189 - DNA, 111 bp, Homo sapiens; identical to SEQ ID NO: 873
  misc_feature 1..111: note = chr10:15761855-15761966
  misc_feature 1..111: note = hyper
  source 1..111: mol_type = genomic DNA

SEQ ID NO: 10190 - DNA, 81 bp, Homo sapiens; identical to SEQ ID NO: 3515
  misc_feature 1..81: note = chr10:16562545-16562626
  misc_feature 1..81: note = hyper
  source 1..81: mol_type = genomic DNA

SEQ ID NO: 10191 - DNA, 46 bp, Homo sapiens; identical to SEQ ID NO: 3516
  misc_feature 1..46: note = chr10:16562627-16562673
  misc_feature 1..46: note = hyper
  source 1..46: mol_type = genomic DNA

SEQ ID NO: 10192 - DNA, 956 bp, Homo sapiens; identical to SEQ ID NO: 3517
  misc_feature 1..956: note = chr10:16562709-16563665
  misc_feature 1..956: note = hyper
  source 1..956: mol_type = genomic DNA

SEQ ID NO: 10193 - DNA, 261 bp, Homo sapiens; identical to SEQ ID NO: 3518
  misc_feature 1..261: note = chr10:16563690-16563951
  misc_feature 1..261: note = hyper
  source 1..261: mol_type = genomic DNA

SEQ ID NO: 10194 - DNA, 32 bp, Homo sapiens; identical to SEQ ID NO: 3519
  misc_feature 1..32: note = chr10:17271223-17271255
  misc_feature 1..32: note = hyper
  source 1..32: mol_type = genomic DNA

SEQ ID NO: 10195 - DNA, 76 bp, Homo sapiens; identical to SEQ ID NO: 3520
  misc_feature 1..76: note = chr10:17271443-17271519
  misc_feature 1..76: note = hyper
  source 1..76: mol_type = genomic DNA

SEQ ID NO: 10196 - DNA, 221 bp, Homo sapiens; identical to SEQ ID NO: 3521
  misc_feature 1..221: note = chr10:17271520-17271741
  misc_feature 1..221: note = hyper
  source 1..221: mol_type = genomic DNA

SEQ ID NO: 10197 - DNA, 102 bp, Homo sapiens
  misc_feature 1..102: note = chr10:17495534-17495636
  misc_feature 1..102: note = hyper
  source 1..102: mol_type = genomic DNA
gcccgcgctgggcgccgctgtacctgttagtggcgcgcggtaccgcggtcgccgggctccggagcgtcctcagcgctgcgggggtgccgtgggtggcctccc

SEQ ID NO: 10198 - DNA, 300 bp, Homo sapiens
  misc_feature 1..300: note = chr10:17496544-17496844
  misc_feature 1..300: note = hyper
  source 1..300: mol_type = genomic DNA
ggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaaactgtgcagtcgcttggctggatcctcccacgcatgaagaaagct

SEQ ID NO: 10199 - DNA, 33 bp, Homo sapiens
  misc_feature 1..33: note = chr10:18429760-18429793
  misc_feature 1..33: note = hyper
  source 1..33: mol_type = genomic DNA
gggggcgctcggagccgccgcacaggtagcgag

SEQ ID NO: 10200 - DNA, 55 bp, Homo sapiens
  misc_feature 1..55: note = chr10:18430183-18430238
  misc_feature 1..55: note = hyper
  source 1..55: mol_type = genomic DNA
cgctttctacgatgccgactctcctggccacgctccgagccggggtgggcgtggg

SEQ ID NO: 10201 - DNA, 33 bp, Homo sapiens
  misc_feature 1..33: note = chr10:20105577-20105610
  misc_feature 1..33: note = hyper
  source 1..33: mol_type = genomic DNA
atctggggcaggcagcggcgctggctgtggaat

SEQ ID NO: 10202 - DNA, 30 bp, Homo sapiens
  misc_feature 1..30: note = chr10:20106628-20106658
  misc_feature 1..30: note = hyper
  source 1..30: mol_type = genomic DNA
gtgacctgggccaagcgggcgctggaaggg

SEQ ID NO: 10203 - DNA, 59 bp, Homo sapiens
  misc_feature 1..59: note = chr10:21783695-21783754
  misc_feature 1..59: note = hyper
  source 1..59: mol_type = genomic DNA
gcgcgcggactcggcttccccaggtcaggacccactaggtgggccgctcggccccaagc

SEQ ID NO: 10204 - DNA, 189 bp, Homo sapiens
  misc_feature 1..189: note = chr10:21805109-21805298
  misc_feature 1..189: note = hyper
  source 1..189: mol_type = genomic DNA
cgttccttatctcagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggt

SEQ ID NO: 10205 - DNA, 30 bp, Homo sapiens
  misc_feature 1..30: note = chr10:22518011-22518041
  misc_feature 1..30: note = hyper
  source 1..30: mol_type = genomic DNA
gaaatacatgcatttcggtggccccgttac

SEQ ID NO: 10206 - DNA, 615 bp, Homo sapiens; identical to SEQ ID NO: 874
  misc_feature 1..615: note = chr10:22541236-22541851
  misc_feature 1..615: note = hyper
  source 1..615: mol_type = genomic DNA

SEQ ID NO: 10207 - DNA, 226 bp, Homo sapiens; identical to SEQ ID NO: 875
  misc_feature 1..226: note = chr10:22542024-22542250
  misc_feature 1..226: note = hyper
  source 1..226: mol_type = genomic DNA

SEQ ID NO: 10208 - DNA, 560 bp, Homo sapiens; identical to SEQ ID NO: 876
  misc_feature 1..560: note = chr10:22624561-22625121
  misc_feature 1..560: note = hyper
  source 1..560: mol_type = genomic DNA

SEQ ID NO: 10209 - DNA, 401 bp, Homo sapiens; identical to SEQ ID NO: 877
  misc_feature 1..401: note = chr10:22625382-22625783
  misc_feature 1..401: note = hyper
  source 1..401: mol_type = genomic DNA

SEQ ID NO: 10210 - DNA, 292 bp, Homo sapiens; identical to SEQ ID NO: 878
  misc_feature 1..292: note = chr10:22625811-22626103
  misc_feature 1..292: note = hyper
  source 1..292: mol_type = genomic DNA

SEQ ID NO: 10211 - DNA, 190 bp, Homo sapiens; identical to SEQ ID NO: 879
  misc_feature 1..190: note = chr10:22633985-22634175
  misc_feature 1..190: note = hyper
  source 1..190: mol_type = genomic DNA

SEQ ID NO: 10212 - DNA, 108 bp, Homo sapiens; identical to SEQ ID NO: 880
  misc_feature 1..108: note = chr10:22634324-22634432
  misc_feature 1..108: note = hyper
  source 1..108: mol_type = genomic DNA

SEQ ID NO: 10213 - skipped

SEQ ID NO: 10214 - DNA, 215 bp, Homo sapiens; identical to SEQ ID NO: 882
  misc_feature 1..215: note = chr10:22634440-22634655
  misc_feature 1..215: note = hyper
  source 1..215: mol_type = genomic DNA

SEQ ID NO: 10215 - DNA, 897 bp, Homo sapiens; identical to SEQ ID NO: 883
  misc_feature 1..897: note = chr10:22764693-22765590
  misc_feature 1..897: note = hyper
  source 1..897: mol_type = genomic DNA

SEQ ID NO: 10216 - DNA, 274 bp, Homo sapiens; identical to SEQ ID NO: 3532
  misc_feature 1..274: note = chr10:23216856-23217130
  misc_feature 1..274: note = hyper
  source 1..274: mol_type = genomic DNA

SEQ ID NO: 10217 - DNA, 322 bp, Homo sapiens
  misc_feature 1..322: note = chr10:23461301-23461623
  misc_feature 1..322: note = hyper
  source 1..322: mol_type = genomic DNA
gactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccaga

SEQ ID NO: 10218 - DNA, 99 bp, Homo sapiens
  misc_feature 1..99: note = chr10:23462209-23462308
  misc_feature 1..99: note = hyper
  source 1..99: mol_type = genomic DNA
tctctgaaagggcagcgcaccccctcccgaccgctagcagcacaagtggcgacattcccatggagcggccgcgccgcagcttgccgcattcagcgcgga

SEQ ID NO: 10219 - DNA, 91 bp, Homo sapiens; identical to SEQ ID NO: 3533
  misc_feature 1..91: note = chr10:23462524-23462615
  misc_feature 1..91: note = hyper
  source 1..91: mol_type = genomic DNA

SEQ ID NO: 10220 - DNA, 298 bp, Homo sapiens; identical to SEQ ID NO: 3534
  misc_feature 1..298: note = chr10:23462634-23462932
  misc_feature 1..298: note = hyper
  source 1..298: mol_type = genomic DNA

SEQ ID NO: 10221 - DNA, 588 bp, Homo sapiens; identical to SEQ ID NO: 3535
  misc_feature 1..588: note = chr10:23463266-23463854
  misc_feature 1..588: note = hyper
  source 1..588: mol_type = genomic DNA

SEQ ID NO: 10222 - DNA, 190 bp, Homo sapiens; identical to SEQ ID NO: 3536
  misc_feature 1..190: note = chr10:23463887-23464077
  misc_feature 1..190: note = hyper
  source 1..190: mol_type = genomic DNA

SEQ ID NO: 10223 - DNA, 124 bp, Homo sapiens
  misc_feature 1..124: note = chr10:23480002-23480126
  misc_feature 1..124: note = hyper
  source 1..124: mol_type = genomic DNA
gcttctgaactctcccggggtggaagctgcagcctggcttttaaccggaattgcccagaccttgaaagtgtttctttgttgctcttaaaaagaggaattcacgttgcatcgcagtctgtgataa

SEQ ID NO: 10224 - DNA, 204 bp, Homo sapiens
  misc_feature 1..204: note = chr10:23480383-23480587
  misc_feature 1..204: note = hyper
  source 1..204: mol_type = genomic DNA
tgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagt

SEQ ID NO: 10225 - DNA, 35 bp, Homo sapiens
  misc_feature 1..35: note = chr10:23481015-23481050
  misc_feature 1..35: note = hyper
  source 1..35: mol_type = genomic DNA
ggagagggaagagagcggtgcgaggagccccgggc

SEQ ID NO: 10226 - DNA, 82 bp, Homo sapiens
  misc_feature 1..82: note = chr10:23481303-23481385
  misc_feature 1..82: note = hyper
  source 1..82: mol_type = genomic DNA
gggcactccagggaggcccgggggcgggcagcccggcggccgcctagctgcccccagccagggccccgggagggaggggctc

SEQ ID NO: 10227 - DNA, 400 bp, Homo sapiens
  misc_feature 1..400: note = chr10:23481386-23481786
  misc_feature 1..400: note = hyper
  source 1..400: mol_type = genomic DNA
gacgggccttagaaactcaccaagaactaacacgcgcagcccggcagtcccgctgcccactgcggcggcgagcatggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggc

SEQ ID NO: 10228 - DNA, 179 bp, Homo sapiens
  misc_feature 1..179: note = chr10:23481787-23481966
  misc_feature 1..179: note = hyper
  source 1..179: mol_type = genomic DNA
gcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaac

SEQ ID NO: 10229 - skipped

SEQ ID NO: 10230 - DNA, 172 bp, Homo sapiens
  misc_feature 1..172: note = chr10:23482288-23482460
  misc_feature 1..172: note = hyper
  source 1..172: mol_type = genomic DNA
cgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccaga

SEQ ID NO: 10231 - DNA, 734 bp, Homo sapiens; identical to SEQ ID NO: 884
  misc_feature 1..734: note = chr10:23483777-23484511
  misc_feature 1..734: note = hyper
  source 1..734: mol_type = genomic DNA

SEQ ID NO: 10232 - DNA, 30 bp, Homo sapiens
  misc_feature 1..30: note = chr10:23486384-23486414
  misc_feature 1..30: note = hyper
  source 1..30: mol_type = genomic DNA
accgagtaccagctgcgaggttgaacaaac

SEQ ID NO: 10233 - DNA, 413 bp, Homo sapiens; identical to SEQ ID NO: 3538
  misc_feature 1..413: note = chr10:23487742-23488155
  misc_feature 1..413: note = hyper
  source 1..413: mol_type = genomic DNA

SEQ ID NO: 10234 - DNA, 1097 bp, Homo sapiens; identical to SEQ ID NO: 885
  misc_feature 1..1097: note = chr10:23488393-23489490
  misc_feature 1..1097: note = hyper
  source 1..1097: mol_type = genomic DNA

SEQ ID NO: 10235 - DNA, 55 bp, Homo sapiens
  misc_feature 1..55: note = chr10:23633401-23633456
  misc_feature 1..55: note = hyper
  source 1..55: mol_type = genomic DNA
ggaaagctgcacccccgtaaataacccttcagcctcccgccgtgcccctggaccc

SEQ ID NO: 10236 - DNA, 886 bp, Homo sapiens; identical to SEQ ID NO: 886
  misc_feature 1..886: note = chr10:23982394-23983280
  misc_feature 1..886: note = hyper
  source 1..886: mol_type = genomic DNA

SEQ ID NO: 10237 - DNA, 190 bp, Homo sapiens
  misc_feature 1..190: note = chr10:23983617-23983807
  misc_feature 1..190: note = hyper
  source 1..190: mol_type = genomic DNA
cgcggggtggggggtggtgggggtgacgtcaggactgcagtccagaagagagcggctggagagggctgcgcgcttctcgccaagcaagcgggaggcgcactggggccgccgccgttcccgcgctcctccctctcctctgcacccactgtcacgctacccgcccgcgggggagcctcgagagcctccaggt

SEQ ID NO: 10238 - DNA, 83 bp, Homo sapiens; identical to SEQ ID NO: 3541
  misc_feature 1..83: note = chr10:23984130-23984213
  misc_feature 1..83: note = hyper
  source 1..83: mol_type = genomic DNA

SEQ ID NO: 10239 - DNA, 240 bp, Homo sapiens
  misc_feature 1..240: note = chr10:23984535-23984775
  misc_feature 1..240: note = hyper
  source 1..240: mol_type = genomic DNA
actaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 10240 - DNA, 146 bp, Homo sapiens
  misc_feature 1..146: note = chr10:23984841-23984987
  misc_feature 1..146: note = hyper
  source 1..146: mol_type = genomic DNA
cgacagcgcccgggagcagggtgacccccacagcggccggccttccggctggctgccctccccgctcgccgctctccccgcgccgctgcgggtcctccgagaccccggactgtcctgagctgcttcgagggcgggcgagaccctgt

SEQ ID NO: 10241 - DNA, 137 bp, Homo sapiens
  misc_feature 1..137: note = chr10:25464619-25464756
  misc_feature 1..137: note = hyper
  source 1..137: mol_type = genomic DNA
tcccaccagctgaagcgagccaactgctccggccgctacgagttggcgggcctgccggggaagtggccagccctggccagcgcgcacccctccttgcaccgggcgctggacacactgacacacgccaccaacttcct

SEQ ID NO: 10242 - DNA, 147 bp, Homo sapiens; identical to SEQ ID NO: 3542
  misc_feature 1..147: note = chr10:25465203-25465350
  misc_feature 1..147: note = hyper
  source 1..147: mol_type = genomic DNA

SEQ ID NO: 10243 - DNA, 204 bp, Homo sapiens; identical to SEQ ID NO: 3543
  misc_feature 1..204: note = chr10:25465351-25465555
  misc_feature 1..204: note = hyper
  source 1..204: mol_type = genomic DNA

SEQ ID NO: 10244 - DNA, 140 bp, Homo sapiens
  misc_feature 1..140: note = chr10:26055811-26055951
  misc_feature 1..140: note = hyper
  source 1..140: mol_type = genomic DNA
gatgccattatcagccgccaacagatggagcctatctgcgcgctgtcaatcatcccccacctgtggatcgcgcagcccagccaaaaaattaattgcttagaaatataaaatcggtggactcagatcggaaaggattagga

SEQ ID NO: 10245 - DNA, 30 bp, Homo sapiens
  misc_feature 1..30: note = chr10:26223157-26223187
  misc_feature 1..30: note = hyper
  source 1..30: mol_type = genomic DNA
agttcttcccctgctcggctgcccctgccc

SEQ ID NO: 10246 - DNA, 104 bp, Homo sapiens
  misc_feature 1..104: note = chr10:26223766-26223870
  misc_feature 1..104: note = hyper
  source 1..104: mol_type = genomic DNA
aacaggaggagggaacgggaagggtggcgtaaggggtgaaggaagatctttaggggtgaacttgggaaggaaacgtaaggggaggacctcgaagagtaacgagg

SEQ ID NO: 10247 - DNA, 279 bp, Homo sapiens; identical to SEQ ID NO: 887
  misc_feature 1..279: note = chr10:26500592-26500871
  misc_feature 1..279: note = hyper
  source 1..279: mol_type = genomic DNA

SEQ ID NO: 10248 - DNA, 30 bp, Homo sapiens
  misc_feature 1..30: note = chr10:26501132-26501162
  misc_feature 1..30: note = hyper
  source 1..30: mol_type = genomic DNA
cctttctcaccagcccgccagttgtggcaa

SEQ ID NO: 10249 - DNA, 39 bp, Homo sapiens
  misc_feature 1..39: note = chr10:26501446-26501485
  misc_feature 1..39: note = hyper
  source 1..39: mol_type = genomic DNA
gtgccttggaaaacccgtggtttgcgtgactgatccctc

SEQ ID NO: 10250 - DNA, 130 bp, Homo sapiens; identical to SEQ ID NO: 3545
  misc_feature 1..130: note = chr10:26504014-26504144
  misc_feature 1..130: note = hyper
  source 1..130: mol_type = genomic DNA

SEQ ID NO: 10251 - DNA, 694 bp, Homo sapiens; identical to SEQ ID NO: 3546
  misc_feature 1..694: note = chr10:26504190-26504884
  misc_feature 1..694: note = hyper
  source 1..694: mol_type = genomic DNA

SEQ ID NO: 10252 - DNA, 200 bp, Homo sapiens; identical to SEQ ID NO: 3547
  misc_feature 1..200: note = chr10:26505008-26505208
  misc_feature 1..200: note = hyper
  source 1..200: mol_type = genomic DNA

SEQ ID NO: 10253 - DNA, 65 bp, Homo sapiens
  misc_feature 1..65: note = chr10:26505553-26505618
  misc_feature 1..65: note = hyper
  source 1..65: mol_type = genomic DNA
acacacgcacagacacgcacgttttctgttcctgcgtgacacccgccctcgccgctcggccccgc

SEQ ID NO: 10254 - DNA, 90 bp, Homo sapiens; identical to SEQ ID NO: 3548
  misc_feature 1..90: note = chr10:26506073-26506163
  misc_feature 1..90: note = hyper
  source 1..90: mol_type = genomic DNA

SEQ ID NO: 10255 - DNA, 246 bp, Homo sapiens; identical to SEQ ID NO: 888
  misc_feature 1..246: note = chr10:26506373-26506619
  misc_feature 1..246: note = hyper
  source 1..246: mol_type = genomic DNA

SEQ ID NO: 10256 - DNA, 518 bp, Homo sapiens; identical to SEQ ID NO: 889
  misc_feature 1..518: note = chr10:26506902-26507420
  misc_feature 1..518: note = hyper
  source 1..518: mol_type = genomic DNA

SEQ ID NO: 10257 - DNA, 89 bp, Homo sapiens
  misc_feature 1..89: note = chr10:26727302-26727391
  misc_feature 1..89: note = hyper
  source 1..89: mol_type = genomic DNA
ccttagtccctcttgcgtcgaggctgcaaaatggttccattcgccaggagacgctcctgagagaagggcgcgcgcggcacaggtagggg

SEQ ID NO: 10258 - DNA, 200 bp, Homo sapiens; identical to SEQ ID NO: 890
  misc_feature 1..200: note = chr10:26727617-26727817
  misc_feature 1..200: note = hyper
  source 1..200: mol_type = genomic DNA

SEQ ID NO: 10259 - DNA, 183 bp, Homo sapiens; identical to SEQ ID NO: 891
  misc_feature 1..183: note = chr10:26727867-26728050
  misc_feature 1..183: note = hyper
  source 1..183: mol_type = genomic DNA

SEQ ID NO: 10260 - DNA, 606 bp, Homo sapiens; identical to SEQ ID NO: 3553
  misc_feature 1..606: note = chr10:27547726-27548332
  misc_feature 1..606: note = hyper
  source 1..606: mol_type = genomic DNA

SEQ ID NO: 10261 - DNA, 15 bp, Homo sapiens
  misc_feature 1..15: note = chr10:27548400-27548415
  misc_feature 1..15: note = hyper
  source 1..15: mol_type = genomic DNA
cgaatccattcttgg

SEQ ID NO: 10262 - DNA, 33 bp, Homo sapiens
  misc_feature 1..33: note = chr10:28030892-28030925
  misc_feature 1..33: note = hyper
  source 1..33: mol_type = genomic DNA
ggtcaggggaaaggtcgccgactggacataggg

SEQ ID NO: 10263 - DNA, 173 bp, Homo sapiens
  misc_feature 1..173: note = chr10:28032490-28032663
  misc_feature 1..173: note = hyper
  source 1..173: mol_type = genomic DNA
ggccttgaacttggccgggtcgccgggctgcggagccgaggggaggagcggcgccgccgcaactggcagggaccctgcggctctccccagttggctacacgcccccgcccctgcaggttccccggacaggtacctgccctcttccttgcctgggcgatcgatccccccaatcc

SEQ ID NO: 10264 - DNA, 54 bp, Homo sapiens
  misc_feature 1..54: note = chr10:28032966-28033020
  misc_feature 1..54: note = hyper
  source 1..54: mol_type = genomic DNA
tcgtgttttctagatcgtggatggtttggttgaaacccccgcatcttctgtccg

SEQ ID NO: 10265 - DNA, 40 bp, Homo sapiens
  misc_feature 1..40: note = chr10:28033410-28033450
  misc_feature 1..40: note = hyper
  source 1..40: mol_type = genomic DNA
tgagcctctgcctgccgcgcaccggcgtcaggagcaagtc

SEQ ID NO: 10266 - DNA, 83 bp, Homo sapiens
  misc_feature 1..83: note = chr10:28033790-28033873
  misc_feature 1..83: note = hyper
  source 1..83: mol_type = genomic DNA
gctacggtctgtgttcgtagggaagtgaagtcagacctctgctggatgtcgtgtgtcccctaggactgcgtcctcccgcgcag

SEQ ID NO: 10267 - DNA, 123 bp, Homo sapiens
  misc_feature 1..123: note = chr10:28034396-28034519
  misc_feature 1..123: note = hyper
  source 1..123: mol_type = genomic DNA
gtccccctcccccaacgccggcgaataattttaaagcaaaggaggcgcggccaggtgggctcccaagctccgcgcagacccttgggccagccttggccgctacccgagcgcctctccaccaga

SEQ ID NO: 10268 - DNA, 391 bp, Homo sapiens; identical to SEQ ID NO: 3555
  misc_feature 1..391: note = chr10:28034909-28035300
  misc_feature 1..391: note = hyper
  source 1..391: mol_type = genomic DNA

SEQ ID NO: 10269 - DNA, 45 bp, Homo sapiens
  misc_feature 1..45: note = chr10:28035615-28035660
  misc_feature 1..45: note = hyper
  source 1..45: mol_type = genomic DNA
gcttcctaacattaccgcaaatataagtagcgaaagcggcggttt

SEQ ID NO: 10270 - DNA, 378 bp, Homo sapiens
  misc_feature 1..378: note = chr10:28287828-28288206
  misc_feature 1..378: note = hyper
  source 1..378: mol_type = genomic DNA
gaggcctacagggcccgtgccctcccccgggcgccgccgccgccgccttccgctcccagcctcacccggccgcgaccgcagcccagtccgttaccctggtctcgggacctccgcgcatccaagattcccgcggacccgttgcaccgtatgcccgcgccagagacgctctgcgcccgcgctgggttccacccgccccggccacctgctgctttccgctcggcccctcccgggaaacacttttattcaactttgcatctccctttctcaaacacttttatgcaactcccgagtgtgcaccctaactcactccacgcggtgggaaaggttgactttgacagaggtcgtgagcagttgcggggtcggcggcaagttagcaga

SEQ ID NO: 10271 - DNA, 355 bp, Homo sapiens
  misc_feature 1..355: note = chr10:28957640-28957995
  misc_feature 1..355: note = hyper
  source 1..355: mol_type = genomic DNA
gagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcact

SEQ ID NO: 10272 - DNA, 15 bp, Homo sapiens
  misc_feature 1..15: note = chr10:28958043-28958058
  misc_feature 1..15: note = hyper
  source 1..15: mol_type = genomic DNA
cgatctttttggatg

SEQ ID NO: 10273 - DNA, 30 bp, Homo sapiens
  misc_feature 1..30: note = chr10:28965689-28965719
  misc_feature 1..30: note = hyper
  source 1..30: mol_type = genomic DNA
attgagtgtcagtctcggccagtgtcgtct

SEQ ID NO: 10274 - DNA, 124 bp, Homo sapiens
  misc_feature 1..124: note = chr10:29011038-29011162
  misc_feature 1..124: note = hyper
  source 1..124: mol_type = genomic DNA
agctgtttagacaaacgggctcagcgctccggagccgcgcgggcctccaaatgcaagggtttgttctgctggggcagcgtctgtcgcgaaagcagcggcggggaggaagcgcagagctgtgttt

SEQ ID NO: 10275 - DNA, 14 bp, Homo sapiens
  misc_feature 1..14: note = chr10:30026076-30026090
  misc_feature 1..14: note = hyper
  source 1..14: mol_type = genomic DNA
gcttaccctggagc

SEQ ID NO: 10276 - DNA, 47 bp, Homo sapiens
  misc_feature 1..47: note = chr10:31608931-31608978
  misc_feature 1..47: note = hyper
  source 1..47: mol_type = genomic DNA
ggtaaagttgggacccgcgggccgggcgcgctcgcgtaacggggatt

SEQ ID NO: 10277 - DNA, 81 bp, Homo sapiens
  misc_feature 1..81: note = chr10:31609959-31610040
  misc_feature 1..81: note = hyper
  source 1..81: mol_type = genomic DNA
cgtctataatgggaccgctgcagcgtcgagaaaacgaggaaatacgtgtttaggagaaaactctctcgtgctcccccagcc

SEQ ID NO: 10278 - DNA, 41 bp, Homo sapiens
  misc_feature 1..41: note = chr10:43248734-43248775
  misc_feature 1..41: note = hyper
  source 1..41: mol_type = genomic DNA
tcccccaggcaaaggcgccgccggcgcgtccagcgcggcct

SEQ ID NO: 10279 - DNA, 175 bp, Homo sapiens
  misc_feature 1..175: note = chr10:43249944-43250119
  misc_feature 1..175: note = hyper
  source 1..175: mol_type = genomic DNA
caggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatc

SEQ ID NO: 10280 - DNA, 15 bp, Homo sapiens
  misc_feature 1..15: note = chr10:43250136-43250151
  misc_feature 1..15: note = hyper
  source 1..15: mol_type = genomic DNA
cggggagggagcgtg

SEQ ID NO: 10281 - DNA, 374 bp, Homo sapiens; identical to SEQ ID NO: 3556
  misc_feature 1..374: note = chr10:43250406-43250780
  misc_feature 1..374: note = hyper
  source 1..374: mol_type = genomic DNA

SEQ ID NO: 10282 - DNA, 39 bp, Homo sapiens; identical to SEQ ID NO: 3557
  misc_feature 1..39: note = chr10:43250854-43250893
  misc_feature 1..39: note = hyper
  source 1..39: mol_type = genomic DNA

SEQ ID NO: 10283 - DNA, 78 bp, Homo sapiens
  misc_feature 1..78: note = chr10:43393565-43393643
  misc_feature 1..78: note = hyper
  source 1..78: mol_type = genomic DNA
cgcttcagcctctagcgacccagcgggggcgcgacttccgagccgcctccgcctcccgcctctaccgcggggccgggg

SEQ ID NO: 10284 - DNA, 30 bp, Homo sapiens
  misc_feature 1..30: note = chr10:43428424-43428454
  misc_feature 1..30: note = hyper
  source 1..30: mol_type = genomic DNA
agtctcagcgggttccggcttagtccggca

SEQ ID NO: 10285 - DNA, 92 bp, Homo sapiens; identical to SEQ ID NO: 892
  misc_feature 1..92: note = chr10:43429066-43429158
  misc_feature 1..92: note = hyper
  source 1..92: mol_type = genomic DNA

SEQ ID NO: 10286 - DNA, 77 bp, Homo sapiens; identical to SEQ ID NO: 3559
  misc_feature 1..77: note = chr10:43429361-43429438
  misc_feature 1..77: note = hyper
  source 1..77: mol_type = genomic DNA

SEQ ID NO: 10287 - DNA, 192 bp, Homo sapiens
  misc_feature 1..192: note = chr10:43571989-43572181
  misc_feature 1..192: note = hyper
  source 1..192: mol_type = genomic DNA
gcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcg

SEQ ID NO: 10288 - DNA, 30 bp, Homo sapiens
  misc_feature 1..30: note = chr10:43600564-43600594
  misc_feature 1..30: note = hyper
  source 1..30: mol_type = genomic DNA
acgaggacgactcggcgcccaccttccccg

SEQ ID NO: 10289 - DNA, 60 bp, Homo sapiens
  misc_feature 1..60: note = chr10:43697887-43697947
  misc_feature 1..60: note = hyper
  source 1..60: mol_type = genomic DNA
ccctcttggctgaaacgactccgaccctctcggaagatgcccgcgcggcctctgcccccg

SEQ ID NO: 10290 - DNA, 67 bp, Homo sapiens
  misc_feature 1..67: note = chr10:43724529-43724596
  misc_feature 1..67: note = hyper
  source 1..67: mol_type = genomic DNA
gcctgcaccctacagcgccctcgccctggagcgcacactcctcgaagccccacggtgggctccactc

SEQ ID NO: 10291 - DNA, 117 bp, Homo sapiens
  misc_feature 1..117: note = chr10:44185390-44185507
  misc_feature 1..117: note = hyper
  source 1..117: mol_type = genomic DNA
gcccttctcgtctcccgccgggctcactctttcgcattttgctgcgaaagtttactggaaataggtccattcactggtcgattcagagggacactagaaacgcgatgcccatatcta

SEQ ID NO: 10292 - DNA, 164 bp, Homo sapiens
  misc_feature 1..164: note = chr10:44879926-44880090
  misc_feature 1..164: note = hyper
  source 1..164: mol_type = genomic DNA
gcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctc

SEQ ID NO: 10293 - DNA, 78 bp, Homo sapiens
  misc_feature 1..78: note = chr10:44880377-44880455
  misc_feature 1..78: note = hyper
  source 1..78: mol_type = genomic DNA
gccgagcgcacttaccgtcgctgaggcagagcgcggtcagcacgaggaccagcacgaccacgaccttggcgttcatgg

SEQ ID NO: 10294 - DNA, 189 bp, Homo sapiens
  misc_feature 1..189: note = chr10:44880759-44880948
  misc_feature 1..189: note = hyper
  source 1..189: mol_type = genomic DNA
ggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgag

SEQ ID NO: 10295 - DNA, 159 bp, Homo sapiens
  misc_feature 1..159: note = chr10:49731642-49731801
  misc_feature 1..159: note = hyper
  source 1..159: mol_type = genomic DNA
gaatggtccctctcccggcagttaagccgcaggggcggcgcagggcgcgcgccgggctcgcggtgcagagacctgcgagcgggtctgggcgccgggggttcctccgtcccggccgtggacttggcggacctgcagccggcgccgcggccagccccgggc

SEQ ID NO: 10296 - DNA, 28 bp, Homo sapiens
  misc_feature 1..28: note = chr10:49732060-49732088
  misc_feature 1..28: note = hyper
  source 1..28: mol_type = genomic DNA
ccgcagggagcggggcgcacgtgcgcgc

SEQ ID NO: 10297 - DNA, 160 bp, Homo sapiens; identical to SEQ ID NO: 3561
  misc_feature 1..160: note = chr10:49732155-49732315
  misc_feature 1..160: note = hyper
  source 1..160: mol_type = genomic DNA

SEQ ID NO: 10298 - DNA, 227 bp, Homo sapiens; identical to SEQ ID NO: 3562
  misc_feature 1..227: note = chr10:49732316-49732543
  misc_feature 1..227: note = hyper
  source 1..227: mol_type = genomic DNA

SEQ ID NO: 10299 - DNA, 340 bp, Homo sapiens
  misc_feature 1..340: note = chr10:50323347-50323687
  misc_feature 1..340: note = hyper
  source 1..340: mol_type = genomic DNA
gacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcac

SEQ ID NO: 10300 - DNA, 205 bp, Homo sapiens
  misc_feature 1..205: note = chr10:50603003-50603208
  misc_feature 1..205: note = hyper
  source 1..205: mol_type = genomic DNA
gtgagagcagcccagcgacgggcccttgtaggctcgtgcagctcgtgatctgggccaggacgcggcgggtccactcgcctttgctttctgggatgtttgcagaagcaccgtgaaagattgatgcggccccctgggttgcggagccccaattagaggcgtgacaccagcatctgtgctgggaggattcggccggtccccgcggcac

SEQ ID NO: 10301 - DNA, 261 bp, Homo sapiens; identical to SEQ ID NO: 3563
  misc_feature 1..261: note = chr10:50603909-50604170
  misc_feature 1..261: note = hyper
  source 1..261: mol_type = genomic DNA

SEQ ID NO: 10302 - DNA, 30 bp, Homo sapiens
  misc_feature 1..30: note = chr10:50604615-50604645
  misc_feature 1..30: note = hyper
  source 1..30: mol_type = genomic DNA
tttatgttcgcttctcgatgcaaatgatat

SEQ ID NO: 10303 - DNA, 1458 bp, Homo sapiens; identical to SEQ ID NO: 893
  misc_feature 1..1458: note = chr10:50605213-50606671
  misc_feature 1..1458: note = hyper
  source 1..1458: mol_type = genomic DNA

SEQ ID NO: 10304 - DNA, 38 bp, Homo sapiens
  misc_feature 1..38: note = chr10:50817080-50817118
  misc_feature 1..38: note = hyper
  source 1..38: mol_type = genomic DNA
ctggagcctctctcccgccagtccgcccactggaacac

SEQ ID NO: 10305 - DNA, 30 bp, Homo sapiens
  misc_feature 1..30: note = chr10:50817434-50817464
  misc_feature 1..30: note = hyper
  source 1..30: mol_type = genomic DNA
gaggctggcaggagccgagggagggcttgg

SEQ ID NO: 10306 - DNA, 460 bp, Homo sapiens
  misc_feature 1..460: note = chr10:50818152-50818612
  misc_feature 1..460: note = hyper
  source 1..460: mol_type = genomic DNA
cgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacgg

SEQ ID NO: 10307 - DNA, 189 bp, Homo sapiens; identical to SEQ ID NO: 3565
  misc_feature 1..189: note = chr10:50821472-50821661
  misc_feature 1..189: note = hyper
  source 1..189: mol_type = genomic DNA

SEQ ID NO: 10308 - DNA, 52 bp, Homo sapiens
  misc_feature 1..52: note = chr10:50822142-50822194
  misc_feature 1..52: note = hyper
  source 1..52: mol_type = genomic DNA
cctaaatttgttgcccgagttcctccgggaagcgctccgggtagattctggg

SEQ ID NO: 10309 - DNA, 30 bp, Homo sapiens
  misc_feature 1..30: note = chr10:50887488-50887518
  misc_feature 1..30: note = hyper
  source 1..30: mol_type = genomic DNA
gcacgccgcctgacacgaacttactgtgcc

SEQ ID NO: 10310 - DNA, 27 bp, Homo sapiens
  misc_feature 1..27: note = chr10:50887789-50887816
  misc_feature 1..27: note = hyper
  source 1..27: mol_type = genomic DNA
cggcaggcctaccggtggagcaccaca

SEQ ID NO: 10311 - DNA, 196 bp, Homo sapiens
  misc_feature 1..196: note = chr10:50969916-50970112
  misc_feature 1..196: note = hyper
  source 1..196: mol_type = genomic DNA
accctccccatcccccgcacagccctcgcagctccgggccctcccctggccacggaaggcgcggggcagtctgaagtcctcgggctggagaaacccaccgcgagcacccgctcctctgcgcaggaccctggactagccgggtggtacgcgcgcgatgggctgggggtcccgggggaggccacggccagccaaggtc

SEQ ID NO: 10312 - DNA, 88 bp, Homo sapiens
  misc_feature 1..88: note = chr10:52177735-52177823
  misc_feature 1..88: note = hyper
  source 1..88: mol_type = genomic DNA
aattggcactgattgcggtattttaatcggttcacaccgtctgttagtgtattctaatgaaccacagcatctccggagcaacacttac

SEQ ID NO: 10313 - DNA, 30 bp, Homo sapiens
  misc_feature 1..30: note = chr10:52178275-52178305
  misc_feature 1..30: note = hyper
  source 1..30: mol_type = genomic DNA
cagtgtcggttaaggcggaactttcctttc

SEQ ID NO: 10314 - DNA, 137 bp, Homo sapiens
  misc_feature 1..137: note = chr10:52750888-52751025
  misc_feature 1..137: note = hyper
  source 1..137: mol_type = genomic DNA
gcctctcctctccatcgcttttagacttctcatcctcccctcggtgcttttagtccattcagcagaagcggatcgaagcaggaggctccccgcgccgcattaggggcgcactccgccgcgctcgagtacttagcgcc

SEQ ID NO: 10315 - DNA, 88 bp, Homo sapiens
  misc_feature 1..88: note = chr10:52833568-52833656
  misc_feature 1..88: note = hyper
  source 1..88: mol_type = genomic DNA
agaggcaagtttcttcgcaagcgttagccacctgtgtgaggcgctctgggtgggaaaggtggcgtgggagaagcgacagctcggccac

SEQ ID NO: 10316 - DNA, 87 bp, Homo sapiens
  misc_feature 1..87: note = chr10:52834409-52834496
  misc_feature 1..87: note = hyper
  source 1..87: mol_type = genomic DNA
gcgggatgctctcatcgacgagctggagctggagttggatcagaaggacgaactgatccagaagctgcagaacgagctggacaagta

SEQ ID NO: 10317 - DNA, 140 bp, Homo sapiens
  misc_feature 1..140: note = chr10:54068446-54068586
  misc_feature 1..140: note = hyper
  source 1..140: mol_type = genomic DNA
aagtctgattaagaccgggggtccccaggccgtttgatcttcgctcatcaaagagagtctttaaacaagcttcattttacactactgtatgctagcgacgggttgtgacacccaagtgcagccaccgtgagcacccggca

SEQ ID NO: 10318 - DNA, 133 bp, Homo sapiens
  misc_feature 1..133: note = chr10:54073162-54073295
  misc_feature 1..133: note = hyper
  source 1..133: mol_type = genomic DNA
acgttggaccctgtccgctttggtcccggccactttgatctcacgcgtctgcctaatcaagttcatctaccgccgcgattgccctgattcaaagaacaacattaaatggtttgattatcggatggtcatttcc

SEQ ID NO: 10319 - DNA, 89 bp, Homo sapiens
  misc_feature 1..89: note = chr10:57387425-57387514
  misc_feature 1..89: note = hyper
  source 1..89: mol_type = genomic DNA
ctccttcagcagcagcggacgtagggatcccgagcagccacggagcttaggtcccgcagagagctcctgccaagcgcttctctctcgac

SEQ ID NO: 10320 - DNA, 30 bp, Homo sapiens
  misc_feature 1..30: note = chr10:57387755-57387785
  misc_feature 1..30: note = hyper
  source 1..30: mol_type = genomic DNA
agcgagaaggcctggcggagatagcgcggg

SEQ ID NO: 10321 - DNA, 220 bp, Homo sapiens
  misc_feature 1..220: note = chr10:57388267-57388487
  misc_feature 1..220: note = hyper
  source 1..220: mol_type = genomic DNA
gacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagc

SEQ ID NO: 10322 - DNA, 46 bp, Homo sapiens
  misc_feature 1..46: note = chr10:57389890-57389936
  misc_feature 1..46: note = hyper
  source 1..46: mol_type = genomic DNA
aactggcaacagttacggcatttttgctctgcgaagaatacgccca

SEQ ID NO: 10323 - DNA, 30 bp, Homo sapiens
  misc_feature 1..30: note = chr10:57390376-57390406
  misc_feature 1..30: note = hyper
  source 1..30: mol_type = genomic DNA
ggcggacgcaaccagcgcacccgcagacgg

SEQ ID NO: 10324 - DNA, 30 bp, Homo sapiens
  misc_feature 1..30: note = chr10:57390646-57390676
  misc_feature 1..30: note = hyper
  source 1..30: mol_type = genomic DNA
cacacatccagtctccgggaacaaaactct

SEQ ID NO: 10325 - DNA, 94 bp, Homo sapiens
  misc_feature 1..94: note = chr10:57391255-57391349
  misc_feature 1..94: note = hyper
  source 1..94: mol_type = genomic DNA
tccttcccaggaggccgattctctccatcccaactcgctccgtggctcctgcttgctcctgttccccctcccgactccccgggtaacagtcgac

SEQ ID NO: 10326 - DNA, 188 bp, Homo sapiens
  misc_feature 1..188: note = chr10:60272637-60272825
  misc_feature 1..188: note = hyper
  source 1..188: mol_type = genomic DNA
cgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagtt

SEQ ID NO: 10327 - DNA, 149 bp, Homo sapiens
  misc_feature 1..149: note = chr10:60273130-60273279
  misc_feature 1..149: note = hyper
  source 1..149: mol_type = genomic DNA
cctctaactccttttcggacatccccaccgcgcgctccggcgcccgctactccagcctacggccggccggtttagctccaggcccgctcccccgcggagccggaggacacccagggactggagacttcgcgggactccccacccttcca

SEQ ID NO: 10328 - DNA, 48 bp, Homo sapiens
  misc_feature 1..48: note = chr10:60936403-60936451
  misc_feature 1..48: note = hyper
  source 1..48: mol_type = genomic DNA
gagccgcacactccgcggagctcctgccacagccgtcgccttcgcggc

SEQ ID NO: 10329 - DNA, 19 bp, Homo sapiens
  misc_feature 1..19: note = chr10:60936711-60936730
  misc_feature 1..19: note = hyper
  source 1..19: mol_type = genomic DNA
ccgggacggtaagagcggc

SEQ ID NO: 10330 - DNA, 30 bp, Homo sapiens; identical to SEQ ID NO: 3566
  misc_feature 1..30: note = chr10:60937073-60937103
  misc_feature 1..30: note = hyper
  source 1..30: mol_type = genomic DNA

SEQ ID NO: 10331 - DNA, 260 bp, Homo sapiens
  misc_feature 1..260: note = chr10:63212569-63212829
  misc_feature 1..260: note = hyper
  source 1..260: mol_type = genomic DNA
cgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagacca

SEQ ID NO: 10332 - DNA, 92 bp, Homo sapiens
  misc_feature 1..92: note = chr10:63213120-63213212
  misc_feature 1..92: note = hyper
  source 1..92: mol_type = genomic DNA
ggcgttattctccagcgctgcccatccccctcccaatctcggggccagtctccatccctgtccggtatccccgcccccgggcctctgtgagg

SEQ ID NO: 10333 - DNA, 250 bp, Homo sapiens
  misc_feature 1..250: note = chr10:64133867-64134117
  misc_feature 1..250: note = hyper
  source 1..250: mol_type = genomic DNA
agtgtaatcctgagtcggatcgggctcccggctgggtggcgggggggcagatgatgctcccgccagctgggcagagcaagggtgttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagcc

SEQ ID NO: 10334 - DNA, 354 bp, Homo sapiens
  misc_feature 1..354: note = chr10:64574714-64575068
  misc_feature 1..354: note = hyper
  source 1..354: mol_type = genomic DNA
gctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccc

SEQ ID NO: 10335 - DNA, 667 bp, Homo sapiens
  misc_feature 1..667: note = chr10:64575127-64575794
  misc_feature 1..667: note = hyper
  source 1..667: mol_type = genomic DNA
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgct

SEQ ID NO: 10336 - DNA, 342 bp, Homo sapiens; identical to SEQ ID NO: 3567
  misc_feature 1..342: note = chr10:64578287-64578629
  misc_feature 1..342: note = hyper
  source 1..342: mol_type = genomic DNA

SEQ ID NO: 10337 - skipped

SEQ ID NO: 10338 - DNA, 39 bp, Homo sapiens
  misc_feature 1..39: note = chr10:71327725-71327764
  misc_feature 1..39: note = hyper
  source 1..39: mol_type = genomic DNA
cgcctcactcccagacgcatctctcgcgctggatctacg

SEQ ID NO: 10339 - DNA, 154 bp, Homo sapiens
  misc_feature 1..154: note = chr10:71328773-71328927
  misc_feature 1..154: note = hyper
  source 1..154: mol_type = genomic DNA
gcattccaatggccccgggacgcttttgtcctccgactgaggccggctgggggtggggtgggatgggggcagggcaccataaatctacctgcttgtgtgccagcgcggcttgactggaaggaggagcaagattcatgtgcggtttttctggaag

SEQ ID NO: 10340 - DNA, 102 bp, Homo sapiens
  misc_feature 1..102: note = chr10:71331570-71331672
  misc_feature 1..102: note = hyper
  source 1..102: mol_type = genomic DNA
ggagggcaatggctccgaaaagtgcacgaggagaaggcagagggtcgccttcgtggctttaaggcagagtgaggcgccctgaaatcccggacctgattggga

SEQ ID NO: 10341 - DNA, 462 bp, Homo sapiens; identical to SEQ ID NO: 894
  misc_feature 1..462: note = chr10:71331980-71332442
  misc_feature 1..462: note = hyper
  source 1..462: mol_type = genomic DNA

SEQ ID NO: 10342 - DNA, 230 bp, Homo sapiens
  misc_feature 1..230: note = chr10:71332821-71333051
  misc_feature 1..230: note = hyper
  source 1..230: mol_type = genomic DNA
gggtaagtttgagtccgtcactgggcgcagtccgcgattccgaggctaggtgggaaaaaacaaaaacagccatcctcccagcccccgctgggtcagaggatccctctttcccctgcccgtccctcggaggcctccaaatattacctttctaccggcgcaaaagaatagagagcgatgagcagcgagggccgtggggagctcagcgggcttctggtcgccaagttcagctg

SEQ ID NO: 10343 - DNA, 57 bp, Homo sapiens
  misc_feature 1..57: note = chr10:71338223-71338280
  misc_feature 1..57: note = hyper
  source 1..57: mol_type = genomic DNA
ggcatccacagaaaacgcgactgatgacacagatgcggagcgcgagatgcccatatg

SEQ ID NO: 10344 - DNA, 49 bp, Homo sapiens
  misc_feature 1..49: note = chr10:71562537-71562586
  misc_feature 1..49: note = hyper
  source 1..49: mol_type = genomic DNA
tgttcagccggtgtccgcgggcgctcgctctctgcgagccccaggttcg

SEQ ID NO: 10345 - DNA, 51 bp, Homo sapiens
  misc_feature 1..51: note = chr10:71813722-71813773
  misc_feature 1..51: note = hyper
  source 1..51: mol_type = genomic DNA
cccagcctccagccccggcgcacctcagccccagcccggccagccccccgg

SEQ ID NO: 10346 - DNA, 89 bp, Homo sapiens; identical to SEQ ID NO: 3570
  misc_feature 1..89: note = chr10:72015293-72015382
  misc_feature 1..89: note = hyper
  source 1..89: mol_type = genomic DNA

SEQ ID NO: 10347 - DNA, 70 bp, Homo sapiens
  misc_feature 1..70: note = chr10:72043778-72043848
  misc_feature 1..70: note = hyper
  source 1..70: mol_type = genomic DNA
cgccccgggcccgcctcccgcatggcgctctctccacagagcccgagcgcccctccgaagtaggggacac

SEQ ID NO: 10348 - DNA, 15 bp, Homo sapiens
  misc_feature 1..15: note = chr10:72200050-72200065
  misc_feature 1..15: note = hyper
  source 1..15: mol_type = genomic DNA
gccccctcccatccc

SEQ ID NO: 10349 - DNA, 655 bp, Homo sapiens; identical to SEQ ID NO: 896
  misc_feature 1..655: note = chr10:72200117-72200772
  misc_feature 1..655: note = hyper
  source 1..655: mol_type = genomic DNA

SEQ ID NO: 10350 - DNA, 557 bp, Homo sapiens; identical to SEQ ID NO: 897
  misc_feature 1..557: note = chr10:72200824-72201381
  misc_feature 1..557: note = hyper
  source 1..557: mol_type = genomic DNA

SEQ ID NO: 10351 - DNA, 49 bp, Homo sapiens
  misc_feature 1..49: note = chr10:72431989-72432038
  misc_feature 1..49: note = hyper
  source 1..49: mol_type = genomic DNA
agcagccatagaaagcggctttgggccaccactccggggatcccaggcg

SEQ ID NO: 10352 - DNA, 56 bp, Homo sapiens
  misc_feature 1..56: note = chr10:73156679-73156735
  misc_feature 1..56: note = hyper
  source 1..56: mol_type = genomic DNA
cgcggacttgagcggcggcggcggctcgggagagagggacgcgggctgcaggcgcg

SEQ ID NO: 10353 - DNA, 135 bp, Homo sapiens
  misc_feature 1..135: note = chr10:73157113-73157248
  misc_feature 1..135: note = hyper
  source 1..135: mol_type = genomic DNA
ccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccct

SEQ ID NO: 10354 - DNA, 30 bp, Homo sapiens
  misc_feature 1..30: note = chr10:73157660-73157690
  misc_feature 1..30: note = hyper
  source 1..30: mol_type = genomic DNA
ggaagacgcgcccctcgaggagccgggagc

SEQ ID NO: 10355 - DNA, 72 bp, Homo sapiens; identical to SEQ ID NO: 3574
  misc_feature 1..72: note = chr10:73847720-73847792
  misc_feature 1..72: note = hyper
  source 1..72: mol_type = genomic DNA

SEQ ID NO: 10356 - DNA, 14 bp, Homo sapiens
  misc_feature 1..14: note = chr10:73848208-73848222
  misc_feature 1..14: note = hyper
  source 1..14: mol_type = genomic DNA
ggtgactggcggag

SEQ ID NO: 10357 - DNA, 15 bp, Homo sapiens
  misc_feature 1..15: note = chr10:75407398-75407413
  misc_feature 1..15: note = hyper
  source 1..15: mol_type = genomic DNA
cagattctgcacccc

SEQ ID NO: 10358 - DNA, 189 bp, Homo sapiens
  misc_feature 1..189: note = chr10:75407477-75407666
  misc_feature 1..189: note = hyper
  source 1..189: mol_type = genomic DNA
cgtctcctcctttcccggccggaacatctgcttccgggtcccccggcgccgggcctcctgcaggatacccgtgcgggcagctggcacagagatgcgctgctcgcgagcgctggggggctcaggagcccctgggcctggggcaggcgcctctgggcgcgcagagggtcgcaaaggcgcagataggaagat

SEQ ID NO: 10359 - DNA, 30 bp, Homo sapiens
  misc_feature 1..30: note = chr10:77191554-77191584
  misc_feature 1..30: note = hyper
  source 1..30: mol_type = genomic DNA
cgtggggagggacagcggggcacagaggct

SEQ ID NO: 10360 - DNA, 777 bp, Homo sapiens; identical to SEQ ID NO: 3576
  misc_feature 1..777: note = chr10:79396686-79397463
  misc_feature 1..777: note = hyper
  source 1..777: mol_type = genomic DNA

SEQ ID NO: 10361 - DNA, 581 bp, Homo sapiens
  misc_feature 1..581: note = chr10:79398015-79398596
  misc_feature 1..581: note = hyper
  source 1..581: mol_type = genomic DNA
ccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtg

SEQ ID NO: 10362 - DNA, 30 bp, Homo sapiens
  misc_feature 1..30: note = chr10:79470990-79471020
  misc_feature 1..30: note = hyper
  source 1..30: mol_type = genomic DNA
agcagccgcagtccccgaaaggacccgtcc

SEQ ID NO: 10363 - DNA, 392 bp, Homo sapiens
  misc_feature 1..392: note = chr10:81664598-81664990
  misc_feature 1..392: note = hyper
  source 1..392: mol_type = genomic DNA
gcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactgggaagatcgcgagtcgtgcgcgtgggaaggtcctccggctcatctttgctccccaggagcagcatatttcgcatctgccagaggtgtgcccgggggtcgttgggagagggacggggtgaatccctg

SEQ ID NO: 10364 - DNA, 127 bp, Homo sapiens
  misc_feature 1..127: note = chr10:81892288-81892415
  misc_feature 1..127: note = hyper
  source 1..127: mol_type = genomic DNA
ggcgcccaggtggcacgtcggtgcctcagctcccggggtctctgggctccgcgctgcccacggggtgccgaggggcctctggagggggcgggttctctcgagccagaaagtccggagccgcccagga

SEQ ID NO: 10365 - DNA, 329 bp, Homo sapiens
  misc_feature 1..329: note = chr10:82116699-82117028
  misc_feature 1..329: note = hyper
  source 1..329: mol_type = genomic DNA
gcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcg

SEQ ID NO: 10366 - DNA, 246 bp, Homo sapiens
  misc_feature 1..246: note = chr10:83633868-83634114
  misc_feature 1..246: note = hyper
  source 1..246: mol_type = genomic DNA
ccgcccccgccccctcgcccagcagcgtcagtctctgaccccactggatccgtacaggagacgactcacaatcggtcggaagctgcttttgcccccccaccccaccgcaaacgggggtttgcttggatcatttatctatcttgtgtgcattaagaaaccagcattagctgctagtgggaggcgctactctgcccgaatcccagcccgccgcggcgattctgcacacacacacgcaccagcctggca

SEQ ID NO: 10367 - DNA, 282 bp, Homo sapiens
  misc_feature 1..282: note = chr10:83634933-83635215
  misc_feature 1..282: note = hyper
  source 1..282: mol_type = genomic DNA
cgtgggggcagggagcggatttgcatgcggccgccgcggccgctgcctgcgcccgagcccgccgccgccgccggagcccgcgcccgcgcccgcgcccggcccgcgcggccccatgcctctgccgcggccctcgggggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacgg

SEQ ID NO: 10368 - DNA, 15 bp, Homo sapiens
  misc_feature 1..15: note = chr10:83635484-83635499
  misc_feature 1..15: note = hyper
  source 1..15: mol_type = genomic DNA
ctaccacttccacca

SEQ ID NO: 10369 - DNA, 29 bp, Homo sapiens
  misc_feature 1..29: note = chr10:83635530-83635559
  misc_feature 1..29: note = hyper
  source 1..29: mol_type = genomic DNA
cgcctcctccaggacgcccaaccggatta

SEQ ID NO: 10370 - DNA, 59 bp, Homo sapiens
  misc_feature 1..59: note = chr10:83636287-83636346
  misc_feature 1..59: note = hyper
  source 1..59: mol_type = genomic DNA
gagagagggccttcccgaaggcactgagccccttctccgcccgccggtaggaaggaaag

SEQ ID NO: 10371 - DNA, 30 bp, Homo sapiens
  misc_feature 1..30: note = chr10:85954715-85954745
  misc_feature 1..30: note = hyper
  source 1..30: mol_type = genomic DNA
tcttcctggcccattcggtagtggggagtg

SEQ ID NO: 10372 - DNA, 516 bp, Homo sapiens
  misc_feature 1..516: note = chr10:88125592-88126108
  misc_feature 1..516: note = hyper
  source 1..516: mol_type = genomic DNA
gccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcac

SEQ ID NO: 10373 - DNA, 20 bp, Homo sapiens
  misc_feature 1..20: note = chr10:88126833-88126853
  misc_feature 1..20: note = hyper
  source 1..20: mol_type = genomic DNA
agaatggaggagggccggcc

SEQ ID NO: 10374 - DNA, 279 bp, Homo sapiens
  misc_feature 1..279: note = chr10:88126854-88127133
  misc_feature 1..279: note = hyper
  source 1..279: mol_type = genomic DNA
ctaactgccctcgaggggctcccgaagcgccctggcgacctcagcagccgcgcgtctcgggtcatgtccccggccgaaacagaccgttcctcgtggagtgggacctggggagcaagaagagagaccggggcggggcgccgggccaggccccaggacagctggggagccagagggggccggccgccgcaagcatctcagagtagagcccgggccgtgggctcgaaccctggctggccgcgcggacctcggcgggcgcccatcccccgctccatgggcagc

SEQ ID NO: 10375 - DNA, 14 bp, Homo sapiens
  misc_feature 1..14: note = chr10:88127346-88127360
  misc_feature 1..14: note = hyper
  source 1..14: mol_type = genomic DNA
ggtgcctgcctcgg

SEQ ID NO: 10376 - DNA, 87 bp, Homo sapiens
  misc_feature 1..87: note = chr10:88149420-88149507
  misc_feature 1..87: note = hyper
  source 1..87: mol_type = genomic DNA
gctcccaggtctgggcgttaggattctctcagtcccggagccacgccggctgaccgcagggctcggggagcgcggctgggccccttt

SEQ ID NO: 10377 - DNA, 132 bp, Homo sapiens
  misc_feature 1..132: note = chr10:88391908-88392040
  misc_feature 1..132: note = hyper
  source 1..132: mol_type = genomic DNA
gaggatacagggagccgtttgcctgggttcgcgctcggctgtcctagctcacggggcgacctcggaaacgtccagcgtctgccctgtccccctgcgccgcgtctgagcagccagccccgggccaaagggtcg

SEQ ID NO: 10378 - DNA, 42 bp, Homo sapiens
  misc_feature 1..42: note = chr10:90343138-90343180
  misc_feature 1..42: note = hyper
  source 1..42: mol_type = genomic DNA
cgtccttgaggagcaaacctggggctgcggagaaccggggct

SEQ ID NO: 10379 - DNA, 30 bp, Homo sapiens
  misc_feature 1..30: note = chr10:90966573-90966603
  misc_feature 1..30: note = hyper
  source 1..30: mol_type = genomic DNA
accttgtggaaggtgcggtacagccagggc

SEQ ID NO: 10380 - DNA, 153 bp, Homo sapiens
  misc_feature 1..153: note = chr10:90967173-90967326
  misc_feature 1..153: note = hyper
  source 1..153: mol_type = genomic DNA
aataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacg

SEQ ID NO: 10381 - DNA, 512 bp, Homo sapiens; identical to SEQ ID NO: 3577
  misc_feature 1..512: note = chr10:90967644-90968156
  misc_feature 1..512: note = hyper
  source 1..512: mol_type = genomic DNA

SEQ ID NO: 10382 - DNA, 87 bp, Homo sapiens
  misc_feature 1..87: note = chr10:91295259-91295346
  misc_feature 1..87: note = hyper
  source 1..87: mol_type = genomic DNA
gcttcttggccagggcgctggggatccgggagcgggggccgccggcgagactgagcccgggacagcccagagctccagcgctccagc

SEQ ID NO: 10383 - DNA, 145 bp, Homo sapiens
  misc_feature 1..145: note = chr10:91295347-91295492
  misc_feature 1..145: note = hyper
  source 1..145: mol_type = genomic DNA
ctctgcagcccgcccagagcgcgcagaccacccccatgccccgcccgccctcctgccacacccgcccccagcccggccccgccgcctcctcacctcgccgggaccactgcagccctggcggtagcgcgcggacatgcccccgggg

SEQ ID NO: 10384 - DNA, 295 bp, Homo sapiens
  misc_feature 1..295: note = chr10:91295584-91295879
  misc_feature 1..295: note = hyper
  source 1..295: mol_type = genomic DNA
cggaggcgccggcgaggctggggccgggggcctagctggcaacgccgggagagggaagcgtagcgcggaaaatcccagtgctcggccttcgaaatgcaccggctcattcagccccgccagctccgccggggactctgcctggccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccc

SEQ ID NO: 10385 - DNA, 139 bp, Homo sapiens; identical to SEQ ID NO: 3578
  misc_feature 1..139: note = chr10:92617227-92617366
  misc_feature 1..139: note = hyper
  source 1..139: mol_type = genomic DNA

SEQ ID NO: 10386 - DNA, 529 bp, Homo sapiens
  misc_feature 1..529: note = chr10:93647119-93647648
  misc_feature 1..529: note = hyper
  source 1..529: mol_type = genomic DNA
ggccagtgggaaggtcggacgccgaggggcgaaatcaccccaccggcatcagaccaccgcctccattcagcggaggaatgtgggcgggcagaggacgcgcggtcccctcgcccggcgttaaccctgtgcgcgccgggagcttcgcccggagcatcgcagcatcgcgcagcgcccggagcccggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcaccgcaccgaggccagaagaaggtagccagcgcccaggcaagcgcttaaaactgcagcctcctccacacctttgcacgtggggaaacc

SEQ ID NO: 10387 - skipped

SEQ ID NO: 10388 - DNA, 70 bp, Homo sapiens
  misc_feature 1..70: note = chr10:94180377-94180447
  misc_feature 1..70: note = hyper
  source 1..70: mol_type = genomic DNA
acagccgttgggtaacggatcaaaacccttaacggccgcggctggagcgcgagctcggggcgccgagggg

SEQ ID NO: 10389 - DNA, 30 bp, Homo sapiens
  misc_feature 1..30: note = chr10:94451474-94451504
  misc_feature 1..30: note = hyper
  source 1..30: mol_type = genomic DNA
aagcaaagagtttttcgagctagaccaaca

SEQ ID NO: 10390 - DNA, 30 bp, Homo sapiens
  misc_feature 1..30: note = chr10:94822377-94822407
  misc_feature 1..30: note = hyper
  source 1..30: mol_type = genomic DNA
agagggagaaaggaccggaactggccttct

SEQ ID NO: 10391 - DNA, 328 bp, Homo sapiens
  misc_feature 1..328: note = chr10:94828193-94828521
  misc_feature 1..328: note = hyper
  source 1..328: mol_type = genomic DNA
cgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgcc

SEQ ID NO: 10392 - DNA, 159 bp, Homo sapiens; identical to SEQ ID NO: 898
  misc_feature 1..159: note = chr10:94828735-94828894
  misc_feature 1..159: note = hyper
  source 1..159: mol_type = genomic DNA

SEQ ID NO: 10393 - DNA, 53 bp, Homo sapiens
  misc_feature 1..53: note = chr10:94831830-94831883
  misc_feature 1..53: note = hyper
  source 1..53: mol_type = genomic DNA
ggccagaggttggttcgccgtgtttacagccaccaaatcgtttgccggagact

SEQ ID NO: 10394 - DNA, 92 bp, Homo sapiens
  misc_feature 1..92: note = chr10:94833030-94833122
  misc_feature 1..92: note = hyper
  source 1..92: mol_type = genomic DNA
tctgcctattgcgcccgatgccccgaggctctctcttggactctggccctgagttcttctgcgcgatccttcggagacgtctggaggcctgc

SEQ ID NO: 10395 - DNA, 937 bp, Homo sapiens; identical to SEQ ID NO: 899
  misc_feature 1..937: note = chr10:94834033-94834970
  misc_feature 1..937: note = hyper
  source 1..937: mol_type = genomic DNA

SEQ ID NO: 10396 - DNA, 36 bp, Homo sapiens
  misc_feature 1..36: note = chr10:95361207-95361243
  misc_feature 1..36: note = hyper
  source 1..36: mol_type = genomic DNA
cggccaggccaaatgcgccagcggccctggctcagt

SEQ ID NO: 10397 - DNA, 243 bp, Homo sapiens
  misc_feature 1..243: note = chr10:98945514-98945757
  misc_feature 1..243: note = hyper
  source 1..243: mol_type = genomic DNA
ccggggcagagccaccgaagagcccgcgggcttgcgcgcggcgcccctgcgggctgggaggcaccttgctcctccaagcgacggcgcctgtgcgcggacggagggagggcgccttgggcggagggggctcggctcctctgccgtttcgccgcctgcgtctccctctccctccctccagctcccaactgactgctgcgaggaggaaaatgggcaggccccgcgcgcgcacgcaccctgcgcaca

SEQ ID NO: 10398 - DNA, 29 bp, Homo sapiens
  misc_feature 1..29: note = chr10:98945992-98946021
  misc_feature 1..29: note = hyper
  source 1..29: mol_type = genomic DNA
gggtgtgactcgacccgccaagtcctggc

SEQ ID NO: 10399 - DNA, 76 bp, Homo sapiens
  misc_feature 1..76: note = chr10:98946094-98946170
  misc_feature 1..76: note = hyper
  source 1..76: mol_type = genomic DNA
cgcaccccggcacccgcggccccagctgctagtccagggtgggagggagatcttattttgccgcttggacgccttc

SEQ ID NO: 10400 - DNA, 185 bp, Homo sapiens; identical to SEQ ID NO: 3581
  misc_feature 1..185: note = chr10:99080262-99080447
  misc_feature 1..185: note = hyper
  source 1..185: mol_type = genomic DNA

SEQ ID NO: 10401 - DNA, 127 bp, Homo sapiens
  misc_feature 1..127: note = chr10:99531148-99531275
  misc_feature 1..127: note = hyper
  source 1..127: mol_type = genomic DNA
caggccaggggaagccgtaggcctccatgagcggcgcgcagccggcgcgcacggcctcgcacagcgagcggcacgggtagatgggccggtcgagacagacgggcgcaaagagcgagcacaggaagac

SEQ ID NO: 10402 - DNA, 98 bp, Homo sapiens
  misc_feature 1..98: note = chr10:99531512-99531610
  misc_feature 1..98: note = hyper
  source 1..98: mol_type = genomic DNA
cggcgcccagtgcagcgcccccagcagcagcgccagcgcggccgtccgcacgcccccccccgccgccgccgcccgcatggctgcgccctctccaggtg

SEQ ID NO: 10403 - DNA, 16 bp, Homo sapiens
  misc_feature 1..16: note = chr10:99531863-99531879
  misc_feature 1..16: note = hyper
  source 1..16: mol_type = genomic DNA
gccctcagcccctccc

SEQ ID NO: 10404 - DNA, 101 bp, Homo sapiens
  misc_feature 1..101: note = chr10:99531880-99531981
  misc_feature 1..101: note = hyper
  source 1..101: mol_type = genomic DNA
caccctgcccgagcgtcccgcccagcgccaggtcttgcgcccctctcccggctcggctcccctgccgcagccctggcctcgcccagcgtttctccccaggg

SEQ ID NO: 10405 - DNA, 119 bp, Homo sapiens; identical to SEQ ID NO: 900
  misc_feature 1..119: note = chr10:99789175-99789294
  misc_feature 1..119: note = hyper
  source 1..119: mol_type = genomic DNA

SEQ ID NO: 10406 - DNA, 44 bp, Homo sapiens
  misc_feature 1..44: note = chr10:99789739-99789783
  misc_feature 1..44: note = hyper
  source 1..44: mol_type = genomic DNA
tccccagcctggaagcgtaggcactcggccgaggccagtggctt

SEQ ID NO: 10407 - DNA, 32 bp, Homo sapiens; identical to SEQ ID NO: 901
  misc_feature 1..32: note = chr10:99790308-99790340
  misc_feature 1..32: note = hyper
  source 1..32: mol_type = genomic DNA

SEQ ID NO: 10408 - DNA, 323 bp, Homo sapiens; identical to SEQ ID NO: 902
  misc_feature 1..323: note = chr10:99790437-99790760
  misc_feature 1..323: note = hyper
  source 1..323: mol_type = genomic DNA

SEQ ID NO: 10409 - DNA, 260 bp, Homo sapiens; identical to SEQ ID NO: 903
  misc_feature 1..260: note = chr10:99790917-99791177
  misc_feature 1..260: note = hyper
  source 1..260: mol_type = genomic DNA

SEQ ID NO: 10410 - DNA, 74 bp, Homo sapiens; identical to SEQ ID NO: 904
  misc_feature 1..74: note = chr10:100992117-100992191
  misc_feature 1..74: note = hyper
  source 1..74: mol_type = genomic DNA

SEQ ID NO: 10411 - skipped

SEQ ID NO: 10412 - DNA, 49 bp, Homo sapiens
  misc_feature 1..49: note = chr10:100992458-100992507
  misc_feature 1..49: note = hyper
  source 1..49: mol_type = genomic DNA
gggggctgtgcctcccgcttccagacgcccgcagcggccccctcccgca

SEQ ID NO: 10413 - DNA, 451 bp, Homo sapiens; identical to SEQ ID NO: 906
  misc_feature 1..451: note = chr10:100993487-100993938
  misc_feature 1..451: note = hyper
  source 1..451: mol_type = genomic DNA

SEQ ID NO: 10414 - DNA, 456 bp, Homo sapiens; identical to SEQ ID NO: 907
  misc_feature 1..456: note = chr10:100993939-100994395
  misc_feature 1..456: note = hyper
  source 1..456: mol_type = genomic DNA

SEQ ID NO: 10415 - DNA, 62 bp, Homo sapiens
  misc_feature 1..62: note = chr10:100994599-100994661
  misc_feature 1..62: note = hyper
  source 1..62: mol_type = genomic DNA
aggaggaggaactggcggggggaggggggcattccgtctataaaaagcgccttacaaagtcc

SEQ ID NO: 10416 - DNA, 427 bp, Homo sapiens; identical to SEQ ID NO: 908
  misc_feature 1..427: note = chr10:100995797-100996224
  misc_feature 1..427: note = hyper
  source 1..427: mol_type = genomic DNA

SEQ ID NO: 10417 - DNA, 171 bp, Homo sapiens
  misc_feature 1..171: note = chr10:101088995-101089166
  misc_feature 1..171: note = hyper
  source 1..171: mol_type = genomic DNA
agtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcgg

SEQ ID NO: 10418 - DNA, 43 bp, Homo sapiens
  misc_feature 1..43: note = chr10:101089367-101089410
  misc_feature 1..43: note = hyper
  source 1..43: mol_type = genomic DNA
atttccagccaggaccgccggccaccgccgcaccggtgccctc

SEQ ID NO: 10419 - DNA, 55 bp, Homo sapiens
  misc_feature 1..55: note = chr10:101089855-101089910
  misc_feature 1..55: note = hyper
  source 1..55: mol_type = genomic DNA
ctgttcagcggcctgcgcctgagcctgctgtcgctggacccggtggagttacggg

SEQ ID NO: 10420 - DNA, 258 bp, Homo sapiens
  misc_feature 1..258: note = chr10:101280193-101280451
  misc_feature 1..258: note = hyper
  source 1..258: mol_type = genomic DNA
cacataaatcaccagcgccagagtctcgggaaaaggcgcatttttcattgctggctgcagggcgactccagaccgcgaacgagaaacagaagttgtctttagataaaccgttcaccggagcgcgcgttgtggcagcagggtccgcagagcacagggcaacctgggtctggcgctgcgcccccgccaccgatcacctcccagaggccccgcaagaaacccagatcctctcaagggctggtaccacgtcctcctgccaga

SEQ ID NO: 10421 - DNA, 253 bp, Homo sapiens
  misc_feature 1..253: note = chr10:101283181-101283434
  misc_feature 1..253: note = hyper
  source 1..253: mol_type = genomic DNA
atactgaatagaaagcgaaggacggaggtagggagaaaggaaactgctctggggggcggaggtgggggtacacgtaggagggaaggggagggggctagaggaggctccgccccaccgtccggcagtgtttattttcaaggcagcttcccgtcaatcctgtcaccggggcacattcttttcgggggctgtgaaccaccgtcagggctctgcaggaagatttgaggagggggagggctgtcgagtagggagcagg

SEQ ID NO: 10422 - DNA, 327 bp, Homo sapiens; identical to SEQ ID NO: 909
  misc_feature 1..327: note = chr10:101290372-101290699
  misc_feature 1..327: note = hyper
  source 1..327: mol_type = genomic DNA

SEQ ID NO: 10423 - DNA, 443 bp, Homo sapiens; identical to SEQ ID NO: 910
  misc_feature 1..443: note = chr10:101290700-101291143
  misc_feature 1..443: note = hyper
  source 1..443: mol_type = genomic DNA

SEQ ID NO: 10424 - DNA, 403 bp, Homo sapiens; identical to SEQ ID NO: 911
  misc_feature 1..403: note = chr10:101292461-101292864
  misc_feature 1..403: note = hyper
  source 1..403: mol_type = genomic DNA

SEQ ID NO: 10425 - DNA, 290 bp, Homo sapiens; identical to SEQ ID NO: 3594
  misc_feature 1..290: note = chr10:101293164-101293454
  misc_feature 1..290: note = hyper
  source 1..290: mol_type = genomic DNA

SEQ ID NO: 10426 - DNA, 644 bp, Homo sapiens; identical to SEQ ID NO: 3595
  misc_feature 1..644: note = chr10:101294756-101295400
  misc_feature 1..644: note = hyper
  source 1..644: mol_type = genomic DNA

SEQ ID NO: 10427 - DNA, 152 bp, Homo sapiens; identical to SEQ ID NO: 3596
  misc_feature 1..152: note = chr10:101295401-101295553
  misc_feature 1..152: note = hyper
  source 1..152: mol_type = genomic DNA

SEQ ID NO: 10428 - DNA, 44 bp, Homo sapiens
  misc_feature 1..44: note = chr10:101875049-101875093
  misc_feature 1..44: note = hyper
  source 1..44: mol_type = genomic DNA
tgcctgcaccggggccgccccgcaccccccgccaacccccagcc

SEQ ID NO: 10429 - DNA, 49 bp, Homo sapiens
  misc_feature 1..49: note = chr10:102322230-102322279
  misc_feature 1..49: note = hyper
  source 1..49: mol_type = genomic DNA
cccccgaccttccgccgactggccgtgggctggccgcagcccagctcgg

SEQ ID NO: 10430 - DNA, 30 bp, Homo sapiens
  misc_feature 1..30: note = chr10:102414410-102414440
  misc_feature 1..30: note = hyper
  source 1..30: mol_type = genomic DNA
tgcataagattaagccgaggctctcagctg

SEQ ID NO: 10431 - DNA, 448 bp, Homo sapiens
  misc_feature 1..448: note = chr10:102419399-102419847
  misc_feature 1..448: note = hyper
  source 1..448: mol_type = genomic DNA
cgtatcatccggcatatttgctgcttggctagccaaatagaagttgttttttgcacaaatttccttgtcaaatttgtcaatgttcatgtcatttttgctttaggtcacagagcaaggtgcaaattcctggcatctttactagttgcagccaatttcggcgatttcggcggtgacggggattctcagaggagccgcgtgcccgtgcgctcccgcctgtcggccccagagagcgcagccctgacacctcctcccggaagcccgccggcccgaccctggtttggaaggagaggctcagggagtgggacagagggtatctctctttccccagcgtccacccccagacgcctcctacccccaaccagggaggttagaggggcagatgggagtacgaggcttacacccagctctcctatgccacttcctctccctaagacgtggccttttcccc

SEQ ID NO: 10432 - DNA, 116 bp, Homo sapiens
  misc_feature 1..116: note = chr10:102430682-102430798
  misc_feature 1..116: note = hyper
  source 1..116: mol_type = genomic DNA
tactcctgacaggatcgccgggggcacggctgcgagataaccattagcgcagccgccgataaagcggggaggctgcatttccaaaggctccgcggccattacgggaaagttagtgt

SEQ ID NO: 10433 - DNA, 39 bp, Homo sapiens
  misc_feature 1..39: note = chr10:102470136-102470175
  misc_feature 1..39: note = hyper
  source 1..39: mol_type = genomic DNA
ccagccggcctggggcgccctagccgctggtcctggccc

SEQ ID NO: 10434 - DNA, 30 bp, Homo sapiens
  misc_feature 1..30: note = chr10:102470378-102470408
  misc_feature 1..30: note = hyper
  source 1..30: mol_type = genomic DNA
gtagaggggcttccccgggtgtgaggtgac

SEQ ID NO: 10435 - DNA, 197 bp, Homo sapiens
  misc_feature 1..197: note = chr10:102473519-102473716
  misc_feature 1..197: note = hyper
  source 1..197: mol_type = genomic DNA
cccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccc

SEQ ID NO: 10436 - DNA, 250 bp, Homo sapiens
  misc_feature 1..250: note = chr10:102473759-102474009
  misc_feature 1..250: note = hyper
  source 1..250: mol_type = genomic DNA
cggaggtgggactggggagcagggcctgggactccgctggtgggggtacacgcaggggcactggcgggggcggggggcgacggcactcagaattgcgctgaggcaaattccccgccaggtccagattggggggcgcgaggacaggagcatcgagtgcccggatagctgagcccccccactccccatccccttcctggaccccacgtctagggccgctggcggctcctgcgattagcgctccagatgtttg

SEQ ID NO: 10437 - DNA, 50 bp, Homo sapiens
  misc_feature 1..50: note = chr10:102475641-102475691
  misc_feature 1..50: note = hyper
  source 1..50: mol_type = genomic DNA
caggggccgaggctccgccattggggttaacggtgcggaagaatacaaaa

SEQ ID NO: 10438 - DNA, 41 bp, Homo sapiens
  misc_feature 1..41: note = chr10:102475904-102475945
  misc_feature 1..41: note = hyper
  source 1..41: mol_type = genomic DNA
tggtcacacctcttccgcgggaggggcggggtcggcggcca

SEQ ID NO: 10439 - DNA, 30 bp, Homo sapiens
  misc_feature 1..30: note = chr10:102483765-102483795
  misc_feature 1..30: note = hyper
  source 1..30: mol_type = genomic DNA
cgaggggagggggctcgatgggggaattgc

SEQ ID NO: 10440 - DNA, 111 bp, Homo sapiens; identical to SEQ ID NO: 3597
  misc_feature 1..111: note = chr10:102484269-102484380
  misc_feature 1..111: note = hyper
  source 1..111: mol_type = genomic DNA

SEQ ID NO: 10441 - DNA, 60 bp, Homo sapiens
  misc_feature 1..60: note = chr10:102489604-102489664
  misc_feature 1..60: note = hyper
  source 1..60: mol_type = genomic DNA
ctccccacctcccttcgcgccagggctgaaagtcccaggcgcccaatgcgtgcccaagaa

SEQ ID NO: 10442 - DNA, 15 bp, Homo sapiens
  misc_feature 1..15: note = chr10:102489700-102489715
  misc_feature 1..15: note = hyper
  source 1..15: mol_type = genomic DNA
cgccatggacccagg

SEQ ID NO: 10443 - DNA, 16 bp, Homo sapiens
  misc_feature 1..16: note = chr10:102495125-102495141
  misc_feature 1..16: note = hyper
  source 1..16: mol_type = genomic DNA
ggctgggctgcggtcc

SEQ ID NO: 10444 - DNA, 51 bp, Homo sapiens
  misc_feature 1..51: note = chr10:102495142-102495193
  misc_feature 1..51: note = hyper
  source 1..51: mol_type = genomic DNA
tgggcgcctcaggcagcgagggtggctgcttgcctgcggctggctggggcc

SEQ ID NO: 10445 - DNA, 35 bp, Homo sapiens
  misc_feature 1..35: note = chr10:102495544-102495579
  misc_feature 1..35: note = hyper
  source 1..35: mol_type = genomic DNA
gggggcggccatggccggggcgggctcctctcctc

SEQ ID NO: 10446 - DNA, 15 bp, Homo sapiens
  misc_feature 1..15: note = chr10:102497161-102497176
  misc_feature 1..15: note = hyper
  source 1..15: mol_type = genomic DNA
gggcggccgcttacc

SEQ ID NO: 10447 - DNA, 46 bp, Homo sapiens; identical to SEQ ID NO: 3599
  misc_feature 1..46: note = chr10:102497252-102497298
  misc_feature 1..46: note = hyper
  source 1..46: mol_type = genomic DNA

SEQ ID NO: 10448 - DNA, 26 bp, Homo sapiens
  misc_feature 1..26: note = chr10:102497299-102497325
  misc_feature 1..26: note = hyper
  source 1..26: mol_type = genomic DNA
ggggggagctgcggagctgggcagga

SEQ ID NO: 10449 - DNA, 241 bp, Homo sapiens; identical to SEQ ID NO: 912
  misc_feature 1..241: note = chr10:102497525-102497766
  misc_feature 1..241: note = hyper
  source 1..241: mol_type = genomic DNA

SEQ ID NO: 10450 - DNA, 32 bp, Homo sapiens
  misc_feature 1..32: note = chr10:102498739-102498771
  misc_feature 1..32: note = hyper
  source 1..32: mol_type = genomic DNA
gagggcctaatccgtcgcgcgcgcgcacgcgg

SEQ ID NO: 10451 - DNA, 211 bp, Homo sapiens
  misc_feature 1..211: note = chr10:102498831-102499042
  misc_feature 1..211: note = hyper
  source 1..211: mol_type = genomic DNA
cagcagcagccctagccccgacccgaggccccaagacggcgggccaggaacccctgggacgtcctggctccaggctggacgtaggcggaggtggcaggagtggacaaacccaggcgggtcccacgacgcccctttcctcgggtctctccttgtttcagccagccgctctcgcccctggtcccctctcccctgcgttcgggtcctttgtctc

SEQ ID NO: 10452 - DNA, 128 bp, Homo sapiens; identical to SEQ ID NO: 3602
  misc_feature 1..128: note = chr10:102501247-102501375
  misc_feature 1..128: note = hyper
  source 1..128: mol_type = genomic DNA

SEQ ID NO: 10453 - DNA, 181 bp, Homo sapiens
  misc_feature 1..181: note = chr10:102501875-102502056
  misc_feature 1..181: note = hyper
  source 1..181: mol_type = genomic DNA
gcttctgccttttctcgcctgggcagaaaacgctgggccagggaactggaaaccggaaaacaggagaaagggtttctggaaggcagcgggagcgggtggcagcggggcagcgggcagtggactaggtctacaccggcacttcacttttgcacaacatgcccagaaacgcatttgagagccc

SEQ ID NO: 10454 - DNA, 30 bp, Homo sapiens
  misc_feature 1..30: note = chr10:102502378-102502408
  misc_feature 1..30: note = hyper
  source 1..30: mol_type = genomic DNA
ttgcctttaaatttccgcagggaggcgggc

SEQ ID NO: 10455 - DNA, 216 bp, Homo sapiens
  misc_feature 1..216: note = chr10:102504302-102504518
  misc_feature 1..216: note = hyper
  source 1..216: mol_type = genomic DNA
tgcgcctcctgcgctcgccccggatccaccgagctagcagcgggcggcgctcagccgcgtccgcagcctcctcttctccccagccggggagagccagcctcgtctcccacatcctctgccgccagcgacctgcagctccgcactgtttccctcccctgtacccccttcccagtcacccgagggttcagaaaccaagtcccccggctctcccgccat

SEQ ID NO: 10456 - DNA, 69 bp, Homo sapiens; identical to SEQ ID NO: 913
  misc_feature 1..69: note = chr10:102507467-102507536
  misc_feature 1..69: note = hyper
  source 1..69: mol_type = genomic DNA

SEQ ID NO: 10457 - DNA, 43 bp, Homo sapiens
  misc_feature 1..43: note = chr10:102507908-102507951
  misc_feature 1..43: note = hyper
  source 1..43: mol_type = genomic DNA
ctggggctgaggggccgggccctgagcccggggaggctgaatt

SEQ ID NO: 10458 - DNA, 470 bp, Homo sapiens
  misc_feature 1..470: note = chr10:102508341-102508811
  misc_feature 1..470: note = hyper
  source 1..470: mol_type = genomic DNA
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctct

SEQ ID NO: 10459 - DNA, 145 bp, Homo sapiens
  misc_feature 1..145: note = chr10:102509140-102509285
  misc_feature 1..145: note = hyper
  source 1..145: mol_type = genomic DNA
ggcccttcctctcctcgctttcttacgccctttccgctggcatgaattcccctttggcattttctcccctctcccctcttttctgtcatctggtttctctccagtcccccctttgctttctaccttgcgtcgcaaggcctgagtc

SEQ ID NO: 10460 - DNA, 48 bp, Homo sapiens
  misc_feature 1..48: note = chr10:102509494-102509542
  misc_feature 1..48: note = hyper
  source 1..48: mol_type = genomic DNA
ctccccagcagggcacgggggtgtgaaccagctcgggggggtgtttgt

SEQ ID NO: 10461 - DNA, 1165 bp, Homo sapiens; identical to SEQ ID NO: 914
  misc_feature 1..1165: note = chr10:102589250-102590415
  misc_feature 1..1165: note = hyper
  source 1..1165: mol_type = genomic DNA

SEQ ID NO: 10462 - DNA, 51 bp, Homo sapiens; identical to SEQ ID NO: 3605
  misc_feature 1..51: note = chr10:102890968-102891019
  misc_feature 1..51: note = hyper
  source 1..51: mol_type = genomic DNA

SEQ ID NO: 10463 - DNA, 274 bp, Homo sapiens; identical to SEQ ID NO: 3606
  misc_feature 1..274: note = chr10:102891020-102891294
  misc_feature 1..274: note = hyper
  source 1..274: mol_type = genomic DNA

SEQ ID NO: 10464 - DNA, 380 bp, Homo sapiens; identical to SEQ ID NO: 3607
  misc_feature 1..380: note = chr10:102891576-102891956
  misc_feature 1..380: note = hyper
  source 1..380: mol_type = genomic DNA

SEQ ID NO: 10465 - DNA, 369 bp, Homo sapiens; identical to SEQ ID NO: 915
  misc_feature 1..369: note = chr10:102893583-102893952
  misc_feature 1..369: note = hyper
  source 1..369: mol_type = genomic DNA

SEQ ID NO: 10466 - DNA, 1155 bp, Homo sapiens; identical to SEQ ID NO: 916
  misc_feature 1..1155: note = chr10:102894090-102895245
  misc_feature 1..1155: note = hyper
  source 1..1155: mol_type = genomic DNA

SEQ ID NO: 10467 - DNA, 683 bp, Homo sapiens; identical to SEQ ID NO: 917
  misc_feature 1..683: note = chr10:102899173-102899856
  misc_feature 1..683: note = hyper
  source 1..683: mol_type = genomic DNA

SEQ ID NO: 10468 - DNA, 372 bp, Homo sapiens; identical to SEQ ID NO: 918
  misc_feature 1..372: note = chr10:102900262-102900634
  misc_feature 1..372: note = hyper
  source 1..372: mol_type = genomic DNA

SEQ ID NO: 10469 - DNA, 40 bp, Homo sapiens
  misc_feature 1..40: note = chr10:102905699-102905739
  misc_feature 1..40: note = hyper
  source 1..40: mol_type = genomic DNA
ccacaaggacttgtccgggccgggccgggctagatgccga

SEQ ID NO: 10470 - DNA, 125 bp, Homo sapiens
  misc_feature 1..125: note = chr10:102975199-102975324
  misc_feature 1..125: note = hyper
  source 1..125: mol_type = genomic DNA
tctgcccccaagtttcgaggaactgccccccagcgcccaggaggaaaggggaatggggctgtaaacgtgtctaattcagacccgttatccagatcggaattagtttctcgcggacacctccgcgc

SEQ ID NO: 10471 - DNA, 88 bp, Homo sapiens
  misc_feature 1..88: note = chr10:102975771-102975859
  misc_feature 1..88: note = hyper
  source 1..88: mol_type = genomic DNA
agagactgaaggaggcggggcatgggaccccggaagatgcctcccagacgttccaggcctgcttgcccggctccggaggtcttagcag

SEQ ID NO: 10472 - DNA, 70 bp, Homo sapiens
  misc_feature 1..70: note = chr10:102976414-102976484
  misc_feature 1..70: note = hyper
  source 1..70: mol_type = genomic DNA
gcaggatggattagccgagcaacgacctagagtctgagaaacgggcaggcacaaacgcttactcagacca

SEQ ID NO: 10473 - DNA, 712 bp, Homo sapiens
  misc_feature 1..712: note = chr10:102977236-102977948
  misc_feature 1..712: note = hyper
  source 1..712: mol_type = genomic DNA
gctaccgccgctgcccgcccgagcccccctcccctcctgcgctgcccgctcccagtctctccggcccgaattgtccgctccaggccccagacgctgaacacggaacgaaaaggcttccatcctggagacctggagacgagtgacgccagagcgacctcgtgcggttggggaaggcccagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattg

SEQ ID NO: 10474 - DNA, 280 bp, Homo sapiens
  misc_feature 1..280: note = chr10:102978742-102979022
  misc_feature 1..280: note = hyper
  source 1..280: mol_type = genomic DNA
tccaaggacatggctcggtttccagggtccccagagctgggacgccgccgggaaaccatggtcctggaggggagggagttatttgagggggtgcttgtccctgcctcgtcccttgtcaggccccgcgcggcgctaaagcgggggccgttttccctttaaatcgcggacactttgacaggggacattaaggacccggctgctcaggctgagcagatcataaaaccggacaggcaatttctgctcccgccaaatagccgggcaaactcgttctgcatctttg

SEQ ID NO: 10475 - DNA, 224 bp, Homo sapiens
  misc_feature 1..224: note = chr10:102982567-102982791
  misc_feature 1..224: note = hyper
  source 1..224: mol_type = genomic DNA
gccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccaga

SEQ ID NO: 10476 - DNA, 30 bp, Homo sapiens
  misc_feature 1..30: note = chr10:102983002-102983032
  misc_feature 1..30: note = hyper
  source 1..30: mol_type = genomic DNA
gagcctacacttgggcgaacacaccactgc

SEQ ID NO: 10477 - DNA, 135 bp, Homo sapiens; identical to SEQ ID NO: 919
  misc_feature 1..135: note = chr10:102983245-102983380
  misc_feature 1..135: note = hyper
  source 1..135: mol_type = genomic DNA

SEQ ID NO: 10478 - DNA, 315 bp, Homo sapiens; identical to SEQ ID NO: 920
  misc_feature 1..315: note = chr10:102983434-102983749
  misc_feature 1..315: note = hyper
  source 1..315: mol_type = genomic DNA

SEQ ID NO: 10479 - skipped

SEQ ID NO: 10480 - DNA, 1497 bp, Homo sapiens; identical to SEQ ID NO: 3614
  misc_feature 1..1497: note = chr10:102985456-102986953
  misc_feature 1..1497: note = hyper
  source 1..1497: mol_type = genomic DNA

SEQ ID NO: 10481 - DNA, 136 bp, Homo sapiens; identical to SEQ ID NO: 3615
  misc_feature 1..136: note = chr10:102987206-102987342
  misc_feature 1..136: note = hyper
  source 1..136: mol_type = genomic DNA

SEQ ID NO: 10482 - DNA, 256 bp, Homo sapiens
  misc_feature 1..256: note = chr10:102989238-102989494
  misc_feature 1..256: note = hyper
  source 1..256: mol_type = genomic DNA
aagctcattaattagcgggccgggggtaggaggagccggctggaattagcctgcctaatgcgcctgtcagtccgggcgctgcgctgcgttcggcccgagctgtttgtaaattacattagctgctcctttattgcacccgaacctcgggcgactgaaaagccaccgcccccaccccaaactgcgagccgcgctcctggcgcacccgcctcccgccggcctagctgcaatgaccgcaccggcccgaaggtctcggtct

SEQ ID NO: 10483 - DNA, 329 bp, Homo sapiens
  misc_feature 1..329: note = chr10:102989968-102990297
  misc_feature 1..329: note = hyper
  source 1..329: mol_type = genomic DNA
ggctggggccaccaacggcctgatgatgggcgtctgaagagtagccaggccaggtgccggggctaacggggccggctccgtgcctccctgctgcgctccgcccgggccccggccggggccccgctgccggccccgcctagcccagcgcccggcttgagtgcatggccaggccgactccagctgttccggatgcggggcgggggcccggcgggagccaggccgcggctggggctttgctctcaggaactcgcagggaggccaggcttccagttaggctggggctaaagaccttagggcccgggatctgtgaatatcgggagaacatgttg

SEQ ID NO: 10484 - DNA, 455 bp, Homo sapiens; identical to SEQ ID NO: 921
  misc_feature 1..455: note = chr10:102996026-102996481
  misc_feature 1..455: note = hyper
  source 1..455: mol_type = genomic DNA

SEQ ID NO: 10485 - DNA, 123 bp, Homo sapiens; identical to SEQ ID NO: 922
  misc_feature 1..123: note = chr10:102996596-102996719
  misc_feature 1..123: note = hyper
  source 1..123: mol_type = genomic DNA

SEQ ID NO: 10486 - DNA, 142 bp, Homo sapiens; identical to SEQ ID NO: 3618
  misc_feature 1..142: note = chr10:102997086-102997228
  misc_feature 1..142: note = hyper
  source 1..142: mol_type = genomic DNA

SEQ ID NO: 10487 - DNA, 303 bp, Homo sapiens; identical to SEQ ID NO: 3619
  misc_feature 1..303: note = chr10:102997281-102997584
  misc_feature 1..303: note = hyper
  source 1..303: mol_type = genomic DNA

SEQ ID NO: 10488 - DNA, 503 bp, Homo sapiens; identical to SEQ ID NO: 923
  misc_feature 1..503: note = chr10:102998356-102998859
  misc_feature 1..503: note = hyper
  source 1..503: mol_type = genomic DNA

SEQ ID NO: 10489 - DNA, 304 bp, Homo sapiens; identical to SEQ ID NO: 924
  misc_feature 1..304: note = chr10:103043924-103044228
  misc_feature 1..304: note = hyper
  source 1..304: mol_type = genomic DNA

SEQ ID NO: 10490 - DNA, 99 bp, Homo sapiens; identical to SEQ ID NO: 925
  misc_feature 1..99: note = chr10:103044300-103044399
  misc_feature 1..99: note = hyper
  source 1..99: mol_type = genomic DNA

SEQ ID NO: 10491 - DNA, 36 bp, Homo sapiens
  misc_feature 1..36: note = chr10:103051231-103051267
  misc_feature 1..36: note = hyper
  source 1..36: mol_type = genomic DNA
gcctccatgccgcgtcggccgcggccttgggggtct

SEQ ID NO: 10492 - DNA, 553 bp, Homo sapiens
  misc_feature 1..553: note = chr10:103534896-103535449
  misc_feature 1..553: note = hyper
  source 1..553: mol_type = genomic DNA
acaccctggggctcccggccagcccggaacagggaagcgagctccctgcccagcgcagggcccctgcccgggccttcctagaggagcagggcgcttttaagtagggaggcagccctccccgacccctgacatttataaagacaaatttacggagcaaatgttgagagtgcagggaacctgggcacccgatcattgggccaaatcggccacaagcctcccccgaggggcgctgagagggtctctgctgcagtcacccggcttcccctggcatcgaacatccatcccctggccgcggctgcccccttcctcggcggctgggtgttccctatgcccccagccggcgaggatgcatgggggacagtgctgggctccgagaccttcgtttctatcctggccactcactcgctgtgtgacctcaggaggggtgctacctctctgtgcctcagctccctcctcggggtggctcggggctgggtttctaaggtgccctcagccctcccgcgccggccgcagagtcagtcccggtgcccccgaccggcgctgcccacccggg

SEQ ID NO: 10493 - skipped

SEQ ID NO: 10494 - DNA, 177 bp, Homo sapiens; identical to SEQ ID NO: 3623
  misc_feature 1..177: note = chr10:103536320-103536497
  misc_feature 1..177: note = hyper
  source 1..177: mol_type = genomic DNA

SEQ ID NO: 10495 - DNA, 108 bp, Homo sapiens
  misc_feature 1..108: note = chr10:103986112-103986220
  misc_feature 1..108: note = hyper
  source 1..108: mol_type = genomic DNA
cgcagtggctgcgcccgggatagctggctgcgccgccgcgcacatgcctaggttcgacgccctcctccctttgcccaggagttccttctgtcccggctctgttccgtc

SEQ ID NO: 10496 - DNA, 142 bp, Homo sapiens
  misc_feature 1..142: note = chr10:104000843-104000985
  misc_feature 1..142: note = hyper
  source 1..142: mol_type = genomic DNA
ctggtttcaagtctccggcttcgttccggatcctctgagtctcccccttccctatcccctggttcttaccctgagtttcccttttcccaagtcctggccccaggtctgcagtccgccctcccattctcgacctgttcccaag

SEQ ID NO: 10497 - DNA, 62 bp, Homo sapiens; identical to SEQ ID NO: 3624
  misc_feature 1..62: note = chr10:104170201-104170263
  misc_feature 1..62: note = hyper
  source 1..62: mol_type = genomic DNA

SEQ ID NO: 10498 - DNA, 106 bp, Homo sapiens; identical to SEQ ID NO: 3625
  misc_feature 1..106: note = chr10:104170407-104170513
  misc_feature 1..106: note = hyper
  source 1..106: mol_type = genomic DNA

SEQ ID NO: 10499 - DNA, 287 bp, Homo sapiens; identical to SEQ ID NO: 3626
  misc_feature 1..287: note = chr10:104170514-104170801
  misc_feature 1..287: note = hyper
  source 1..287: mol_type = genomic DNA

SEQ ID NO: 10500 - DNA, 209 bp, Homo sapiens; identical to SEQ ID NO: 3627
  misc_feature 1..209: note = chr10:105036450-105036659
  misc_feature 1..209: note = hyper
  source 1..209: mol_type = genomic DNA

SEQ ID NO: 10501 - DNA, 163 bp, Homo sapiens; identical to SEQ ID NO: 3628
  misc_feature 1..163: note = chr10:105036700-105036863
  misc_feature 1..163: note = hyper
  source 1..163: mol_type = genomic DNA

SEQ ID NO: 10502 - DNA, 19 bp, Homo sapiens
  misc_feature 1..19: note = chr10:105036864-105036883
  misc_feature 1..19: note = hyper
  source 1..19: mol_type = genomic DNA
ccttaaaagccgggcgcac

SEQ ID NO: 10503 - DNA, 717 bp, Homo sapiens; identical to SEQ ID NO: 3630
  misc_feature 1..717: note = chr10:105036893-105037610
  misc_feature 1..717: note = hyper
  source 1..717: mol_type = genomic DNA

SEQ ID NO: 10504 - DNA, 86 bp, Homo sapiens
  misc_feature 1..86: note = chr10:105041683-105041769
  misc_feature 1..86: note = hyper
  source 1..86: mol_type = genomic DNA
tccctcaggctaagccggcagcagctgcgtggttgggggaggggacagactgcagcgctctgctcagatctcgagctggaggccat

SEQ ID NO: 10505 - skipped

SEQ ID NO: 10506 - DNA, 934 bp, Homo sapiens; identical to SEQ ID NO: 3631
  misc_feature 1..934: note = chr10:106399442-106400376
  misc_feature 1..934: note = hyper
  source 1..934: mol_type = genomic DNA

SEQ ID NO: 10507 - DNA, 110 bp, Homo sapiens; identical to SEQ ID NO: 3632
  misc_feature 1..110: note = chr10:106400808-106400918
  misc_feature 1..110: note = hyper
  source 1..110: mol_type = genomic DNA

SEQ ID NO: 10508 - DNA, 111 bp, Homo sapiens; identical to SEQ ID NO: 3633
  misc_feature 1..111: note = chr10:106401322-106401433
  misc_feature 1..111: note = hyper
  source 1..111: mol_type = genomic DNA

SEQ ID NO: 10509 - DNA, 681 bp, Homo sapiens; identical to SEQ ID NO: 3634
  misc_feature 1..681: note = chr10:106401510-106402191
  misc_feature 1..681: note = hyper
  source 1..681: mol_type = genomic DNA

SEQ ID NO: 10510 - DNA, 80 bp, Homo sapiens; identical to SEQ ID NO: 3635
  misc_feature 1..80: note = chr10:106402271-106402351
  misc_feature 1..80: note = hyper
  source 1..80: mol_type = genomic DNA

SEQ ID NO: 10511 - DNA, 205 bp, Homo sapiens; identical to SEQ ID NO: 3636
  misc_feature 1..205: note = chr10:106402620-106402825
  misc_feature 1..205: note = hyper
  source 1..205: mol_type = genomic DNA

SEQ ID NO: 10512 - DNA, 30 bp, Homo sapiens
  misc_feature 1..30: note = chr10:108923969-108923999
  misc_feature 1..30: note = hyper
  source 1..30: mol_type = genomic DNA
ggagcgtgcagcaaccgccatggatgcccc

SEQ ID NO: 10513 - DNA, 19 bp, Homo sapiens
  misc_feature 1..19: note = chr10:108924382-108924401
  misc_feature 1..19: note = hyper
  source 1..19: mol_type = genomic DNA
actccatccaagttgcgcc

SEQ ID NO: 10514 - skipped

SEQ ID NO: 10515 - DNA, 68 bp, Homo sapiens
  misc_feature 1..68: note = chr10:109674855-109674923
  misc_feature 1..68: note = hyper
  source 1..68: mol_type = genomic DNA
gcagccgccagcagagcccggtgcgggaccgggagctgccggggcctcagctccgctctccccacagc

SEQ ID NO: 10516 - DNA, 257 bp, Homo sapiens
  misc_feature 1..257: note = chr10:110225912-110226169
  misc_feature 1..257: note = hyper
  source 1..257: mol_type = genomic DNA
tctcctgcacctggtcgcggtggcgcgcccccatctcccgctgaaacccagaactttcggttcagcagggctgggaagcagccgccggcgcccacttttcccaccgcgggggcggagaacagcagagaggggtcccagaccgaaggtggcagcgcgtggctctgcgctggcggctgtggggggcaggcgctcaggaccccaattccctccaagttgggccgcggtgggggcgggtggaggtggcgccgggcagctgg

SEQ ID NO: 10517 - DNA, 71 bp, Homo sapiens
  misc_feature 1..71: note = chr10:110671709-110671780
  misc_feature 1..71: note = hyper
  source 1..71: mol_type = genomic DNA
gctctcaatagagggcgcgctgggcgaagtaggggcgtggcaggagccccgctccgcggatccaggttgaa

SEQ ID NO: 10518 - DNA, 180 bp, Homo sapiens; identical to SEQ ID NO: 3637
  misc_feature 1..180: note = chr10:110672065-110672245
  misc_feature 1..180: note = hyper
  source 1..180: mol_type = genomic DNA

SEQ ID NO: 10519 - DNA, 51 bp, Homo sapiens; identical to SEQ ID NO: 3638
  misc_feature 1..51: note = chr10:111216345-111216396
  misc_feature 1..51: note = hyper
  source 1..51: mol_type = genomic DNA

SEQ ID NO: 10520 - DNA, 15 bp, Homo sapiens
  misc_feature 1..15: note = chr10:111216789-111216804
  misc_feature 1..15: note = hyper
  source 1..15: mol_type = genomic DNA
caactccagccaagt

SEQ ID NO: 10521 - DNA, 705 bp, Homo sapiens
  misc_feature 1..705: note = chr10:112403151-112403856
  misc_feature 1..705: note = hyper
  source 1..705: mol_type = genomic DNA
tcagccttgaaaggccgcaggatgtccgcgtccacagctgtgaaccggtgagtgcaggtggacgggcgcacgcgggcgccagggtaattaacagggcttcagagggcgtgacggtgaccgtacgttgtcggcgaactctcttttcatcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtg

SEQ ID NO: 10522 - DNA, 56 bp, Homo sapiens
  misc_feature 1..56: note = chr10:112404226-112404282
  misc_feature 1..56: note = hyper
  source 1..56: mol_type = genomic DNA
agccatgagccaggacgcggaccccagcggtccggagcagccggacagagttgcct

SEQ ID NO: 10523 - DNA, 76 bp, Homo sapiens
  misc_feature 1..76: note = chr10:112431872-112431948
  misc_feature 1..76: note = hyper
  source 1..76: mol_type = genomic DNA
ggcattgcttttacccggtgggcttcagggagccgtccctgccgcgctttgcgtttctccgcgcacttggacaggg

SEQ ID NO: 10524 - DNA, 70 bp, Homo sapiens
  misc_feature 1..70: note = chr10:115804051-115804121
  misc_feature 1..70: note = hyper
  source 1..70: mol_type = genomic DNA
ctcagcagtggacagcgggcatgggtctgctgatggcgctcatcgtgctgctcatcgtggcgggcaatgt

SEQ ID NO: 10525 - DNA, 79 bp, Homo sapiens; identical to SEQ ID NO: 926
  misc_feature 1..79: note = chr10:115804976-115805055
  misc_feature 1..79: note = hyper
  source 1..79: mol_type = genomic DNA

SEQ ID NO: 10526 - DNA, 154 bp, Homo sapiens
  misc_feature 1..154: note = chr10:116852264-116852418
  misc_feature 1..154: note = hyper
  source 1..154: mol_type = genomic DNA
gcggtttcgaggcagcgtctgtaaggggtggagagcgcggggctcggagcctcgcagttctttgttgggggcgcgggcttcgttattcccgaggcagcaatggctccccctcggaggtccctccgcggagaccgcctcgcgcctctcgcagtcc

SEQ ID NO: 10527 - DNA, 48 bp, Homo sapiens
  misc_feature 1..48: note = chr10:118030658-118030706
  misc_feature 1..48: note = hyper
  source 1..48: mol_type = genomic DNA
ggcgggcggggaccccggccgcccctgctccgggcgagggcgcgcgcc

SEQ ID NO: 10528 - DNA, 74 bp, Homo sapiens
  misc_feature 1..74: note = chr10:118031388-118031462
  misc_feature 1..74: note = hyper
  source 1..74: mol_type = genomic DNA
cacatccaccacacccgcgccccaattttggtgcggagggcggggtgggctgctgcaagcgaccctaggaaaga

SEQ ID NO: 10529 - DNA, 16 bp, Homo sapiens
  misc_feature 1..16: note = chr10:118031848-118031864
  misc_feature 1..16: note = hyper
  source 1..16: mol_type = genomic DNA
ccctctcccctccccc

SEQ ID NO: 10530 - DNA, 263 bp, Homo sapiens
  misc_feature 1..263: note = chr10:118031865-118032128
  misc_feature 1..263: note = hyper
  source 1..263: mol_type = genomic DNA
ttcccgcctttggggaatttccaacaccggggtgaggacccacccccacccaggtcggggtgcatgtgcgtgttttccaggggccgctgacacggggatggaggtgagggctggagaggtctgaagagggttcctaaagtccaagggggtgtctgttgggttcaacccgagacgctgaacgcaagcaaataaataaataaacggtactttccgagcgtcgcgagcggagcctgcagctgcctggagtccgagccctcggtggc

SEQ ID NO: 10531 - DNA, 397 bp, Homo sapiens; identical to SEQ ID NO: 3640
  misc_feature 1..397: note = chr10:118032412-118032809
  misc_feature 1..397: note = hyper
  source 1..397: mol_type = genomic DNA

SEQ ID NO: 10532 - DNA, 95 bp, Homo sapiens; identical to SEQ ID NO: 927
  misc_feature 1..95: note = chr10:118033068-118033163
  misc_feature 1..95: note = hyper
  source 1..95: mol_type = genomic DNA

SEQ ID NO: 10533 - DNA, 454 bp, Homo sapiens; identical to SEQ ID NO: 928
  misc_feature 1..454: note = chr10:118033223-118033677
  misc_feature 1..454: note = hyper
  source 1..454: mol_type = genomic DNA

SEQ ID NO: 10534 - DNA, 157 bp, Homo sapiens; identical to SEQ ID NO: 3643
  misc_feature 1..157: note = chr10:118890938-118891095
  misc_feature 1..157: note = hyper
  source 1..157: mol_type = genomic DNA

SEQ ID NO: 10535 - DNA, 145 bp, Homo sapiens; identical to SEQ ID NO: 929
  misc_feature 1..145: note = chr10:118891517-118891662
  misc_feature 1..145: note = hyper
  source 1..145: mol_type = genomic DNA

SEQ ID NO: 10536 - DNA, 59 bp, Homo sapiens; identical to SEQ ID NO: 930
  misc_feature 1..59: note = chr10:118891715-118891774
  misc_feature 1..59: note = hyper
  source 1..59: mol_type = genomic DNA

SEQ ID NO: 10537 - DNA, 444 bp, Homo sapiens; identical to SEQ ID NO: 931
  misc_feature 1..444: note = chr10:118892013-118892457
  misc_feature 1..444: note = hyper
  source 1..444: mol_type = genomic DNA

SEQ ID NO: 10538 - DNA, 44 bp, Homo sapiens; identical to SEQ ID NO: 932
  misc_feature 1..44: note = chr10:118892517-118892561
  misc_feature 1..44: note = hyper
  source 1..44: mol_type = genomic DNA

SEQ ID NO: 10539 - DNA, 283 bp, Homo sapiens; identical to SEQ ID NO: 933
  misc_feature 1..283: note = chr10:118892955-118893238
  misc_feature 1..283: note = hyper
  source 1..283: mol_type = genomic DNA

SEQ ID NO: 10540 - DNA, 72 bp, Homo sapiens; identical to SEQ ID NO: 934
  misc_feature 1..72: note = chr10:118893679-118893751
  misc_feature 1..72: note = hyper
  source 1..72: mol_type = genomic DNA

SEQ ID NO: 10541 - DNA, 14 bp, Homo sapiens
  misc_feature 1..14: note = chr10:118894477-118894491
  misc_feature 1..14: note = hyper
  source 1..14: mol_type = genomic DNA
ggaatttccggtgg

SEQ ID NO: 10542 - DNA, 229 bp, Homo sapiens
  misc_feature 1..229: note = chr10:118896540-118896769
  misc_feature 1..229: note = hyper
  source 1..229: mol_type = genomic DNA
cagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagca

SEQ ID NO: 10543 - DNA, 30 bp, Homo sapiens
  misc_feature 1..30: note = chr10:118897545-118897575
  misc_feature 1..30: note = hyper
  source 1..30: mol_type = genomic DNA
ttttgtctggtttcccgaacataggcaaga

SEQ ID NO: 10544 - DNA, 260 bp, Homo sapiens
  misc_feature 1..260: note = chr10:118897895-118898155
  misc_feature 1..260: note = hyper
  source 1..260: mol_type = genomic DNA
tcaggtagcgaacagcgcaactccgaaatgctgcggctcccgcctgtttctgagacggcgagttgtagttgtccgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 10545 - DNA, 353 bp, Homo sapiens; identical to SEQ ID NO: 935
  misc_feature 1..353: note = chr10:118899892-118900245
  misc_feature 1..353: note = hyper
  source 1..353: mol_type = genomic DNA

SEQ ID NO: 10546 - DNA, 113 bp, Homo sapiens; identical to SEQ ID NO: 936
  misc_feature 1..113: note = chr10:118900323-118900436
  misc_feature 1..113: note = hyper
  source 1..113: mol_type = genomic DNA

SEQ ID NO: 10547 - DNA, 360 bp, Homo sapiens
  misc_feature 1..360: note = chr10:118922201-118922561
  misc_feature 1..360: note = hyper
  source 1..360: mol_type = genomic DNA
tttgccttctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtc

SEQ ID NO: 10548 - DNA, 30 bp, Homo sapiens
  misc_feature 1..30: note = chr10:118922778-118922808
  misc_feature 1..30: note = hyper
  source 1..30: mol_type = genomic DNA
ctccccgagcactgccggccaggccgggct

SEQ ID NO: 10549 - DNA, 242 bp, Homo sapiens
  misc_feature 1..242: note = chr10:118923063-118923305
  misc_feature 1..242: note = hyper
  source 1..242: mol_type = genomic DNA
gcggagaaccctctccgagctggggtccccgcctgctgggcaacctcacctcaacgtctggcctggcctggggccgcttggactcggcagcggctgcactcctacagagcccagacgcgccttctcgctttttcctttctgggccggggccctaaactcccggaactcgccgcaagaggagcgttgaaaacaaaagggacagcccaagctgtcccgcccgctgcgcccgaggagcatcccct

SEQ ID NO: 10550 - DNA, 292 bp, Homo sapiens; identical to SEQ ID NO: 3653
  misc_feature 1..292: note = chr10:118924431-118924723
  misc_feature 1..292: note = hyper
  source 1..292: mol_type = genomic DNA

SEQ ID NO: 10551 - DNA, 480 bp, Homo sapiens
  misc_feature 1..480: note = chr10:118925062-118925542
  misc_feature 1..480: note = hyper
  source 1..480: mol_type = genomic DNA
ttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagatttttt

SEQ ID NO: 10552 - DNA, 86 bp, Homo sapiens
  misc_feature 1..86: note = chr10:118925816-118925902
  misc_feature 1..86: note = hyper
  source 1..86: mol_type = genomic DNA
gcgttcagagagacacgtttggagctgggactgttcattctttaaggaacaccagcttccagggcatctttcgttggcaccttggc

SEQ ID NO: 10553 - DNA, 537 bp, Homo sapiens; identical to SEQ ID NO: 937
  misc_feature 1..537: note = chr10:118927026-118927563
  misc_feature 1..537: note = hyper
  source 1..537: mol_type = genomic DNA

SEQ ID NO: 10554 - DNA, 30 bp, Homo sapiens
  misc_feature 1..30: note = chr10:118928412-118928442
  misc_feature 1..30: note = hyper
  source 1..30: mol_type = genomic DNA
aaccccgctggcagacgggatggagagaga

SEQ ID NO: 10555 - DNA, 113 bp, Homo sapiens
  misc_feature 1..113: note = chr10:119000479-119000592
  misc_feature 1..113: note = hyper
  source 1..113: mol_type = genomic DNA
gcggggacagggaggcggcagcccctcctgcgcagcgacggcgcgggcgggcggaggccggggcgccccagccccccgcccccgctccctccggccgtgacgtcagagccgga

SEQ ID NO: 10556 - DNA, 21 bp, Homo sapiens
  misc_feature 1..21: note = chr10:119000689-119000710
  misc_feature 1..21: note = hyper
  source 1..21: mol_type = genomic DNA
cgggcacggaggacccgggca

SEQ ID NO: 10557 - DNA, 244 bp, Homo sapiens; identical to SEQ ID NO: 3655
  misc_feature 1..244: note = chr10:119000911-119001155
  misc_feature 1..244: note = hyper
  source 1..244: mol_type = genomic DNA

SEQ ID NO: 10558 - DNA, 200 bp, Homo sapiens; identical to SEQ ID NO: 3656
  misc_feature 1..200: note = chr10:119001328-119001528
  misc_feature 1..200: note = hyper
  source 1..200: mol_type = genomic DNA

SEQ ID NO: 10559 - DNA, 85 bp, Homo sapiens
  misc_feature 1..85: note = chr10:119295037-119295122
  misc_feature 1..85: note = hyper
  source 1..85: mol_type = genomic DNA
tcggctcactggcagcggcgaggccaccgaccaccctccgccttccagtcctaaactcggggctggagaccgcaggagctaaacc

SEQ ID NO: 10560 - DNA, 19 bp, Homo sapiens
  misc_feature 1..19: note = chr10:119296755-119296774
  misc_feature 1..19: note = hyper
  source 1..19: mol_type = genomic DNA
cgggcgtcttcagccagcc

SEQ ID NO: 10561 - DNA, 83 bp, Homo sapiens
  misc_feature 1..83: note = chr10:119297144-119297227
  misc_feature 1..83: note = hyper
  source 1..83: mol_type = genomic DNA
cactggcctggatgacggcctaggcgagactttggcagtgtggcgcgaccccagcgctcccccgccctcgggctcgggggcgc

SEQ ID NO: 10562 - DNA, 183 bp, Homo sapiens; identical to SEQ ID NO: 3657
  misc_feature 1..183: note = chr10:119297461-119297644
  misc_feature 1..183: note = hyper
  source 1..183: mol_type = genomic DNA

SEQ ID NO: 10563 - DNA, 81 bp, Homo sapiens
  misc_feature 1..81: note = chr10:119300926-119301007
  misc_feature 1..81: note = hyper
  source 1..81: mol_type = genomic DNA
tcataattatgccgccgcgcgagccaatggggacgagggaactcggtcctaaaatcatcccaaaaccgaaggcgagctcga

SEQ ID NO: 10564 - DNA, 105 bp, Homo sapiens; identical to SEQ ID NO: 3658
  misc_feature 1..105: note = chr10:119301323-119301428
  misc_feature 1..105: note = hyper
  source 1..105: mol_type = genomic DNA

SEQ ID NO: 10565 - DNA, 99 bp, Homo sapiens
  misc_feature 1..99: note = chr10:119302909-119303008
  misc_feature 1..99: note = hyper
  source 1..99: mol_type = genomic DNA
aaatccgttcctcaacggcttccactcggccgccgccgccgccgccggtaggggcgtctactccaacccggacttggtgttcgccgaggcggtctcgca

SEQ ID NO: 10566 - DNA, 409 bp, Homo sapiens
  misc_feature 1..409: note = chr10:119303312-119303721
  misc_feature 1..409: note = hyper
  source 1..409: mol_type = genomic DNA
tgttgggaaactaggcggcgcggggccgggcgtggtgtcgatccccagtctccgaagctacgactggtttggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatg

SEQ ID NO: 10567 - DNA, 37 bp, Homo sapiens
  misc_feature 1..37: note = chr10:119304504-119304541
  misc_feature 1..37: note = hyper
  source 1..37: mol_type = genomic DNA
ttctcttctagttctcgggagccgggagccccggagc

SEQ ID NO: 10568 - DNA, 90 bp, Homo sapiens
  misc_feature 1..90: note = chr10:119304896-119304986
  misc_feature 1..90: note = hyper
  source 1..90: mol_type = genomic DNA
ggactggctcctctgcgacagcggctggttgggtgccgcaccggtggagacccggcgttccgggccgggcagctgagcaggcgttccctt

SEQ ID NO: 10569 - DNA, 48 bp, Homo sapiens
  misc_feature 1..48: note = chr10:119305061-119305109
  misc_feature 1..48: note = hyper
  source 1..48: mol_type = genomic DNA
gggccagcccggctcgggagaagtgcgcggctccggtcagagcagccc

SEQ ID NO: 10570 - DNA, 50 bp, Homo sapiens
  misc_feature 1..50: note = chr10:119312751-119312801
  misc_feature 1..50: note = hyper
  source 1..50: mol_type = genomic DNA
tattccagcaatcagcgctggaattactggggcgccgcctagaagcaacc

SEQ ID NO: 10571 - DNA, 33 bp, Homo sapiens
  misc_feature 1..33: note = chr10:119494374-119494407
  misc_feature 1..33: note = hyper
  source 1..33: mol_type = genomic DNA
taggaagcctagggtcgccgatgttccaggatg

SEQ ID NO: 10572 - DNA, 15 bp, Homo sapiens
  misc_feature 1..15: note = chr10:119494848-119494863
  misc_feature 1..15: note = hyper
  source 1..15: mol_type = genomic DNA
cgggagaagttcagg

SEQ ID NO: 10573 - DNA, 30 bp, Homo sapiens
  misc_feature 1..30: note = chr10:120354243-120354273
  misc_feature 1..30: note = hyper
  source 1..30: mol_type = genomic DNA
gatgcgccgcctcagcgggtgcaccagcac

SEQ ID NO: 10574 - DNA, 57 bp, Homo sapiens
  misc_feature 1..57: note = chr10:120355557-120355614
  misc_feature 1..57: note = hyper
  source 1..57: mol_type = genomic DNA
gaggcacgactgacccgttcttaaaggctggatcctgcctagcggccaggttgcgga

SEQ ID NO: 10575 - DNA, 85 bp, Homo sapiens
  misc_feature 1..85: note = chr10:121301528-121301613
  misc_feature 1..85: note = hyper
  source 1..85: mol_type = genomic DNA
gtaacgtcagaacttcgctggctcggaccgcagaagtgcccttctccatcctggggttccgccaccctcgcgatcccaccttttg

SEQ ID NO: 10576 - DNA, 112 bp, Homo sapiens
  misc_feature 1..112: note = chr10:122216112-122216224
  misc_feature 1..112: note = hyper
  source 1..112: mol_type = genomic DNA
ctcctgagagcaaagcgaagcccgcgagtgatctctggggaacttcctagaaaaaagaaagaatttcaggttcgaacggtgtagggagggccgaacacgggagcaaggttgg

SEQ ID NO: 10577 - DNA, 232 bp, Homo sapiens
  misc_feature 1..232: note = chr10:122216525-122216757
  misc_feature 1..232: note = hyper
  source 1..232: mol_type = genomic DNA
ctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggc

SEQ ID NO: 10578 - DNA, 42 bp, Homo sapiens
  misc_feature 1..42: note = chr10:122216793-122216835
  misc_feature 1..42: note = hyper
  source 1..42: mol_type = genomic DNA
cgcgggagctgctccggccgcaccatgcgggagctggccatt

SEQ ID NO: 10579 - DNA, 34 bp, Homo sapiens
  misc_feature 1..34: note = chr10:122217317-122217351
  misc_feature 1..34: note = hyper
  source 1..34: mol_type = genomic DNA
tgtccctggctttagcgcccgcggtcctggcgag

SEQ ID NO: 10580 - DNA, 176 bp, Homo sapiens; identical to SEQ ID NO: 938
  misc_feature 1..176: note = chr10:122708495-122708671
  misc_feature 1..176: note = hyper
  source 1..176: mol_type = genomic DNA

SEQ ID NO: 10581 - DNA, 30 bp, Homo sapiens
  misc_feature 1..30: note = chr10:123356872-123356902
  misc_feature 1..30: note = hyper
  source 1..30: mol_type = genomic DNA
gccccaggcgcactgcgctccctccagcgc

SEQ ID NO: 10582 - DNA, 38 bp, Homo sapiens; identical to SEQ ID NO: 939
  misc_feature 1..38: note = chr10:123922645-123922683
  misc_feature 1..38: note = hyper
  source 1..38: mol_type = genomic DNA

SEQ ID NO: 10583 - DNA, 35 bp, Homo sapiens
  misc_feature 1..35: note = chr10:124221715-124221750
  misc_feature 1..35: note = hyper
  source 1..35: mol_type = genomic DNA
caggttgaggggcagcgaagcgttgtggggtggcc

SEQ ID NO: 10584 - DNA, 78 bp, Homo sapiens
  misc_feature 1..78: note = chr10:124893272-124893350
  misc_feature 1..78: note = hyper
  source 1..78: mol_type = genomic DNA
caggctgtgtgcaggcggtgcccacccaaccctcatagacctacgtgcatcgagctatttctgcggttgggggaaaat

SEQ ID NO: 10585 - DNA, 1013 bp, Homo sapiens; identical to SEQ ID NO: 3661
  misc_feature 1..1013: note = chr10:124893594-124894607
  misc_feature 1..1013: note = hyper
  source 1..1013: mol_type = genomic DNA

SEQ ID NO: 10586 - DNA, 52 bp, Homo sapiens; identical to SEQ ID NO: 3662
  misc_feature 1..52: note = chr10:124894870-124894922
  misc_feature 1..52: note = hyper
  source 1..52: mol_type = genomic DNA

SEQ ID NO: 10587 - DNA, 535 bp, Homo sapiens; identical to SEQ ID NO: 940
  misc_feature 1..535: note = chr10:124895161-124895696
  misc_feature 1..535: note = hyper
  source 1..535: mol_type = genomic DNA

SEQ ID NO: 10588 - DNA, 624 bp, Homo sapiens; identical to SEQ ID NO: 941
  misc_feature 1..624: note = chr10:124895832-124896456
  misc_feature 1..624: note = hyper
  source 1..624: mol_type = genomic DNA

SEQ ID NO: 10589 - DNA, 437 bp, Homo sapiens; identical to SEQ ID NO: 3665
  misc_feature 1..437: note = chr10:124897220-124897657
  misc_feature 1..437: note = hyper
  source 1..437: mol_type = genomic DNA

SEQ ID NO: 10590 - DNA, 16 bp, Homo sapiens
  misc_feature 1..16: note = chr10:124897957-124897973
  misc_feature 1..16: note = hyper
  source 1..16: mol_type = genomic DNA
ccggcctagtttattc

SEQ ID NO: 10591 - DNA, 114 bp, Homo sapiens; identical to SEQ ID NO: 3667
  misc_feature 1..114: note = chr10:124899035-124899149
  misc_feature 1..114: note = hyper
  source 1..114: mol_type = genomic DNA

SEQ ID NO: 10592 - DNA, 32 bp, Homo sapiens
  misc_feature 1..32: note = chr10:124899754-124899786
  misc_feature 1..32: note = hyper
  source 1..32: mol_type = genomic DNA
cgctcaccacacccgcgcgctactgggttcca

SEQ ID NO: 10593 - DNA, 113 bp, Homo sapiens; identical to SEQ ID NO: 942
  misc_feature 1..113: note = chr10:124901934-124902047
  misc_feature 1..113: note = hyper
  source 1..113: mol_type = genomic DNA

SEQ ID NO: 10594 - DNA, 431 bp, Homo sapiens; identical to SEQ ID NO: 943
  misc_feature 1..431: note = chr10:124902138-124902569
  misc_feature 1..431: note = hyper
  source 1..431: mol_type = genomic DNA

SEQ ID NO: 10595 - DNA, 214 bp, Homo sapiens; identical to SEQ ID NO: 944
  misc_feature 1..214: note = chr10:124902607-124902821
  misc_feature 1..214: note = hyper
  source 1..214: mol_type = genomic DNA

SEQ ID NO: 10596 - DNA, 267 bp, Homo sapiens; identical to SEQ ID NO: 945
  misc_feature 1..267: note = chr10:124903040-124903307
  misc_feature 1..267: note = hyper
  source 1..267: mol_type = genomic DNA

SEQ ID NO: 10597 - DNA, 244 bp, Homo sapiens; identical to SEQ ID NO: 3672
  misc_feature 1..244: note = chr10:124904921-124905165
  misc_feature 1..244: note = hyper
  source 1..244: mol_type = genomic DNA

SEQ ID NO: 10598 - DNA, 139 bp, Homo sapiens
  misc_feature 1..139: note = chr10:124905925-124906064
  misc_feature 1..139: note = hyper
  source 1..139: mol_type = genomic DNA
ccggcacctgcccctcgctggcctcccgggccgctgcgcgcaccccctggcccccgccccctcgcctgcccctgccccggctgcgcggccgactcctaatcaattagcccattaacgagcccctcgaggagttaagtag

SEQ ID NO: 10599 - DNA, 296 bp, Homo sapiens; identical to SEQ ID NO: 3673
  misc_feature 1..296: note = chr10:124907293-124907589
  misc_feature 1..296: note = hyper
  source 1..296: mol_type = genomic DNA

SEQ ID NO: 10600 - DNA, 316 bp, Homo sapiens; identical to SEQ ID NO: 3674
  misc_feature 1..316: note = chr10:124907979-124908295
  misc_feature 1..316: note = hyper
  source 1..316: mol_type = genomic DNA

SEQ ID NO: 10601 - DNA, 125 bp, Homo sapiens
  misc_feature 1..125: note = chr10:124909252-124909377
  misc_feature 1..125: note = hyper
  source 1..125: mol_type = genomic DNA
ggcgcggccaagaagaagacgcgcaccgtcttttcgcgcagccaggtgtaccagctcgagtccaccttcgacatgaagcgctacctgagcagctcggagcgcgcctgcctcgcctccagcctgca

SEQ ID NO: 10602 - DNA, 148 bp, Homo sapiens
  misc_feature 1..148: note = chr10:124910900-124911048
  misc_feature 1..148: note = hyper
  source 1..148: mol_type = genomic DNA
gatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgca

SEQ ID NO: 10603 - DNA, 145 bp, Homo sapiens
  misc_feature 1..145: note = chr10:125425698-125425843
  misc_feature 1..145: note = hyper
  source 1..145: mol_type = genomic DNA
tgcctgcccgtgaggcggcgcggggctcccgggtggctgcgcgcccagacgcctgcccgggaggccgcctgaggctccggggtggccgcgcgccctcctgggagccatggcggctggggccggtggtcgccgggcggcggcggcg

SEQ ID NO: 10604 - DNA, 112 bp, Homo sapiens; identical to SEQ ID NO: 3675
  misc_feature 1..112: note = chr10:125651051-125651163
  misc_feature 1..112: note = hyper
  source 1..112: mol_type = genomic DNA

SEQ ID NO: 10605 - DNA, 88 bp, Homo sapiens; identical to SEQ ID NO: 3676
  misc_feature 1..88: note = chr10:125651372-125651460
  misc_feature 1..88: note = hyper
  source 1..88: mol_type = genomic DNA

SEQ ID NO: 10606 - DNA, 364 bp, Homo sapiens
  misc_feature 1..364: note = chr10:125851173-125851537
  misc_feature 1..364: note = hyper
  source 1..364: mol_type = genomic DNA
tcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaagacttccctacactgggcgcggacctccagccgccagcagccggcaacccagccccagccttcctcctctatacccgccgtcccagccgcgccggccggccccgggcgcagggcgggcgggaacgtgggcacccggacagcgacggggaggtcaagcagctgtgcccaggacccgggcggctccgaagcctcaacacgcacacactcgcgc

SEQ ID NO: 10607 - DNA, 188 bp, Homo sapiens
  misc_feature 1..188: note = chr10:126135877-126136065
  misc_feature 1..188: note = hyper
  source 1..188: mol_type = genomic DNA
cgcggcgggcaggggtgcgctgacacccgcgcacctgcacccccggtggaggagccgagggcacacgacgatgccaatccctcgtgaatcccgcgaaagaggggccagggggctccggattcatagacgcggggcgtagaagggggtcaggtaggaaggcccaaggaacggcgcgaaagggctcccgg

SEQ ID NO: 10608 - DNA, 145 bp, Homo sapiens
  misc_feature 1..145: note = chr10:126136506-126136651
  misc_feature 1..145: note = hyper
  source 1..145: mol_type = genomic DNA
gggacctcacagggccgcccccgccgtcctcgcagggctccccagacgccaatgccccggccggggcgtcaggtgagcgcgctaggcccggcagcaagcgcgcagcccgctcccgcagccgcggcctcctcggatcctccgcatc

SEQ ID NO: 10609 - DNA, 109 bp, Homo sapiens; identical to SEQ ID NO: 3677
  misc_feature 1..109: note = chr10:126137296-126137405
  misc_feature 1..109: note = hyper
  source 1..109: mol_type = genomic DNA

SEQ ID NO: 10610 - DNA, 36 bp, Homo sapiens
  misc_feature 1..36: note = chr10:126137640-126137676
  misc_feature 1..36: note = hyper
  source 1..36: mol_type = genomic DNA
ccttcatcaggtgtccgccagcgttgggagtaattc

SEQ ID NO: 10611 - DNA, 698 bp, Homo sapiens
  misc_feature 1..698: note = chr10:126138211-126138909
  misc_feature 1..698: note = hyper
  source 1..698: mol_type = genomic DNA
gccactcaccgggcccggctgttcccccatacactccgcattgttggggctgaggcctcctggggccggggccgccttgcatcttaccaggggtctccagctgtcggacagggtccctggagctggcatctttccccgcttcgacctccgccaaacttttcctggcttcccggggagccgggcgcacggcagggagcgctgcgcgggtgaatttctgtgggtccaggatgtccaggacagagaaagaaatcttgtggtgggagggagccgccttggccccgccgtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgcttgcctgggctcggggaagcctccgcgcgcccggtgcgcgcgaccgcggggacagtgttgtcgtctccgcgcgcctccgcccaaccctctgggactctccgagggcgcgagggaggcttccatcccggggatccctcaccccgacacacacacctc

SEQ ID NO: 10612 - DNA, 70 bp, Homo sapiens
  misc_feature 1..70: note = chr10:128075707-128075777
  misc_feature 1..70: note = hyper
  source 1..70: mol_type = genomic DNA
agggaagtcgttcatcggtggaccgacagcgccccgggcggcagaaagaaggcggcggcggcggagaccc

SEQ ID NO: 10613 - DNA, 46 bp, Homo sapiens
  misc_feature 1..46: note = chr10:128075978-128076024
  misc_feature 1..46: note = hyper
  source 1..46: mol_type = genomic DNA
aaggagggagaattccgctaaagtttgcctgcgactgacagctagg

SEQ ID NO: 10614 - DNA, 128 bp, Homo sapiens
  misc_feature 1..128: note = chr10:128076940-128077068
  misc_feature 1..128: note = hyper
  source 1..128: mol_type = genomic DNA
cgttctggcacaagccagccttgaccgttgcaataaatgagcaaactgtccgagttggcccggggactaggaagagcgttagtgagagaaggcaggcctgtgaaatggatccacggccagcagtcacc

SEQ ID NO: 10615 - DNA, 17 bp, Homo sapiens
  misc_feature 1..17: note = chr10:128993505-128993522
  misc_feature 1..17: note = hyper
  source 1..17: mol_type = genomic DNA
cgaccccgggctgcccg

SEQ ID NO: 10616 - DNA, 41 bp, Homo sapiens
  misc_feature 1..41: note = chr10:128993580-128993621
  misc_feature 1..41: note = hyper
  source 1..41: mol_type = genomic DNA
cgttggttggtttcccacgcctgtcccggtctgactcgggc

SEQ ID NO: 10617 - DNA, 219 bp, Homo sapiens; identical to SEQ ID NO: 3678
  misc_feature 1..219: note = chr10:128993945-128994164
  misc_feature 1..219: note = hyper
  source 1..219: mol_type = genomic DNA

SEQ ID NO: 10618 - DNA, 30 bp, Homo sapiens
  misc_feature 1..30: note = chr10:128994727-128994757
  misc_feature 1..30: note = hyper
  source 1..30: mol_type = genomic DNA
gagggaagtcctttccgctgctccaggtcc

SEQ ID NO: 10619 - DNA, 51 bp, Homo sapiens
  misc_feature 1..51: note = chr10:129535122-129535173
  misc_feature 1..51: note = hyper
  source 1..51: mol_type = genomic DNA
ggggccttgaggagtcgtggtacggtccagggcagtcggggctgcggggcc

SEQ ID NO: 10620 - DNA, 38 bp, Homo sapiens
  misc_feature 1..38: note = chr10:129535695-129535733
  misc_feature 1..38: note = hyper
  source 1..38: mol_type = genomic DNA
cgcttcgggtcccgggcctgcgccgccctacgcggccc

SEQ ID NO: 10621 - DNA, 30 bp, Homo sapiens
  misc_feature 1..30: note = chr10:129536272-129536302
  misc_feature 1..30: note = hyper
  source 1..30: mol_type = genomic DNA
ctctcaatctctgtgcgctccttcggagga

SEQ ID NO: 10622 - DNA, 124 bp, Homo sapiens
  misc_feature 1..124: note = chr10:129948016-129948140
  misc_feature 1..124: note = hyper
  source 1..124: mol_type = genomic DNA
accgtcagctgccgccgacggagcccacagaggaggctcgggcgcccgcgccccctgcgcagcggcccctccgcagcggccccagcccgcgtccccgcagcgccccttccgaagcgccccctcc

SEQ ID NO: 10623 - DNA, 116 bp, Homo sapiens
  misc_feature 1..116: note = chr10:130008498-130008614
  misc_feature 1..116: note = hyper
  source 1..116: mol_type = genomic DNA
cacagtaatcagaggcggcctttacaaatagattgcatttgaccttgttggtttgatggacgggagtggagtccggccgcggacggcgtcccttccagggccggccgccagagggc

SEQ ID NO: 10624 - DNA, 61 bp, Homo sapiens
  misc_feature 1..61: note = chr10:130008816-130008877
  misc_feature 1..61: note = hyper
  source 1..61: mol_type = genomic DNA
gagactccacgtccacgtcccgggcagtccctccggaggttgggccgcgcggcccggggag

SEQ ID NO: 10625 - DNA, 73 bp, Homo sapiens
  misc_feature 1..73: note = chr10:130008906-130008979
  misc_feature 1..73: note = hyper
  source 1..73: mol_type = genomic DNA
cggggcctttaggcgcccccgtttcctcgtcagtggggggcgcggtgccgcttctccgcgggctaaactgctg

SEQ ID NO: 10626 - DNA, 146 bp, Homo sapiens; identical to SEQ ID NO: 946
  misc_feature 1..146: note = chr10:130085053-130085199
  misc_feature 1..146: note = hyper
  source 1..146: mol_type = genomic DNA

SEQ ID NO: 10627 - DNA, 76 bp, Homo sapiens; identical to SEQ ID NO: 947
  misc_feature 1..76: note = chr10:130085200-130085276
  misc_feature 1..76: note = hyper
  source 1..76: mol_type = genomic DNA

SEQ ID NO: 10628 - DNA, 54 bp, Homo sapiens; identical to SEQ ID NO: 948
  misc_feature 1..54: note = chr10:130085355-130085409
  misc_feature 1..54: note = hyper
  source 1..54: mol_type = genomic DNA

SEQ ID NO: 10629 - DNA, 98 bp, Homo sapiens
  misc_feature 1..98: note = chr10:130338828-130338926
  misc_feature 1..98: note = hyper
  source 1..98: mol_type = genomic DNA
atgcccgctaggagccggcgccggggcgccccaaggctgcctccccccgcagcgctgcgcagtgcgccctggtgggatggggacgctgcacccctgaa

SEQ ID NO: 10630 - DNA, 30 bp, Homo sapiens
  misc_feature 1..30: note = chr10:130339734-130339764
  misc_feature 1..30: note = hyper
  source 1..30: mol_type = genomic DNA
tgccggggatttcctcgggtgttggggaaa

SEQ ID NO: 10631 - DNA, 157 bp, Homo sapiens
  misc_feature 1..157: note = chr10:131761695-131761852
  misc_feature 1..157: note = hyper
  source 1..157: mol_type = genomic DNA
cgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggc

SEQ ID NO: 10632 - DNA, 79 bp, Homo sapiens
  misc_feature 1..79: note = chr10:131762087-131762166
  misc_feature 1..79: note = hyper
  source 1..79: mol_type = genomic DNA
gcgctcggggcttggcggcaggcggctgccctggccgccctcgccctgctcggcgcctgcggtccggccccgccgccgg

SEQ ID NO: 10633 - DNA, 698 bp, Homo sapiens; identical to SEQ ID NO: 3682
  misc_feature 1..698: note = chr10:131762639-131763337
  misc_feature 1..698: note = hyper
  source 1..698: mol_type = genomic DNA

SEQ ID NO: 10634 - DNA, 780 bp, Homo sapiens; identical to SEQ ID NO: 3683
  misc_feature 1..780: note = chr10:131769496-131770276
  misc_feature 1..780: note = hyper
  source 1..780: mol_type = genomic DNA

SEQ ID NO: 10635 - DNA, 491 bp, Homo sapiens
  misc_feature 1..491: note = chr10:131770603-131771094
  misc_feature 1..491: note = hyper
  source 1..491: mol_type = genomic DNA
tgcttcctgcgttgtcgtccaggcatctaggcgcttcgaccttccccatccctctctccaagggtctggcgtttgtactgggggaagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgcccgcgctcccgtaggcgagaggagcgcacccggctccggggccccggcaacccggcccccagcgttcagtgtccggcccgccacgcgcgaagttcaactttgctgg

SEQ ID NO: 10636 - DNA, 21 bp, Homo sapiens
  misc_feature 1..21: note = chr10:131771281-131771302
  misc_feature 1..21: note = hyper
  source 1..21: mol_type = genomic DNA
gggagagcccacgggcccggc

SEQ ID NO: 10637 - DNA, 15 bp, Homo sapiens
  misc_feature 1..15: note = chr10:133109246-133109261
  misc_feature 1..15: note = hyper
  source 1..15: mol_type = genomic DNA
atggacagtgacccc

SEQ ID NO: 10638 - DNA, 121 bp, Homo sapiens; identical to SEQ ID NO: 3684
  misc_feature 1..121: note = chr10:133110064-133110185
  misc_feature 1..121: note = hyper
  source 1..121: mol_type = genomic DNA

SEQ ID NO: 10639 - DNA, 290 bp, Homo sapiens; identical to SEQ ID NO: 3685
  misc_feature 1..290: note = chr10:133110553-133110843
  misc_feature 1..290: note = hyper
  source 1..290: mol_type = genomic DNA

SEQ ID NO: 10640 - DNA, 347 bp, Homo sapiens
  misc_feature 1..347: note = chr10:133794895-133795242
  misc_feature 1..347: note = hyper
  source 1..347: mol_type = genomic DNA
gaccgcggagggcaacgtggactttgaggctgttcggtccaactgcgagacgcagattcacctccaggtggaattctagctcgcgcggagctggagaatcggggctttcccgtgcggtccgacccgggtccaagccaacccccgcccgagtggcgaggccgcgaaccccgggcagtacgcggggtccccacgccccgggctccgcatgcccgcaggaggggtgggtacggaaggggaggatggcgcagcctcgcccggcccgcgatgccccctaggcctccccggcaacctccccttggcgccctcttggccttccccaggcttcccccccgcgccccctcggctcc

SEQ ID NO: 10641 - DNA, 572 bp, Homo sapiens
  misc_feature 1..572: note = chr10:133795312-133795884
  misc_feature 1..572: note = hyper
  source 1..572: mol_type = genomic DNA
cgccagagggcaactgcggcgatcggagtccgcgccgggctgcgggatgtgcttcagctgcgggcggtgggaaagcggaggtcggagcgccgcggcccagctgcgctcccggactgagcggagccccgcagcccggccggaggaactcacagggcagggcggggccgggcggatctgcggccgcgtcgcccattggccgcgacttggggcctgcgcgtgcgcaggggcgtggggtgcgtgtggcacgtgcggcgcgtgcgcggggcgggtcctgcggtgggcgaggggcagaggcctgcggtgcgcgggacgcgggcggggagaggggcggggcgaggggcgcgcaggcgcgagggcggcagcgaccgcctgaggtgagccggcccgggctggacgccgcgggccgcgtgacgagtgggctgcgcggtcgccgccgcggcgggcggtgggccgggttctcctttgaaggggcggtgggaccggcggactctctgggcactggctaccacggagacgccgctacgcttcggggcggggcccgtctttccatcctgctagtggggaaactgagg

SEQ ID NO: 10642 - DNA, 84 bp, Homo sapiens
  misc_feature 1..84: note = chr10:133795975-133796059
  misc_feature 1..84: note = hyper
  source 1..84: mol_type = genomic DNA
cgcccggggcgggagctgcgagcggtgggccggagctgagcgtctcgggacgggaccgcgtccccgggtctttgcccgccccgc

SEQ ID NO: 10643 - DNA, 222 bp, Homo sapiens
  misc_feature 1..222: note = chr10:133849913-133850135
  misc_feature 1..222: note = hyper
  source 1..222: mol_type = genomic DNA
tgagtccctctaagccggcggcgcccggtgcccggctccctacgcgcgccccgcggcccccgggctattttcagccacgccgagccctgttttaggagcttgcacagcggctccgcggagaccgggactgcgtgggggaggatcgcggcgggggccgtcgccgagcaaggagcgcggccgcggggaccgcccgggagtgggggcggcggggcgggccgggtt

SEQ ID NO: 10644 - DNA, 137 bp, Homo sapiens
  misc_feature 1..137: note = chr10:133850156-133850293
  misc_feature 1..137: note = hyper
  source 1..137: mol_type = genomic DNA
cggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctg

SEQ ID NO: 10645 - DNA, 294 bp, Homo sapiens
  misc_feature 1..294: note = chr10:133850528-133850822
  misc_feature 1..294: note = hyper
  source 1..294: mol_type = genomic DNA
ccagggctggggacccgcatctccgtgtctccgactgtgcctcccgcggaaaggggcgccgtgcgattatttttatgttggtgtctggtttttaaatttcacagcccccatttcagggatggccagcgtggccgtgggatgctgacgatacgggaagccagagaataaaggctttggtggaggtcgggaggaggcgccggcctggacagttttcctagaaaatattctctgcgtgtacccgcgaccttgcctctcgtggaaagccgctgggagttggagcggctccctcctgcc

SEQ ID NO: 10646 - DNA, 127 bp, Homo sapiens
  misc_feature 1..127: note = chr10:134000613-134000740
  misc_feature 1..127: note = hyper
  source 1..127: mol_type = genomic DNA
cggtcccgcttcgcccggcgccccctgcccgccgcccggagtggggcctggacgccgggcggaccctcctggtcttgtgcgtgggtggggggtccctgcctttgcgtctggtccctgtcctggcgcc

SEQ ID NO: 10647 - DNA, 59 bp, Homo sapiens
  misc_feature 1..59: note = chr10:134000798-134000857
  misc_feature 1..59: note = hyper
  source 1..59: mol_type = genomic DNA
cgcagacccccttaaggagcggggcgcccaggcccggcccggcccggccctgcccggcc

SEQ ID NO: 10648 - DNA, 57 bp, Homo sapiens
  misc_feature 1..57: note = chr10:134001139-134001196
  misc_feature 1..57: note = hyper
  source 1..57: mol_type = genomic DNA
cgatttagccccggccgctctggccggagtccctggtggccccgaacccttccagta

SEQ ID NO: 10649 - DNA, 157 bp, Homo sapiens
  misc_feature 1..157: note = chr10:134120760-134120917
  misc_feature 1..157: note = hyper
  source 1..157: mol_type = genomic DNA
aaagcagggctgccacgggcggtgggcggaggcgcgcgcaagcccggagacgccacagccgcgggggaccctcgccccgagggcccgggcccagcctgctcctcctgcggcgccgccactagaaacggaggacgcgggcgggcgcccagaactcgcg

SEQ ID NO: 10650 - DNA, 30 bp, Homo sapiens
  misc_feature 1..30: note = chr10:134122245-134122275
  misc_feature 1..30: note = hyper
  source 1..30: mol_type = genomic DNA
atgcgacaggggcctcggcactcggcgtat

SEQ ID NO: 10651 - DNA, 81 bp, Homo sapiens
  misc_feature 1..81: note = chr10:134599431-134599512
  misc_feature 1..81: note = hyper
  source 1..81: mol_type = genomic DNA
gcccgggcggttagtgtccatgggcgccgccgccgccggcccgggctcccatccgggccccgccgccgccgcccctgcccg

SEQ ID NO: 10652 - DNA, 30 bp, Homo sapiens
  misc_feature 1..30: note = chr10:134599761-134599791
  misc_feature 1..30: note = hyper
  source 1..30: mol_type = genomic DNA
cccgcgcgcccccgccggccgcgcactcca

SEQ ID NO: 10653 - DNA, 253 bp, Homo sapiens
  misc_feature 1..253: note = chr10:134600301-134600554
  misc_feature 1..253: note = hyper
  source 1..253: mol_type = genomic DNA
ggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccg

SEQ ID NO: 10654 - DNA, 160 bp, Homo sapiens
  misc_feature 1..160: note = chr10:134601556-134601716
  misc_feature 1..160: note = hyper
  source 1..160: mol_type = genomic DNA
ccctgggtctgtctgcgccccccggtcctccctgggctgccgagggaacgcgtggggtcgcgggtggggctggcgtgtcactggctgcggagcgcgcggctctccagggctcaggggcgcgggatgaggggccagggtgagttgggggcgcagaggagcc

SEQ ID NO: 10655 - DNA, 30 bp, Homo sapiens
  misc_feature 1..30: note = chr10:134602360-134602390
  misc_feature 1..30: note = hyper
  source 1..30: mol_type = genomic DNA
gcgggggtgtcggcccggaaggagagccgg

SEQ ID NO: 10656 - DNA, 65 bp, Homo sapiens
  misc_feature 1..65: note = chr10:134676528-134676593
  misc_feature 1..65: note = hyper
  source 1..65: mol_type = genomic DNA
gtccctgcaaaacagcggctgcaggaaggagggtggcgaacccacgttcgcgggagtccagcacc

SEQ ID NO: 10657 - DNA, 91 bp, Homo sapiens
  misc_feature 1..91: note = chr10:134901183-134901274
  misc_feature 1..91: note = hyper
  source 1..91: mol_type = genomic DNA
ggaataacacagggtcgtgcagtccgcccggcggcgttttcgggcgagggtctggtgctggggagcgagcgcggagcgaggtgtctcttta

SEQ ID NO: 10658 - DNA, 117 bp, Homo sapiens
  misc_feature 1..117: note = chr10:134902008-134902125
  misc_feature 1..117: note = hyper
  source 1..117: mol_type = genomic DNA
catctgccgctggcgcgttcggtccgagccccccaccggtccccaccggcaccgcctccgccagccccaggcgcagcccccaggccgcccgcggaggggagggagcgacaggggccg

SEQ ID NO: 10659 - DNA, 42 bp, Homo sapiens
  misc_feature 1..42: note = chr10:134974307-134974349
  misc_feature 1..42: note = hyper
  source 1..42: mol_type = genomic DNA
cgcggtagctcctggtggaaaccctggcgggacagtgtgggg

SEQ ID NO: 10660 - DNA, 291 bp, Homo sapiens
  misc_feature 1..291: note = chr10:135043335-135043626
  misc_feature 1..291: note = hyper
  source 1..291: mol_type = genomic DNA
tgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacc

SEQ ID NO: 10661 - DNA, 172 bp, Homo sapiens
  misc_feature 1..172: note = chr10:135043826-135043998
  misc_feature 1..172: note = hyper
  source 1..172: mol_type = genomic DNA
cgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacgga

SEQ ID NO: 10662 - DNA, 120 bp, Homo sapiens; identical to SEQ ID NO: 3686
  misc_feature 1..120: note = chr10:135044554-135044674
  misc_feature 1..120: note = hyper
  source 1..120: mol_type = genomic DNA

SEQ ID NO: 10663 - DNA, 239 bp, Homo sapiens
  misc_feature 1..239: note = chr10:135048918-135049157
  misc_feature 1..239: note = hyper
  source 1..239: mol_type = genomic DNA
tgggggcggtgctgtcggcctgggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggag

SEQ ID NO: 10664 - DNA, 56 bp, Homo sapiens
  misc_feature 1..56: note = chr10:135049727-135049783
  misc_feature 1..56: note = hyper
  source 1..56: mol_type = genomic DNA
aggcatctgggccctcgctgcccctggccgggacacactgccggtcctgtgcagtg

SEQ ID NO: 10665 - DNA, 334 bp, Homo sapiens
  misc_feature 1..334: note = chr10:135050388-135050722
  misc_feature 1..334: note = hyper
  source 1..334: mol_type = genomic DNA
tcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctc

SEQ ID NO: 10666 - DNA, 603 bp, Homo sapiens
  misc_feature 1..603: note = chr10:135138981-135139584
  misc_feature 1..603: note = hyper
  source 1..603: mol_type = genomic DNA
ggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggatgctgcggtggcgctcggggtccatctccg

SEQ ID NO: 10667 - DNA, 100 bp, Homo sapiens
  misc_feature 1..100: note = chr10:135148986-135149086
  misc_feature 1..100: note = hyper
  source 1..100: mol_type = genomic DNA
caacgcagacaggcccgagacgcgtcttcaggaagaaaaagccattgggggcccactggagcctcgcttctggttccgggcccagcgccccgggcggaat

SEQ ID NO: 10668 - DNA, 30 bp, Homo sapiens
  misc_feature 1..30: note = chr11:308110-308140
  misc_feature 1..30: note = hyper
  source 1..30: mol_type = genomic DNA
aaactgttgagaaaacggaactactgggga

SEQ ID NO: 10669 - DNA, 166 bp, Homo sapiens
  misc_feature 1..166: note = chr11:406876-407042
  misc_feature 1..166: note = hyper
  source 1..166: mol_type = genomic DNA
aggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccaccc

SEQ ID NO: 10670 - DNA, 30 bp, Homo sapiens
  misc_feature 1..30: note = chr11:407401-407431
  misc_feature 1..30: note = hyper
  source 1..30: mol_type = genomic DNA
gcacggggtggggcccgggataccagcgcg

SEQ ID NO: 10671 - skipped

SEQ ID NO: 10672 - DNA, 118 bp, Homo sapiens; identical to SEQ ID NO: 3688
  misc_feature 1..118: note = chr11:637349-637467
  misc_feature 1..118: note = hyper
  source 1..118: mol_type = genomic DNA

SEQ ID NO: 10673 - DNA, 150 bp, Homo sapiens
  misc_feature 1..150: note = chr11:726316-726466
  misc_feature 1..150: note = hyper
  source 1..150: mol_type = genomic DNA
catggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagc

SEQ ID NO: 10674 - DNA, 138 bp, Homo sapiens
  misc_feature 1..138: note = chr11:1410132-1410270
  misc_feature 1..138: note = hyper
  source 1..138: mol_type = genomic DNA
cgggaggcgccagggcgctgcggccggatcccaggtgagttccttgactccgcgccgcgcaggtcactgtggcataactgggaaaaccgccgcttctccctcgggagcggaggcggagggccacgtcctccctggggg

SEQ ID NO: 10675 - DNA, 34 bp, Homo sapiens
  misc_feature 1..34: note = chr11:1411655-1411689
  misc_feature 1..34: note = hyper
  source 1..34: mol_type = genomic DNA
gcgctgggtggggggcgcccgagggaggccccgg

SEQ ID NO: 10676 - DNA, 30 bp, Homo sapiens
  misc_feature 1..30: note = chr11:1412279-1412309
  misc_feature 1..30: note = hyper
  source 1..30: mol_type = genomic DNA
gtggagggggcttcccggtggggcctggct

SEQ ID NO: 10677 - DNA, 379 bp, Homo sapiens
  misc_feature 1..379: note = chr11:1770262-1770641
  misc_feature 1..379: note = hyper
  source 1..379: mol_type = genomic DNA
cgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtc

SEQ ID NO: 10678 - DNA, 45 bp, Homo sapiens
  misc_feature 1..45: note = chr11:2291449-2291494
  misc_feature 1..45: note = hyper
  source 1..45: mol_type = genomic DNA
cgccgccggctgcagcgcaacagttccggggacgcgggtctccgc

SEQ ID NO: 10679 - DNA, 48 bp, Homo sapiens
  misc_feature 1..48: note = chr11:2292010-2292058
  misc_feature 1..48: note = hyper
  source 1..48: mol_type = genomic DNA
cacagatccccagtgcgcccaactggcgaaatctgcgagttcccggtg

SEQ ID NO: 10680 - DNA, 255 bp, Homo sapiens
  misc_feature 1..255: note = chr11:2292105-2292360
  misc_feature 1..255: note = hyper
  source 1..255: mol_type = genomic DNA
cgcaggtcctgggttgagccttcccgtacccccaccctaaccccgcgcgcagccccgccagtcccaagagccgccagaccttcgcacgcgcagcgcgcgctgtgggagggaaggcgcggccctggcgacaacacggctgttcgggaggcgcgcaagatccccgggggcagcacgcgccgcgcagcccacacccacgccccaccctcctggggccgaggaggcgggggccagggtctcagccaatcgtgggccacc

SEQ ID NO: 10681 - DNA, 326 bp, Homo sapiens
  misc_feature 1..326: note = chr11:2292391-2292717
  misc_feature 1..326: note = hyper
  source 1..326: mol_type = genomic DNA
cgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtg

SEQ ID NO: 10682 - DNA, 86 bp, Homo sapiens
  misc_feature 1..86: note = chr11:2883674-2883760
  misc_feature 1..86: note = hyper
  source 1..86: mol_type = genomic DNA
ggcgggggccggggtcgggggtccggcgagctttaatgcgcgcacaaagcctcatttgcaggtcaatgccgcggcacactcgcctc

SEQ ID NO: 10683 - DNA, 156 bp, Homo sapiens
  misc_feature 1..156: note = chr11:6280445-6280601
  misc_feature 1..156: note = hyper
  source 1..156: mol_type = genomic DNA
gagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctc

SEQ ID NO: 10684 - DNA, 51 bp, Homo sapiens
  misc_feature 1..51: note = chr11:6281269-6281320
  misc_feature 1..51: note = hyper
  source 1..51: mol_type = genomic DNA
agctgcgagccccctcgcattcgcggagccgggacacgaggtgggtgcctc

SEQ ID NO: 10685 - DNA, 104 bp, Homo sapiens
  misc_feature 1..104: note = chr11:6676726-6676830
  misc_feature 1..104: note = hyper
  source 1..104: mol_type = genomic DNA
cagcccaggggaggccggcgggcagggcgggcgcggccagacgggccgggcgggcgcgggcactgacctccgcgcgacgcgggctccctcgcccggtgctgggg

SEQ ID NO: 10686 - DNA, 84 bp, Homo sapiens
  misc_feature 1..84: note = chr11:6677244-6677328
  misc_feature 1..84: note = hyper
  source 1..84: mol_type = genomic DNA
gccgcgccgcgcccccgtcccggttcccttcccttctccccgtcacttctcccgtcctctcctcccattcggttctctacgccc

SEQ ID NO: 10687 - DNA, 614 bp, Homo sapiens
  misc_feature 1..614: note = chr11:6947606-6948220
  misc_feature 1..614: note = hyper
  source 1..614: mol_type = genomic DNA
gttccaagtgtgcggcgtgggcggggcctgcagaaagggacggggcctgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacgggtatcgttctcgtcagcgggcggtggggacgcggggtcttggaattgggaatcacgcttgagggcgtccatgcggaacgtgcagcttacctcagcttgcttgcagttacccagtttccacgctgccctccaaggtctgtgccggaaaacctggaggagggcgcgagctgacgggagggatggaaacgtgggctgcggaagtaagacaagcgttgagagcagcgacagagggcgagggggtgggcggcgggacggctggggt

SEQ ID NO: 10688 - DNA, 30 bp, Homo sapiens
  misc_feature 1..30: note = chr11:7273118-7273148
  misc_feature 1..30: note = hyper
  source 1..30: mol_type = genomic DNA
gcgcaagcagagaggcgctctgggctgtgc

SEQ ID NO: 10689 - DNA, 33 bp, Homo sapiens
  misc_feature 1..33: note = chr11:7274215-7274248
  misc_feature 1..33: note = hyper
  source 1..33: mol_type = genomic DNA
tggggttcgtagactcgtcggtcctggcttgtg

SEQ ID NO: 10690 - DNA, 38 bp, Homo sapiens
  misc_feature 1..38: note = chr11:8040298-8040336
  misc_feature 1..38: note = hyper
  source 1..38: mol_type = genomic DNA
ctggggaagaagggacggggagacggcgggaatctagg

SEQ ID NO: 10691 - DNA, 77 bp, Homo sapiens
  misc_feature 1..77: note = chr11:8040699-8040776
  misc_feature 1..77: note = hyper
  source 1..77: mol_type = genomic DNA
cgccattggcagagccggagggggtcaccccccggggggcgaatggtacagtcctccgcccgcgcctcggccgggcc

SEQ ID NO: 10692 - DNA, 67 bp, Homo sapiens
  misc_feature 1..67: note = chr11:8041504-8041571
  misc_feature 1..67: note = hyper
  source 1..67: mol_type = genomic DNA
atggcgagcggctgccggcgtgggcggtttggagctgcgctccccacgcactcgtcctggaggaagg

SEQ ID NO: 10693 - DNA, 344 bp, Homo sapiens
  misc_feature 1..344: note = chr11:8102616-8102960
  misc_feature 1..344: note = hyper
  source 1..344: mol_type = genomic DNA
gcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatg

SEQ ID NO: 10694 - DNA, 794 bp, Homo sapiens; identical to SEQ ID NO: 3689
  misc_feature 1..794: note = chr11:8189946-8190740
  misc_feature 1..794: note = hyper
  source 1..794: mol_type = genomic DNA

SEQ ID NO: 10695 - DNA, 35 bp, Homo sapiens
  misc_feature 1..35: note = chr11:8284256-8284291
  misc_feature 1..35: note = hyper
  source 1..35: mol_type = genomic DNA
gagacagggagctagcgggccggcacaagaggcgg

SEQ ID NO: 10696 - DNA, 41 bp, Homo sapiens
  misc_feature 1..41: note = chr11:8284611-8284652
  misc_feature 1..41: note = hyper
  source 1..41: mol_type = genomic DNA
cagtgcacagctcctcggctcgcggccgggacccggggggc

SEQ ID NO: 10697 - DNA, 39 bp, Homo sapiens
  misc_feature 1..39: note = chr11:8284896-8284935
  misc_feature 1..39: note = hyper
  source 1..39: mol_type = genomic DNA
ccagcaccatcatctcgggcgctccgtgtccagccgcag

SEQ ID NO: 10698 - DNA, 245 bp, Homo sapiens
  misc_feature 1..245: note = chr11:8289527-8289772
  misc_feature 1..245: note = hyper
  source 1..245: mol_type = genomic DNA
caccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgct

SEQ ID NO: 10699 - DNA, 201 bp, Homo sapiens
  misc_feature 1..201: note = chr11:8290057-8290258
  misc_feature 1..201: note = hyper
  source 1..201: mol_type = genomic DNA
cgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcc

SEQ ID NO: 10700 - DNA, 30 bp, Homo sapiens
  misc_feature 1..30: note = chr11:8615288-8615318
  misc_feature 1..30: note = hyper
  source 1..30: mol_type = genomic DNA
accccacagtaagttcgcttctaaactttc

SEQ ID NO: 10701 - DNA, 1027 bp, Homo sapiens
  misc_feature 1..1027: note = chr11:9025080-9026107
  misc_feature 1..1027: note = hyper
  source 1..1027: mol_type = genomic DNA
gggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccacc

SEQ ID NO: 10702 - DNA, 140 bp, Homo sapiens; identical to SEQ ID NO: 3690
  misc_feature 1..140: note = chr11:9112446-9112586
  misc_feature 1..140: note = hyper
  source 1..140: mol_type = genomic DNA

SEQ ID NO: 10703 - DNA, 307 bp, Homo sapiens; identical to SEQ ID NO: 3691
  misc_feature 1..307: note = chr11:9112639-9112946
  misc_feature 1..307: note = hyper
  source 1..307: mol_type = genomic DNA

SEQ ID NO: 10704 - DNA, 341 bp, Homo sapiens
  misc_feature 1..341: note = chr11:12029931-12030272
  misc_feature 1..341: note = hyper
  source 1..341: mol_type = genomic DNA
gcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgccc

SEQ ID NO: 10705 - DNA, 194 bp, Homo sapiens
  misc_feature 1..194: note = chr11:12030273-12030467
  misc_feature 1..194: note = hyper
  source 1..194: mol_type = genomic DNA
gagacgggaggaaaccgaggcccctgaaaacgcagctcccctacacccgaaaagacgcgaccccacccgctccagcccgagccccgatcgccccaggaccccgcacccccatcctcgagcacaagctgagctctgctcctcacctgtgatgctggagccctcgccagagcaaccgaacccggatcctctacgct

SEQ ID NO: 10706 - DNA, 61 bp, Homo sapiens
  misc_feature 1..61: note = chr11:13031258-13031319
  misc_feature 1..61: note = hyper
  source 1..61: mol_type = genomic DNA
cagcggcggagccggcggctggggtcggccggcgacccgcatggcccgggagagctgcccg

SEQ ID NO: 10707 - DNA, 326 bp, Homo sapiens; identical to SEQ ID NO: 3692
  misc_feature 1..326: note = chr11:15136101-15136427
  misc_feature 1..326: note = hyper
  source 1..326: mol_type = genomic DNA

SEQ ID NO: 10708 - DNA, 59 bp, Homo sapiens
  misc_feature 1..59: note = chr11:16626111-16626170
  misc_feature 1..59: note = hyper
  source 1..59: mol_type = genomic DNA
ccattgacagtacagcgggaggtccggagcccagcccagtttgccgcaaggacggcttc

SEQ ID NO: 10709 - DNA, 70 bp, Homo sapiens; identical to SEQ ID NO: 3693
  misc_feature 1..70: note = chr11:16632513-16632583
  misc_feature 1..70: note = hyper
  source 1..70: mol_type = genomic DNA

SEQ ID NO: 10710 - DNA, 53 bp, Homo sapiens
  misc_feature 1..53: note = chr11:16634305-16634358
  misc_feature 1..53: note = hyper
  source 1..53: mol_type = genomic DNA
tcccctctaatgagacgcggatcaccctccactctcaccgacactgcagctct

SEQ ID NO: 10711 - DNA, 29 bp, Homo sapiens
  misc_feature 1..29: note = chr11:17497492-17497521
  misc_feature 1..29: note = hyper
  source 1..29: mol_type = genomic DNA
ctttgcaagcaagggcgccggggtcgctg

SEQ ID NO: 10712 - DNA, 116 bp, Homo sapiens; identical to SEQ ID NO: 3695
  misc_feature 1..116: note = chr11:17497545-17497661
  misc_feature 1..116: note = hyper
  source 1..116: mol_type = genomic DNA

SEQ ID NO: 10713 - DNA, 143 bp, Homo sapiens
  misc_feature 1..143: note = chr11:17498038-17498181
  misc_feature 1..143: note = hyper
  source 1..143: mol_type = genomic DNA
cagggcaggggaccccgggaacgaggcggacggcggtcgcgggccggaaggggacgccgagcggtgcggcgcgcagcgcctcctcctccctccctgctctcccgtcccctcctccgcggctcgctgcgcgcactcaccaatga

SEQ ID NO: 10714 - DNA, 49 bp, Homo sapiens
  misc_feature 1..49: note = chr11:17717486-17717535
  misc_feature 1..49: note = hyper
  source 1..49: mol_type = genomic DNA
ggggaggcgcgtggccggccgcccccagctgtggcgtcgttcaggcccg

SEQ ID NO: 10715 - DNA, 156 bp, Homo sapiens
  misc_feature 1..156: note = chr11:17740414-17740570
  misc_feature 1..156: note = hyper
  source 1..156: mol_type = genomic DNA
agctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcac

SEQ ID NO: 10716 - DNA, 39 bp, Homo sapiens
  misc_feature 1..39: note = chr11:17741123-17741162
  misc_feature 1..39: note = hyper
  source 1..39: mol_type = genomic DNA
gaggaagccctggggcgctgccgccgctttccttaacca

SEQ ID NO: 10717 - DNA, 84 bp, Homo sapiens; identical to SEQ ID NO: 949
  misc_feature 1..84: note = chr11:17741806-17741890
  misc_feature 1..84: note = hyper
  source 1..84: mol_type = genomic DNA

SEQ ID NO: 10718 - DNA, 135 bp, Homo sapiens; identical to SEQ ID NO: 950
  misc_feature 1..135: note = chr11:17741952-17742087
  misc_feature 1..135: note = hyper
  source 1..135: mol_type = genomic DNA

SEQ ID NO: 10719 - DNA, 84 bp, Homo sapiens
  misc_feature 1..84: note = chr11:17742361-17742445
  misc_feature 1..84: note = hyper
  source 1..84: mol_type = genomic DNA
gagttagggagggggcggctacaggaattggtgttcgggcctcgagccgtcccgcgggcctgactcagtcgcccttgctgtttg

SEQ ID NO: 10720 - DNA, 33 bp, Homo sapiens
  misc_feature 1..33: note = chr11:17743742-17743775
  misc_feature 1..33: note = hyper
  source 1..33: mol_type = genomic DNA
ccagctgtccctcagcgacgcctgtaggcggca

SEQ ID NO: 10721 - DNA, 72 bp, Homo sapiens
  misc_feature 1..72: note = chr11:17756900-17756972
  misc_feature 1..72: note = hyper
  source 1..72: mol_type = genomic DNA
ccggagcccgccctgcgtcccgagctgcagcccggccacgcagggaggaaggcaggcggcatccatctcccc

SEQ ID NO: 10722 - DNA, 15 bp, Homo sapiens
  misc_feature 1..15: note = chr11:17756993-17757008
  misc_feature 1..15: note = hyper
  source 1..15: mol_type = genomic DNA
cgaccacctcacaga

SEQ ID NO: 10723 - DNA, 53 bp, Homo sapiens
  misc_feature 1..53: note = chr11:17757704-17757757
  misc_feature 1..53: note = hyper
  source 1..53: mol_type = genomic DNA
tgacgagttcttcttcgaccgccaccccggcgtcttcgcgcacatcctgaact

SEQ ID NO: 10724 - DNA, 306 bp, Homo sapiens
  misc_feature 1..306: note = chr11:18742729-18743035
  misc_feature 1..306: note = hyper
  source 1..306: mol_type = genomic DNA
cgccctccatggctacgcccaccgtcttggtcccgcgttccttttggctcactcgccttgtggacacgccccttcgcttccattgcgtcccgccccgccacgttctggctctgcccctgctctgctctgccccgggggtactttgggtcctctgctcattccggcaatatcccggttcctgactcggcctctcttatcctgccgcgcctctcgggcaatgacagctgcttttcccactgcccggctctcgggccgccgttaaggctctcatcggtgagaagactggcggcccgccctgggggtccc

SEQ ID NO: 10725 - DNA, 96 bp, Homo sapiens
  misc_feature 1..96: note = chr11:18812557-18812653
  misc_feature 1..96: note = hyper
  source 1..96: mol_type = genomic DNA
gctgggggaggggagcgcgctaagcttgtattctaggggagggtgggacgcgggaggctaaagctaaagggtcggtggaggcgaagcaatgggaag

SEQ ID NO: 10726 - DNA, 272 bp, Homo sapiens
  misc_feature 1..272: note = chr11:18812894-18813166
  misc_feature 1..272: note = hyper
  source 1..272: mol_type = genomic DNA
ccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgctt

SEQ ID NO: 10727 - DNA, 132 bp, Homo sapiens
  misc_feature 1..132: note = chr11:18813376-18813508
  misc_feature 1..132: note = hyper
  source 1..132: mol_type = genomic DNA
ccccagccccggctccgccccgcccccgggcgggcttccgccgctcgccgggaattgcgcagggctggcggggcgggggaccgggagagcggcctgctcccggggcacgaagggggccggatcacagaccct

SEQ ID NO: 10728 - DNA, 224 bp, Homo sapiens; identical to SEQ ID NO: 3698
  misc_feature 1..224: note = chr11:18813811-18814035
  misc_feature 1..224: note = hyper
  source 1..224: mol_type = genomic DNA

SEQ ID NO: 10729 - DNA, 62 bp, Homo sapiens
  misc_feature 1..62: note = chr11:19366698-19366760
  misc_feature 1..62: note = hyper
  source 1..62: mol_type = genomic DNA
gcactggttggctggcgggagggaggaggaggcggtttcccgggtaacgggagggcaaggag

SEQ ID NO: 10730 - DNA, 157 bp, Homo sapiens
  misc_feature 1..157: note = chr11:19366978-19367135
  misc_feature 1..157: note = hyper
  source 1..157: mol_type = genomic DNA
ctctgtgctgagctccggggtccagagcagggtggggactgccgttggggagagggccggcccctcattgagaggctcgggggccacacctctgctgcgggactctgaccgagggccagggcctctcaagccacccggccgcagcatagataccggg

SEQ ID NO: 10731 - DNA, 92 bp, Homo sapiens
  misc_feature 1..92: note = chr11:19367267-19367359
  misc_feature 1..92: note = hyper
  source 1..92: mol_type = genomic DNA
cgggggcgcactttcccggcctccagcgacactgcgcacgcccctatccggagtgggtgtgtgtccctctgggcgtacgtgcctgaggctgt

SEQ ID NO: 10732 - DNA, 39 bp, Homo sapiens
  misc_feature 1..39: note = chr11:19367898-19367937
  misc_feature 1..39: note = hyper
  source 1..39: mol_type = genomic DNA
ggatccgagccaagccgggggcaactaggccaggcctgc

SEQ ID NO: 10733 - DNA, 39 bp, Homo sapiens
  misc_feature 1..39: note = chr11:19367938-19367977
  misc_feature 1..39: note = hyper
  source 1..39: mol_type = genomic DNA
gttcccctggctctcgctctcccacgctccggttagctg

SEQ ID NO: 10734 - DNA, 30 bp, Homo sapiens
  misc_feature 1..30: note = chr11:19735404-19735434
  misc_feature 1..30: note = hyper
  source 1..30: mol_type = genomic DNA
agatccccctgaaatcgcaggtgctgcagg

SEQ ID NO: 10735 - DNA, 192 bp, Homo sapiens
  misc_feature 1..192: note = chr11:20153699-20153891
  misc_feature 1..192: note = hyper
  source 1..192: mol_type = genomic DNA
ccgcccatccacattcggcctggcaccgatcctgcggaatctctccccaacgcacggtttctacactggaacgattgaaactaagggggtgcgccaactcccccaccttcgcgggtcccctggcaggagacctggtccttgccttaccgcagtaggtgtggctgtgactgaagggagcggcatccctgagca

SEQ ID NO: 10736 - DNA, 73 bp, Homo sapiens
  misc_feature 1..73: note = chr11:20177730-20177803
  misc_feature 1..73: note = hyper
  source 1..73: mol_type = genomic DNA
aaaatagtactctggcgtgcgagcggcttctaggacacggtgatttcctcctgttcctcgccctcctcttcct

SEQ ID NO: 10737 - DNA, 385 bp, Homo sapiens; identical to SEQ ID NO: 3699
  misc_feature 1..385: note = chr11:20178093-20178478
  misc_feature 1..385: note = hyper
  source 1..385: mol_type = genomic DNA

SEQ ID NO: 10738 - DNA, 200 bp, Homo sapiens
  misc_feature 1..200: note = chr11:20178700-20178900
  misc_feature 1..200: note = hyper
  source 1..200: mol_type = genomic DNA
cgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctcc

SEQ ID NO: 10739 - DNA, 63 bp, Homo sapiens
  misc_feature 1..63: note = chr11:20180763-20180826
  misc_feature 1..63: note = hyper
  source 1..63: mol_type = genomic DNA
gctgaaaagacccttcgaagtagggaaaggcgaaggtcttgggagggacgctctggagcaagg

SEQ ID NO: 10740 - DNA, 101 bp, Homo sapiens; identical to SEQ ID NO: 3700
  misc_feature 1..101: note = chr11:20181185-20181286
  misc_feature 1..101: note = hyper
  source 1..101: mol_type = genomic DNA

SEQ ID NO: 10741 - DNA, 98 bp, Homo sapiens
  misc_feature 1..98: note = chr11:20181895-20181993
  misc_feature 1..98: note = hyper
  source 1..98: mol_type = genomic DNA
ccttctttcagtggccggagggtaaacgcctcgcttcccgcccctcccgcccccacagtgtcctctctcttgggcttagcaaacgtctccaagtaaca

SEQ ID NO: 10742 - DNA, 34 bp, Homo sapiens
  misc_feature 1..34: note = chr11:20182878-20182912
  misc_feature 1..34: note = hyper
  source 1..34: mol_type = genomic DNA
gcggcgctgggctgccgagcggcaggattccgct

SEQ ID NO: 10743 - DNA, 30 bp, Homo sapiens
  misc_feature 1..30: note = chr11:20183391-20183421
  misc_feature 1..30: note = hyper
  source 1..30: mol_type = genomic DNA
agaagtgtgcagccccgccaggccgccctg

SEQ ID NO: 10744 - DNA, 80 bp, Homo sapiens; identical to SEQ ID NO: 3701
  misc_feature 1..80: note = chr11:20183674-20183754
  misc_feature 1..80: note = hyper
  source 1..80: mol_type = genomic DNA

SEQ ID NO: 10745 - DNA, 32 bp, Homo sapiens
  misc_feature 1..32: note = chr11:20184112-20184144
  misc_feature 1..32: note = hyper
  source 1..32: mol_type = genomic DNA
cagttcccagaaggacgcgccgggggcttcag

SEQ ID NO: 10746 - DNA, 190 bp, Homo sapiens; identical to SEQ ID NO: 3702
  misc_feature 1..190: note = chr11:20184500-20184690
  misc_feature 1..190: note = hyper
  source 1..190: mol_type = genomic DNA

SEQ ID NO: 10747 - DNA, 531 bp, Homo sapiens; identical to SEQ ID NO: 3703
  misc_feature 1..531: note = chr11:20184899-20185430
  misc_feature 1..531: note = hyper
  source 1..531: mol_type = genomic DNA

SEQ ID NO: 10748 - DNA, 344 bp, Homo sapiens; identical to SEQ ID NO: 951
  misc_feature 1..344: note = chr11:20229223-20229567
  misc_feature 1..344: note = hyper
  source 1..344: mol_type = genomic DNA

SEQ ID NO: 10749 - DNA, 39 bp, Homo sapiens
  misc_feature 1..39: note = chr11:20230466-20230505
  misc_feature 1..39: note = hyper
  source 1..39: mol_type = genomic DNA
ttgctgcttttgagccggttgcttcgggccggcagccct

SEQ ID NO: 10750 - DNA, 30 bp, Homo sapiens; identical to SEQ ID NO: 952
  misc_feature 1..30: note = chr11:20618363-20618393
  misc_feature 1..30: note = hyper
  source 1..30: mol_type = genomic DNA

SEQ ID NO: 10751 - DNA, 503 bp, Homo sapiens; identical to SEQ ID NO: 953
  misc_feature 1..503: note = chr11:20618422-20618925
  misc_feature 1..503: note = hyper
  source 1..503: mol_type = genomic DNA

SEQ ID NO: 10752 - DNA, 567 bp, Homo sapiens
  misc_feature 1..567: note = chr11:20619407-20619974
  misc_feature 1..567: note = hyper
  source 1..567: mol_type = genomic DNA
agcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccctttagaggggctaggcgggaaagccaaccagcggaggcatccaaacactctcgggctctccagaggagcaggagggtgccccttagtgcccccggcgcccgccgcaatctgccactgcagcctacgcctgcggccgcggccgccgcggcattgtcctcccgccgcgtgggacggcccagccgctggcgacggcgcgcaccccgaggcagtgggctgggctgttggcagtagggaagggaaaacgtgctgtctgtggc

SEQ ID NO: 10753 - DNA, 50 bp, Homo sapiens; identical to SEQ ID NO: 3707
  misc_feature 1..50: note = chr11:20621603-20621653
  misc_feature 1..50: note = hyper
  source 1..50: mol_type = genomic DNA

SEQ ID NO: 10754 - DNA, 101 bp, Homo sapiens; identical to SEQ ID NO: 954
  misc_feature 1..101: note = chr11:20623258-20623359
  misc_feature 1..101: note = hyper
  source 1..101: mol_type = genomic DNA

SEQ ID NO: 10755 - DNA, 182 bp, Homo sapiens
  misc_feature 1..182: note = chr11:20690653-20690835
  misc_feature 1..182: note = hyper
  source 1..182: mol_type = genomic DNA
ggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcg

SEQ ID NO: 10756 - DNA, 26 bp, Homo sapiens
  misc_feature 1..26: note = chr11:20691060-20691086
  misc_feature 1..26: note = hyper
  source 1..26: mol_type = genomic DNA
gccagcggtggggggcgggctggggg

SEQ ID NO: 10757 - DNA, 40 bp, Homo sapiens; identical to SEQ ID NO: 956
  misc_feature 1..40: note = chr11:20691121-20691161
  misc_feature 1..40: note = hyper
  source 1..40: mol_type = genomic DNA

SEQ ID NO: 10758 - DNA, 218 bp, Homo sapiens; identical to SEQ ID NO: 957
  misc_feature 1..218: note = chr11:20691162-20691380
  misc_feature 1..218: note = hyper
  source 1..218: mol_type = genomic DNA

SEQ ID NO: 10759 - DNA, 185 bp, Homo sapiens; identical to SEQ ID NO: 958
  misc_feature 1..185: note = chr11:20691431-20691616
  misc_feature 1..185: note = hyper
  source 1..185: mol_type = genomic DNA

SEQ ID NO: 10760 - DNA, 90 bp, Homo sapiens; identical to SEQ ID NO: 959
  misc_feature 1..90: note = chr11:20691747-20691837
  misc_feature 1..90: note = hyper
  source 1..90: mol_type = genomic DNA

SEQ ID NO: 10761 - DNA, 36 bp, Homo sapiens
  misc_feature 1..36: note = chr11:20692310-20692346
  misc_feature 1..36: note = hyper
  source 1..36: mol_type = genomic DNA
tacccagccatcctccgtacgcgctgcaccccagaa

SEQ ID NO: 10762 - DNA, 30 bp, Homo sapiens
  misc_feature 1..30: note = chr11:20692851-20692881
  misc_feature 1..30: note = hyper
  source 1..30: mol_type = genomic DNA
gctactggctctgagcgcgagagtctggtg

SEQ ID NO: 10763 - DNA, 386 bp, Homo sapiens
  misc_feature 1..386: note = chr11:22214443-22214829
  misc_feature 1..386: note = hyper
  source 1..386: mol_type = genomic DNA
gcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaagg

SEQ ID NO: 10764 - DNA, 105 bp, Homo sapiens; identical to SEQ ID NO: 3714
  misc_feature 1..105: note = chr11:22215182-22215287
  misc_feature 1..105: note = hyper
  source 1..105: mol_type = genomic DNA

SEQ ID NO: 10765 - DNA, 15 bp, Homo sapiens
  misc_feature 1..15: note = chr11:22359403-22359418
  misc_feature 1..15: note = hyper
  source 1..15: mol_type = genomic DNA
tcttttatttactca

SEQ ID NO: 10766 - DNA, 105 bp, Homo sapiens
  misc_feature 1..105: note = chr11:22359777-22359882
  misc_feature 1..105: note = hyper
  source 1..105: mol_type = genomic DNA
ccgtggcactgcttgcgctctttgccaccggatcctccccttccaatgagactttctgattgtgtctaccaactctcctattaggaaacccgtgggttgcatgca

SEQ ID NO: 10767 - DNA, 355 bp, Homo sapiens
  misc_feature 1..355: note = chr11:22362533-22362888
  misc_feature 1..355: note = hyper
  source 1..355: mol_type = genomic DNA
tcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacct

SEQ ID NO: 10768 - DNA, 215 bp, Homo sapiens
  misc_feature 1..215: note = chr11:22364821-22365036
  misc_feature 1..215: note = hyper
  source 1..215: mol_type = genomic DNA
cgtggggatgatccacggttccttcttttggggctacatcatcactcagattccgggaggctacatcgcgtctcggctggcagccaacaggtaatgcgccaggcgggactggggctcggggcgtggtgtttgtttcctccgaaggggcagcagaagctggagcagagacaacagcccagaggggtttgaggactcccgggcgaagtcttctagtc

SEQ ID NO: 10769 - DNA, 140 bp, Homo sapiens; identical to SEQ ID NO: 3715
  misc_feature 1..140: note = chr11:22365407-22365547
  misc_feature 1..140: note = hyper
  source 1..140: mol_type = genomic DNA

SEQ ID NO: 10770 - DNA, 30 bp, Homo sapiens
  misc_feature 1..30: note = chr11:22688349-22688379
  misc_feature 1..30: note = hyper
  source 1..30: mol_type = genomic DNA
gtgcctggagggggccggccccgagaagct

SEQ ID NO: 10771 - DNA, 197 bp, Homo sapiens; identical to SEQ ID NO: 960
  misc_feature 1..197: note = chr11:27743436-27743633
  misc_feature 1..197: note = hyper
  source 1..197: mol_type = genomic DNA

SEQ ID NO: 10772 - DNA, 443 bp, Homo sapiens
  misc_feature 1..443: note = chr11:27743897-27744340
  misc_feature 1..443: note = hyper
  source 1..443: mol_type = genomic DNA
gtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtg

SEQ ID NO: 10773 - DNA, 71 bp, Homo sapiens
  misc_feature 1..71: note = chr11:27744656-27744727
  misc_feature 1..71: note = hyper
  source 1..71: mol_type = genomic DNA
tgttatggagatgtccgtcgctctgaggagcgctagtgccctgggaagtccccagacgcatttcaggtttc

SEQ ID NO: 10774 - DNA, 15 bp, Homo sapiens
  misc_feature 1..15: note = chr11:30037737-30037752
  misc_feature 1..15: note = hyper
  source 1..15: mol_type = genomic DNA
ccaaaagaagggaac

SEQ ID NO: 10775 - DNA, 195 bp, Homo sapiens
  misc_feature 1..195: note = chr11:30038294-30038489
  misc_feature 1..195: note = hyper
  source 1..195: mol_type = genomic DNA
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaag

SEQ ID NO: 10776 - DNA, 37 bp, Homo sapiens
  misc_feature 1..37: note = chr11:30038919-30038956
  misc_feature 1..37: note = hyper
  source 1..37: mol_type = genomic DNA
ctctatatctcccctcgagccccgagccccgtcttct

SEQ ID NO: 10777 - DNA, 71 bp, Homo sapiens
  misc_feature 1..71: note = chr11:30040131-30040202
  misc_feature 1..71: note = hyper
  source 1..71: mol_type = genomic DNA
ataaccagaagcccacgtggcgacggggtctccctagacacctctcccagctcgcccgatggaccaagcag

SEQ ID NO: 10778 - DNA, 34 bp, Homo sapiens
  misc_feature 1..34: note = chr11:30605841-30605875
  misc_feature 1..34: note = hyper
  source 1..34: mol_type = genomic DNA
ggtggtgggcagttgcgcgaggcggggtgggggg

SEQ ID NO: 10779 - DNA, 91 bp, Homo sapiens
  misc_feature 1..91: note = chr11:30605935-30606026
  misc_feature 1..91: note = hyper
  source 1..91: mol_type = genomic DNA
gccctgcccttctaggctcacggctggctcttcccggctacaacttccccttccttcctgaaacaccagcgccttactcgctcagtccccc

SEQ ID NO: 10780 - skipped

SEQ ID NO: 10781 - DNA, 30 bp, Homo sapiens
  misc_feature 1..30: note = chr11:30606351-30606381
  misc_feature 1..30: note = hyper
  source 1..30: mol_type = genomic DNA
aagggagggagccagcgagcgttggaaggg

SEQ ID NO: 10782 - DNA, 15 bp, Homo sapiens
  misc_feature 1..15: note = chr11:30606740-30606755
  misc_feature 1..15: note = hyper
  source 1..15: mol_type = genomic DNA
tgtagagaagaaatc

SEQ ID NO: 10783 - DNA, 292 bp, Homo sapiens; identical to SEQ ID NO: 3718
  misc_feature 1..292: note = chr11:30606795-30607087
  misc_feature 1..292: note = hyper
  source 1..292: mol_type = genomic DNA

SEQ ID NO: 10784 - DNA, 363 bp, Homo sapiens
  misc_feature 1..363: note = chr11:30607367-30607730
  misc_feature 1..363: note = hyper
  source 1..363: mol_type = genomic DNA
gaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttc

SEQ ID NO: 10785 - DNA, 55 bp, Homo sapiens
  misc_feature 1..55: note = chr11:31818458-31818513
  misc_feature 1..55: note = hyper
  source 1..55: mol_type = genomic DNA
ctccgctcacgtgtgcgggcacaagcgtctgtgctaatttactgccccaagtttc

SEQ ID NO: 10786 - DNA, 1042 bp, Homo sapiens; identical to SEQ ID NO: 961
  misc_feature 1..1042: note = chr11:31819319-31820361
  misc_feature 1..1042: note = hyper
  source 1..1042: mol_type = genomic DNA

SEQ ID NO: 10787 - DNA, 565 bp, Homo sapiens; identical to SEQ ID NO: 962
  misc_feature 1..565: note = chr11:31820460-31821025
  misc_feature 1..565: note = hyper
  source 1..565: mol_type = genomic DNA

SEQ ID NO: 10788 - DNA, 36 bp, Homo sapiens
  misc_feature 1..36: note = chr11:31821352-31821388
  misc_feature 1..36: note = hyper
  source 1..36: mol_type = genomic DNA
cacgtcccattatcccgcatattatctccttgtcac

SEQ ID NO: 10789 - DNA, 143 bp, Homo sapiens
  misc_feature 1..143: note = chr11:31821389-31821532
  misc_feature 1..143: note = hyper
  source 1..143: mol_type = genomic DNA
aggacaacaaataccgattaatcttcggagtaaactgtttcctattcttgaccaagctacctcggggtgtggaggggagcggaggggagccaactgaccctcccctccgccccaccccccccatcccccgctcttcttcctcc

SEQ ID NO: 10790 - DNA, 30 bp, Homo sapiens
  misc_feature 1..30: note = chr11:31822002-31822032
  misc_feature 1..30: note = hyper
  source 1..30: mol_type = genomic DNA
cagccaccttcataccgctcctgacataca

SEQ ID NO: 10791 - DNA, 221 bp, Homo sapiens
  misc_feature 1..221: note = chr11:31822487-31822708
  misc_feature 1..221: note = hyper
  source 1..221: mol_type = genomic DNA
aagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 10792 - DNA, 718 bp, Homo sapiens; identical to SEQ ID NO: 3721
  misc_feature 1..718: note = chr11:31824246-31824964
  misc_feature 1..718: note = hyper
  source 1..718: mol_type = genomic DNA

SEQ ID NO: 10793 - DNA, 29 bp, Homo sapiens
  misc_feature 1..29: note = chr11:31826042-31826071
  misc_feature 1..29: note = hyper
  source 1..29: mol_type = genomic DNA
acaggcgtttgggggatctgggctccggc

SEQ ID NO: 10794 - DNA, 198 bp, Homo sapiens; identical to SEQ ID NO: 964
  misc_feature 1..198: note = chr11:31826106-31826304
  misc_feature 1..198: note = hyper
  source 1..198: mol_type = genomic DNA

SEQ ID NO: 10795 - DNA, 325 bp, Homo sapiens; identical to SEQ ID NO: 965
  misc_feature 1..325: note = chr11:31826408-31826733
  misc_feature 1..325: note = hyper
  source 1..325: mol_type = genomic DNA

SEQ ID NO: 10796 - DNA, 117 bp, Homo sapiens; identical to SEQ ID NO: 966
  misc_feature 1..117: note = chr11:31827113-31827230
  misc_feature 1..117: note = hyper
  source 1..117: mol_type = genomic DNA

SEQ ID NO: 10797 - DNA, 457 bp, Homo sapiens; identical to SEQ ID NO: 967
  misc_feature 1..457: note = chr11:31827597-31828054
  misc_feature 1..457: note = hyper
  source 1..457: mol_type = genomic DNA

SEQ ID NO: 10798 - DNA, 329 bp, Homo sapiens
  misc_feature 1..329: note = chr11:31829116-31829445
  misc_feature 1..329: note = hyper
  source 1..329: mol_type = genomic DNA
taacttctcttttggcgtttagatcttcacccctttaactgtactgtgacacaccctgtctacctcgcctcactgctttaaaaagtacgaacaggagggggtgagcgtggtcgacaaagccgacagacggcaaacaatggcttctattctccagctttcctcgaacccaaggagcaaaaccgagtctccctaaccagcaacacagcttccaaccaaatgtaccaacaacccaccaactcacaaagggaacagagggacgcttctagcttcataagccctgacccagtgcaggggtccccgaggctgctcccgtacgaacacctccctac

SEQ ID NO: 10799 - DNA, 56 bp, Homo sapiens
  misc_feature 1..56: note = chr11:31830319-31830375
  misc_feature 1..56: note = hyper
  source 1..56: mol_type = genomic DNA
aattacttaagtaaacgtgaacactaagtgcagaagcaacccgggaagtggggcac

SEQ ID NO: 10800 - DNA, 75 bp, Homo sapiens
  misc_feature 1..75: note = chr11:31831502-31831577
  misc_feature 1..75: note = hyper
  source 1..75: mol_type = genomic DNA
aagggagatgagagtcgggggaagcctggggagcagagagttttcaagttccgagctcagcgctccagtggagtt

SEQ ID NO: 10801 - DNA, 50 bp, Homo sapiens
  misc_feature 1..50: note = chr11:31832795-31832845
  misc_feature 1..50: note = hyper
  source 1..50: mol_type = genomic DNA
gcgcctgaaccagagcgggaaatgaggccgagccacggttcccttttcaa

SEQ ID NO: 10802 - DNA, 49 bp, Homo sapiens
  misc_feature 1..49: note = chr11:31833553-31833602
  misc_feature 1..49: note = hyper
  source 1..49: mol_type = genomic DNA
tctcctttctcctttcggaagccgcggtgcgcagcggagcagaggcaca

SEQ ID NO: 10803 - DNA, 149 bp, Homo sapiens
  misc_feature 1..149: note = chr11:31834086-31834235
  misc_feature 1..149: note = hyper
  source 1..149: mol_type = genomic DNA
ccatttgttgaatgccgcacgattaggacacacctcagtacactccaaaggcgcccctcggagcctgcagttaaggtgacaggagagcgagcggctgcctggtcctgcgctgtcccgagctctctcggcggcttcgggccacggagccg

SEQ ID NO: 10804 - DNA, 30 bp, Homo sapiens
  misc_feature 1..30: note = chr11:31835312-31835342
  misc_feature 1..30: note = hyper
  source 1..30: mol_type = genomic DNA
accccagaatgaggccgagttttcaaagtt

SEQ ID NO: 10805 - DNA, 220 bp, Homo sapiens; identical to SEQ ID NO: 3727
  misc_feature 1..220: note = chr11:31835591-31835811
  misc_feature 1..220: note = hyper
  source 1..220: mol_type = genomic DNA

SEQ ID NO: 10806 - DNA, 438 bp, Homo sapiens; identical to SEQ ID NO: 968
  misc_feature 1..438: note = chr11:31836032-31836470
  misc_feature 1..438: note = hyper
  source 1..438: mol_type = genomic DNA

SEQ ID NO: 10807 - DNA, 159 bp, Homo sapiens; identical to SEQ ID NO: 969
  misc_feature 1..159: note = chr11:31837354-31837513
  misc_feature 1..159: note = hyper
  source 1..159: mol_type = genomic DNA

SEQ ID NO: 10808 - DNA, 735 bp, Homo sapiens; identical to SEQ ID NO: 970
  misc_feature 1..735: note = chr11:31837541-31838276
  misc_feature 1..735: note = hyper
  source 1..735: mol_type = genomic DNA

SEQ ID NO: 10809 - DNA, 1227 bp, Homo sapiens; identical to SEQ ID NO: 3731
  misc_feature 1..1227: note = chr11:31838719-31839946
  misc_feature 1..1227: note = hyper
  source 1..1227: mol_type = genomic DNA

SEQ ID NO: 10810 - DNA, 132 bp, Homo sapiens; identical to SEQ ID NO: 3732
  misc_feature 1..132: note = chr11:31840041-31840173
  misc_feature 1..132: note = hyper
  source 1..132: mol_type = genomic DNA

SEQ ID NO: 10811 - DNA, 315 bp, Homo sapiens; identical to SEQ ID NO: 971
  misc_feature 1..315: note = chr11:31841774-31842089
  misc_feature 1..315: note = hyper
  source 1..315: mol_type = genomic DNA

SEQ ID NO: 10812 - DNA, 51 bp, Homo sapiens
  misc_feature 1..51: note = chr11:31846162-31846213
  misc_feature 1..51: note = hyper
  source 1..51: mol_type = genomic DNA
tcacaaatataatatcggcagctcccggattgcctgcggggttgttcaggc

SEQ ID NO: 10813 - DNA, 94 bp, Homo sapiens
  misc_feature 1..94: note = chr11:31846434-31846528
  misc_feature 1..94: note = hyper
  source 1..94: mol_type = genomic DNA
ccacatccaacttgtcgcagccccacgttcaggcacaggagggagcgaacattgggcagagggtaatttcaacaaaggacggcaggctccgggg

SEQ ID NO: 10814 - DNA, 204 bp, Homo sapiens
  misc_feature 1..204: note = chr11:31846781-31846985
  misc_feature 1..204: note = hyper
  source 1..204: mol_type = genomic DNA
aaagcaaccaaaatgcgcacgccaggcccacggaggccgattgccgaccagcgtagccggcccgcagcgccagagaagccgctcactccggcggagtctctgcaagagaatctgaggctggggaataaaagccgaaactaaatcaggcagcaagagtaacaaaccatctggaaaatggacccacggagccgcaagaatgtactt

SEQ ID NO: 10815 - DNA, 30 bp, Homo sapiens
  misc_feature 1..30: note = chr11:31847250-31847280
  misc_feature 1..30: note = hyper
  source 1..30: mol_type = genomic DNA
tttcttcccctcccccgaacttattctgaa

SEQ ID NO: 10816 - DNA, 229 bp, Homo sapiens; identical to SEQ ID NO: 3734
  misc_feature 1..229: note = chr11:31847484-31847713
  misc_feature 1..229: note = hyper
  source 1..229: mol_type = genomic DNA

SEQ ID NO: 10817 - DNA, 104 bp, Homo sapiens; identical to SEQ ID NO: 3735
  misc_feature 1..104: note = chr11:31847769-31847873
  misc_feature 1..104: note = hyper
  source 1..104: mol_type = genomic DNA

SEQ ID NO: 10818 - DNA, 76 bp, Homo sapiens; identical to SEQ ID NO: 3736
  misc_feature 1..76: note = chr11:31847895-31847971
  misc_feature 1..76: note = hyper
  source 1..76: mol_type = genomic DNA

SEQ ID NO: 10819 - DNA, 248 bp, Homo sapiens; identical to SEQ ID NO: 3737
  misc_feature 1..248: note = chr11:31848355-31848603
  misc_feature 1..248: note = hyper
  source 1..248: mol_type = genomic DNA

SEQ ID NO: 10820 - DNA, 353 bp, Homo sapiens; identical to SEQ ID NO: 3738
  misc_feature 1..353: note = chr11:31848722-31849075
  misc_feature 1..353: note = hyper
  source 1..353: mol_type = genomic DNA

SEQ ID NO: 10821 - DNA, 15 bp, Homo sapiens
  misc_feature 1..15: note = chr11:32009112-32009127
  misc_feature 1..15: note = hyper
  source 1..15: mol_type = genomic DNA
ccagccccggggtgg

SEQ ID NO: 10822 - DNA, 32 bp, Homo sapiens
  misc_feature 1..32: note = chr11:32455602-32455634
  misc_feature 1..32: note = hyper
  source 1..32: mol_type = genomic DNA
ttctgtattaccatacgcgggagctatccacg

SEQ ID NO: 10823 - DNA, 110 bp, Homo sapiens; identical to SEQ ID NO: 972
  misc_feature 1..110: note = chr11:32455906-32456016
  misc_feature 1..110: note = hyper
  source 1..110: mol_type = genomic DNA

SEQ ID NO: 10824 - DNA, 84 bp, Homo sapiens
  misc_feature 1..84: note = chr11:32456305-32456389
  misc_feature 1..84: note = hyper
  source 1..84: mol_type = genomic DNA
acatcctggcctggccggatgacgcctggctgggcggaggaggaccgaagggcccgtagcgacaggctccggctgtgccagtga

SEQ ID NO: 10825 - DNA, 154 bp, Homo sapiens; identical to SEQ ID NO: 3740
  misc_feature 1..154: note = chr11:32456758-32456912
  misc_feature 1..154: note = hyper
  source 1..154: mol_type = genomic DNA

SEQ ID NO: 10826 - DNA, 156 bp, Homo sapiens; identical to SEQ ID NO: 3741
  misc_feature 1..156: note = chr11:32456913-32457069
  misc_feature 1..156: note = hyper
  source 1..156: mol_type = genomic DNA

SEQ ID NO: 10827 - DNA, 916 bp, Homo sapiens; identical to SEQ ID NO: 3742
  misc_feature 1..916: note = chr11:32457851-32458767
  misc_feature 1..916: note = hyper
  source 1..916: mol_type = genomic DNA

SEQ ID NO: 10828 - DNA, 30 bp, Homo sapiens
  misc_feature 1..30: note = chr11:32459780-32459810
  misc_feature 1..30: note = hyper
  source 1..30: mol_type = genomic DNA
actcacagcctagcacgaaggcaggtagca

SEQ ID NO: 10829 - DNA, 41 bp, Homo sapiens
  misc_feature 1..41: note = chr11:32460848-32460889
  misc_feature 1..41: note = hyper
  source 1..41: mol_type = genomic DNA
ccggggcccgcgccccgagccccacgcgcaagacagcccaa

SEQ ID NO: 10830 - DNA, 155 bp, Homo sapiens; identical to SEQ ID NO: 3743
  misc_feature 1..155: note = chr11:33890297-33890452
  misc_feature 1..155: note = hyper
  source 1..155: mol_type = genomic DNA

SEQ ID NO: 10831 - DNA, 91 bp, Homo sapiens
  misc_feature 1..91: note = chr11:35440574-35440665
  misc_feature 1..91: note = hyper
  source 1..91: mol_type = genomic DNA
ggacgccggggtgagcgcgaagtgcggccgggagcggtatttaagaggagcctctgcccgcccttccacccgcctccggggtaagcccttt

SEQ ID NO: 10832 - DNA, 146 bp, Homo sapiens
  misc_feature 1..146: note = chr11:35441295-35441441
  misc_feature 1..146: note = hyper
  source 1..146: mol_type = genomic DNA
gtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttc

SEQ ID NO: 10833 - DNA, 549 bp, Homo sapiens
  misc_feature 1..549: note = chr11:35641053-35641602
  misc_feature 1..549: note = hyper
  source 1..549: mol_type = genomic DNA
cgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacc

SEQ ID NO: 10834 - DNA, 52 bp, Homo sapiens
  misc_feature 1..52: note = chr11:36399257-36399309
  misc_feature 1..52: note = hyper
  source 1..52: mol_type = genomic DNA
ttgtcagcagttaggcggtgagtatttatagacgccacggcagtcctgcggt

SEQ ID NO: 10835 - DNA, 44 bp, Homo sapiens
  misc_feature 1..44: note = chr11:40314716-40314760
  misc_feature 1..44: note = hyper
  source 1..44: mol_type = genomic DNA
aatttcataatctcacgttaaatggagtgcggggggcgggggcg

SEQ ID NO: 10836 - DNA, 93 bp, Homo sapiens
  misc_feature 1..93: note = chr11:40315465-40315558
  misc_feature 1..93: note = hyper
  source 1..93: mol_type = genomic DNA
cggtttgaactctcttcctccccctccctctgctctctcccctctttttctcccaaataaatgctctcccagcaccggcggcagctcttgcca

SEQ ID NO: 10837 - DNA, 62 bp, Homo sapiens
  misc_feature 1..62: note = chr11:43569013-43569075
  misc_feature 1..62: note = hyper
  source 1..62: mol_type = genomic DNA
ggttgcctggcaacccggcagacccgcgggtggacaagctcaaggggcagccaggtgccacc

SEQ ID NO: 10838 - DNA, 110 bp, Homo sapiens
  misc_feature 1..110: note = chr11:43569128-43569238
  misc_feature 1..110: note = hyper
  source 1..110: mol_type = genomic DNA
cgagcgcagccggagcagtcgagcgggcaggacaccgtcagtgccgggagaacacgcgcgcgtgggtggatggcgggagggtcctcacagccagccgcaccacccccctc

SEQ ID NO: 10839 - DNA, 54 bp, Homo sapiens
  misc_feature 1..54: note = chr11:43596489-43596543
  misc_feature 1..54: note = hyper
  source 1..54: mol_type = genomic DNA
ggtgagtttcctcttcgggtggagagcagaggggaaagccgcagtagcaagccg

SEQ ID NO: 10840 - DNA, 30 bp, Homo sapiens
  misc_feature 1..30: note = chr11:43599075-43599105
  misc_feature 1..30: note = hyper
  source 1..30: mol_type = genomic DNA
tgaaagatttctcctcggtgatggtgactc

SEQ ID NO: 10841 - DNA, 287 bp, Homo sapiens
  misc_feature 1..287: note = chr11:43600516-43600803
  misc_feature 1..287: note = hyper
  source 1..287: mol_type = genomic DNA
aaaaagtgagtaatgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctc

SEQ ID NO: 10842 - DNA, 240 bp, Homo sapiens
  misc_feature 1..240: note = chr11:43601012-43601252
  misc_feature 1..240: note = hyper
  source 1..240: mol_type = genomic DNA
cagctggctgcagtgcggacgggaccggcgcgctcccgtggcccccagaccgaggtaaggagcagggagtcggcgcccgggtcggctggtggtcggtcggctcactggtagtcggtcggctcacgggtagtctgagcagaacttttttttcccagttgccccgcgccgcggcggcggcgggcgcagaccgcggagcccctctggcgcggcgggcgcgcagacgctcggagggtgtgtgct

SEQ ID NO: 10843 - DNA, 454 bp, Homo sapiens; identical to SEQ ID NO: 973
  misc_feature 1..454: note = chr11:43602393-43602847
  misc_feature 1..454: note = hyper
  source 1..454: mol_type = genomic DNA

SEQ ID NO: 10844 - DNA, 189 bp, Homo sapiens; identical to SEQ ID NO: 974
  misc_feature 1..189: note = chr11:43602848-43603037
  misc_feature 1..189: note = hyper
  source 1..189: mol_type = genomic DNA

SEQ ID NO: 10845 - DNA, 112 bp, Homo sapiens; identical to SEQ ID NO: 975
  misc_feature 1..112: note = chr11:43603076-43603188
  misc_feature 1..112: note = hyper
  source 1..112: mol_type = genomic DNA

SEQ ID NO: 10846 - DNA, 40 bp, Homo sapiens; identical to SEQ ID NO: 3747
  misc_feature 1..40: note = chr11:43603446-43603486
  misc_feature 1..40: note = hyper
  source 1..40: mol_type = genomic DNA

SEQ ID NO: 10847 - DNA, 438 bp, Homo sapiens
  misc_feature 1..438: note = chr11:43603708-43604146
  misc_feature 1..438: note = hyper
  source 1..438: mol_type = genomic DNA
caaaactaagtagcacggaagggggtaaaacaggcgagaactggggaagcccccgcagagaaggagctttggagagatgcggttgtgcccgactcagacgcttagcaggaacagaagcagcagcagcagcagcagccccatcccggcctctccaggcgccggtcctggggaggggggcaaagctgcaggagaggggagagtctgtgagtccccctcctccccctccactcattgcagtcctgaccacttcggtcacaagtggcacaaatcaggccttcaccacgctccccgcgcccttcgcctgctaggaacactgctagacgcccttgcccttagggactgggccagaaggacacacatacacacatgagtgcccacagggacagaaatgggtagaagatgggtctagagacaccggagttcaagacccgagggctg

SEQ ID NO: 10848 - DNA, 31 bp, Homo sapiens
  misc_feature 1..31: note = chr11:43963534-43963565
  misc_feature 1..31: note = hyper
  source 1..31: mol_type = genomic DNA
agggaagggaagaaccggaatggaataatcg

SEQ ID NO: 10849 - DNA, 30 bp, Homo sapiens
  misc_feature 1..30: note = chr11:43963625-43963655
  misc_feature 1..30: note = hyper
  source 1..30: mol_type = genomic DNA
gcgcgcgcgcgcctgcggaggggggtggca

SEQ ID NO: 10850 - DNA, 198 bp, Homo sapiens
  misc_feature 1..198: note = chr11:43964453-43964651
  misc_feature 1..198: note = hyper
  source 1..198: mol_type = genomic DNA
catggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggt

SEQ ID NO: 10851 - DNA, 357 bp, Homo sapiens
  misc_feature 1..357: note = chr11:43964895-43965252
  misc_feature 1..357: note = hyper
  source 1..357: mol_type = genomic DNA
cccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacactttta

SEQ ID NO: 10852 - DNA, 162 bp, Homo sapiens
  misc_feature 1..162: note = chr11:43965899-43966061
  misc_feature 1..162: note = hyper
  source 1..162: mol_type = genomic DNA
ccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccgcagggttcctcca

SEQ ID NO: 10853 - DNA, 81 bp, Homo sapiens; identical to SEQ ID NO: 976
  misc_feature 1..81: note = chr11:44330877-44330958
  misc_feature 1..81: note = hyper
  source 1..81: mol_type = genomic DNA

SEQ ID NO: 10854 - DNA, 481 bp, Homo sapiens; identical to SEQ ID NO: 977
  misc_feature 1..481: note = chr11:44330959-44331440
  misc_feature 1..481: note = hyper
  source 1..481: mol_type = genomic DNA

SEQ ID NO: 10855 - DNA, 229 bp, Homo sapiens; identical to SEQ ID NO: 978
  misc_feature 1..229: note = chr11:44331482-44331711
  misc_feature 1..229: note = hyper
  source 1..229: mol_type = genomic DNA

SEQ ID NO: 10856 - DNA, 30 bp, Homo sapiens
  misc_feature 1..30: note = chr11:44332542-44332572
  misc_feature 1..30: note = hyper
  source 1..30: mol_type = genomic DNA
tgggctgggatgtagcggaatctgtgctcc

SEQ ID NO: 10857 - DNA, 122 bp, Homo sapiens
  misc_feature 1..122: note = chr11:44332922-44333044
  misc_feature 1..122: note = hyper
  source 1..122: mol_type = genomic DNA
agggaaaaaactttgcgcgtgcagcccctcgatttcgcttcatgacaaccgtgctagagattggcgcccccaattttctgatgagctaacggaggctcagagaggggcggccacctggtcca

SEQ ID NO: 10858 - DNA, 136 bp, Homo sapiens
  misc_feature 1..136: note = chr11:44337726-44337862
  misc_feature 1..136: note = hyper
  source 1..136: mol_type = genomic DNA
cgcgcgggtcctcggcgcgctcgccagacccagccgaccgcgtgactcaccacgtcctccgccgggaggaggtcagcatcggccctgggcaccggtccccagccgccgcagcccctgccccaatctccccggaatg

SEQ ID NO: 10859 - DNA, 176 bp, Homo sapiens
  misc_feature 1..176: note = chr11:44337882-44338058
  misc_feature 1..176: note = hyper
  source 1..176: mol_type = genomic DNA
cgagcctccagtcggatagaggcagggagggaggcactgcccacgacgagtgctctccaggcgctgcaaagagcaggggtctcctaggggctttgagaccgcgggcggacctcgggggagcaggcgtgggacccgatctgtgccggctcagcagggccccagcagcgccccagcgt

SEQ ID NO: 10860 - DNA, 68 bp, Homo sapiens; identical to SEQ ID NO: 3751
  misc_feature 1..68: note = chr11:44341966-44342034
  misc_feature 1..68: note = hyper
  source 1..68: mol_type = genomic DNA

SEQ ID NO: 10861 - DNA, 194 bp, Homo sapiens; identical to SEQ ID NO: 3752
  misc_feature 1..194: note = chr11:45376858-45377052
  misc_feature 1..194: note = hyper
  source 1..194: mol_type = genomic DNA

SEQ ID NO: 10862 - DNA, 88 bp, Homo sapiens
  misc_feature 1..88: note = chr11:46259327-46259415
  misc_feature 1..88: note = hyper
  source 1..88: mol_type = genomic DNA
acacgcggcgagtggcggtgcgcgcggggccaaccgcgtggagctgtcgggagggcgataggatgggcgcgcccgggctgcaggcggg

SEQ ID NO: 10863 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 10864 - DNA, 461 bp, Homo sapiens; identical to SEQ ID NO: 980
  misc_feature 1..461: note = chr11:46316895-46317356
  misc_feature 1..461: note = hyper
  source 1..461: mol_type = genomic DNA

SEQ ID NO: 10865 - DNA, 290 bp, Homo sapiens; identical to SEQ ID NO: 981
  misc_feature 1..290: note = chr11:46317407-46317697
  misc_feature 1..290: note = hyper
  source 1..290: mol_type = genomic DNA

SEQ ID NO: 10866 - DNA, 137 bp, Homo sapiens
  misc_feature 1..137: note = chr11:46414563-46414700
  misc_feature 1..137: note = hyper
  source 1..137: mol_type = genomic DNA
gaatgggagggaactcgagtagaagccagcgctgcggggctcttggtgtggggttctccgcgcggaacccggaagtggagttcgggtccccagagctcgcgagcgcgacggctggggttggtcggaattgggaactt

SEQ ID NO: 10867 - DNA, 577 bp, Homo sapiens; identical to SEQ ID NO: 3756
  misc_feature 1..577: note = chr11:47208680-47209257
  misc_feature 1..577: note = hyper
  source 1..577: mol_type = genomic DNA

SEQ ID NO: 10868 - DNA, 64 bp, Homo sapiens
  misc_feature 1..64: note = chr11:47615772-47615836
  misc_feature 1..64: note = hyper
  source 1..64: mol_type = genomic DNA
gcaggctgcaggctgcgggtgccgggctgcgcgctgaccgcccgcgctgcggcaggggcggcgg

SEQ ID NO: 10869 - DNA, 300 bp, Homo sapiens; identical to SEQ ID NO: 3757
  misc_feature 1..300: note = chr11:57194178-57194478
  misc_feature 1..300: note = hyper
  source 1..300: mol_type = genomic DNA

SEQ ID NO: 10870 - DNA, 30 bp, Homo sapiens
  misc_feature 1..30: note = chr11:58668429-58668459
  misc_feature 1..30: note = hyper
  source 1..30: mol_type = genomic DNA
aggttagttctctggcgccatcagctggca

SEQ ID NO: 10871 - DNA, 450 bp, Homo sapiens; identical to SEQ ID NO: 3758
  misc_feature 1..450: note = chr11:58672717-58673167
  misc_feature 1..450: note = hyper
  source 1..450: mol_type = genomic DNA

SEQ ID NO: 10872 - DNA, 80 bp, Homo sapiens; identical to SEQ ID NO: 3759
  misc_feature 1..80: note = chr11:58673168-58673248
  misc_feature 1..80: note = hyper
  source 1..80: mol_type = genomic DNA

SEQ ID NO: 10873 - DNA, 170 bp, Homo sapiens
  misc_feature 1..170: note = chr11:59333371-59333541
  misc_feature 1..170: note = hyper
  source 1..170: mol_type = genomic DNA
agcccgtgcgccgaacgctttcgaggacttctttggccaagagggggcccgggctgtcaccattcccggcaagcccgcgaccaagcaggcagcggaggcggcgcaggccgagagctcccgcccctctgacagtgagagaagggtcgcagcgcccacggctgcctagaacc

SEQ ID NO: 10874 - DNA, 153 bp, Homo sapiens; identical to SEQ ID NO: 982
  misc_feature 1..153: note = chr11:60718701-60718854
  misc_feature 1..153: note = hyper
  source 1..153: mol_type = genomic DNA

SEQ ID NO: 10875 - DNA, 145 bp, Homo sapiens; identical to SEQ ID NO: 983
  misc_feature 1..145: note = chr11:60718976-60719121
  misc_feature 1..145: note = hyper
  source 1..145: mol_type = genomic DNA

SEQ ID NO: 10876 - DNA, 197 bp, Homo sapiens
  misc_feature 1..197: note = chr11:61062827-61063024
  misc_feature 1..197: note = hyper
  source 1..197: mol_type = genomic DNA
gcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaac

SEQ ID NO: 10877 - DNA, 97 bp, Homo sapiens
  misc_feature 1..97: note = chr11:61063061-61063158
  misc_feature 1..97: note = hyper
  source 1..97: mol_type = genomic DNA
cgctgagcagttctaggcctgcccccagcctgccagaaggtctgcaccctaacgccggagtgcgttgatctgtgggtccaaccgctccctggcctgg

SEQ ID NO: 10878 - DNA, 38 bp, Homo sapiens
  misc_feature 1..38: note = chr11:61276466-61276504
  misc_feature 1..38: note = hyper
  source 1..38: mol_type = genomic DNA
gaccatgggcatcgccgagtccacgccggatgagctgc

SEQ ID NO: 10879 - DNA, 348 bp, Homo sapiens; identical to SEQ ID NO: 3762
  misc_feature 1..348: note = chr11:61276772-61277120
  misc_feature 1..348: note = hyper
  source 1..348: mol_type = genomic DNA

SEQ ID NO: 10880 - DNA, 15 bp, Homo sapiens
  misc_feature 1..15: note = chr11:61277327-61277342
  misc_feature 1..15: note = hyper
  source 1..15: mol_type = genomic DNA
cgctccaggactggg

SEQ ID NO: 10881 - DNA, 51 bp, Homo sapiens
  misc_feature 1..51: note = chr11:61335193-61335244
  misc_feature 1..51: note = hyper
  source 1..51: mol_type = genomic DNA
ctgcaccccggcgggcgcacagacggtccccagcggcggcctgggccagcg

SEQ ID NO: 10882 - DNA, 274 bp, Homo sapiens; identical to SEQ ID NO: 3764
  misc_feature 1..274: note = chr11:61595049-61595323
  misc_feature 1..274: note = hyper
  source 1..274: mol_type = genomic DNA

SEQ ID NO: 10883 - DNA, 465 bp, Homo sapiens
  misc_feature 1..465: note = chr11:61596120-61596585
  misc_feature 1..465: note = hyper
  source 1..465: mol_type = genomic DNA
ggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggac

SEQ ID NO: 10884 - DNA, 158 bp, Homo sapiens
  misc_feature 1..158: note = chr11:64059919-64060077
  misc_feature 1..158: note = hyper
  source 1..158: mol_type = genomic DNA
aggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccc

SEQ ID NO: 10885 - DNA, 72 bp, Homo sapiens
  misc_feature 1..72: note = chr11:64066962-64067034
  misc_feature 1..72: note = hyper
  source 1..72: mol_type = genomic DNA
ggccccgatccccttcgccccccgagaaggctcagccgccttccccgcccacggcctcggccctggattatc

SEQ ID NO: 10886 - DNA, 123 bp, Homo sapiens
  misc_feature 1..123: note = chr11:64409956-64410079
  misc_feature 1..123: note = hyper
  source 1..123: mol_type = genomic DNA
agcgccccccgcccccgggccaaccgggtggccggcatctacagtgccacttaccgtggccgccgcgggtgaggaagggcatgcggttgatggcgatgggcacggtgccgtgcttgctgtgga

SEQ ID NO: 10887 - DNA, 59 bp, Homo sapiens
  misc_feature 1..59: note = chr11:64410347-64410406
  misc_feature 1..59: note = hyper
  source 1..59: mol_type = genomic DNA
gcccccctccggctccgagctccgggagcggggtagggatgaagcggaggtaaaccagg

SEQ ID NO: 10888 - DNA, 108 bp, Homo sapiens
  misc_feature 1..108: note = chr11:64478789-64478897
  misc_feature 1..108: note = hyper
  source 1..108: mol_type = genomic DNA
gaccaggggagagaacgtcaggcctgaggcacacacgagctggaagaacagggacgaggggcggggagagacgcgcatgcgccgcccccagaccgatgggggagcccc

SEQ ID NO: 10889 - DNA, 58 bp, Homo sapiens
  misc_feature 1..58: note = chr11:64480273-64480331
  misc_feature 1..58: note = hyper
  source 1..58: mol_type = genomic DNA
cctcgcccggacacgcgtccccgcagccctggagcgctcgcacccactcacaagccct

SEQ ID NO: 10890 - DNA, 821 bp, Homo sapiens
  misc_feature 1..821: note = chr11:64480379-64481200
  misc_feature 1..821: note = hyper
  source 1..821: mol_type = genomic DNA
cgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcc

SEQ ID NO: 10891 - DNA, 328 bp, Homo sapiens
  misc_feature 1..328: note = chr11:64512954-64513282
  misc_feature 1..328: note = hyper
  source 1..328: mol_type = genomic DNA
gtctgggaatgggggcggggggcccagttcacacaggaggaacggggccccggaagcctggctccccacagggtcgaatggaaaggggcagccgcatgtggcggtgggttctccgcagctcggagactggagacctggatgcctggccaacagggaggaacttgggaggggcagccgcaggcggttggggtccccactagccgggcctaggagagcgggtaacggtttccgaccatttggcttcagacacactcactgtgaaaccaccgaccccaaacctcccttccgaggcgtgcccctcccagccttggggcgggggatccaggac

SEQ ID NO: 10892 - DNA, 30 bp, Homo sapiens
  misc_feature 1..30: note = chr11:64739455-64739485
  misc_feature 1..30: note = hyper
  source 1..30: mol_type = genomic DNA
gctctctgaaaaaggcgggcgccaacctcg

SEQ ID NO: 10893 - DNA, 32 bp, Homo sapiens
  misc_feature 1..32: note = chr11:64739698-64739730
  misc_feature 1..32: note = hyper
  source 1..32: mol_type = genomic DNA
gcccattgtttatttcgcgcctgctttagcgt

SEQ ID NO: 10894 - DNA, 30 bp, Homo sapiens
  misc_feature 1..30: note = chr11:65185213-65185243
  misc_feature 1..30: note = hyper
  source 1..30: mol_type = genomic DNA
aggtgcagggcagcccggggaggcagggct

SEQ ID NO: 10895 - DNA, 30 bp, Homo sapiens
  misc_feature 1..30: note = chr11:65185467-65185497
  misc_feature 1..30: note = hyper
  source 1..30: mol_type = genomic DNA
gagtgctcaggaggacgggggaccaaggcc

SEQ ID NO: 10896 - DNA, 762 bp, Homo sapiens; identical to SEQ ID NO: 984
  misc_feature 1..762: note = chr11:65600895-65601657
  misc_feature 1..762: note = hyper
  source 1..762: mol_type = genomic DNA

SEQ ID NO: 10897 - DNA, 73 bp, Homo sapiens; identical to SEQ ID NO: 985
  misc_feature 1..73: note = chr11:65816447-65816520
  misc_feature 1..73: note = hyper
  source 1..73: mol_type = genomic DNA

SEQ ID NO: 10898 - skipped

SEQ ID NO: 10899 - DNA, 75 bp, Homo sapiens; identical to SEQ ID NO: 987
  misc_feature 1..75: note = chr11:66188095-66188170
  misc_feature 1..75: note = hyper
  source 1..75: mol_type = genomic DNA

SEQ ID NO: 10900 - DNA, 110 bp, Homo sapiens
  misc_feature 1..110: note = chr11:66188375-66188485
  misc_feature 1..110: note = hyper
  source 1..110: mol_type = genomic DNA
cccctccccagtcagcggctcccgctgcagcttgcttagcccagcctcccgctctcccgcccccccggctctaaaacgagccccccacgcctggcaggagctatataagg

SEQ ID NO: 10901 - DNA, 15 bp, Homo sapiens
  misc_feature 1..15: note = chr11:66188769-66188784
  misc_feature 1..15: note = hyper
  source 1..15: mol_type = genomic DNA
gcacatcatgagcct

SEQ ID NO: 10902 - DNA, 257 bp, Homo sapiens; identical to SEQ ID NO: 3770
  misc_feature 1..257: note = chr11:66188852-66189109
  misc_feature 1..257: note = hyper
  source 1..257: mol_type = genomic DNA

SEQ ID NO: 10903 - DNA, 66 bp, Homo sapiens
  misc_feature 1..66: note = chr11:67479192-67479258
  misc_feature 1..66: note = hyper
  source 1..66: mol_type = genomic DNA
ccctctgcgcctgttcgtacgggcagggccggcggccgagtccagcgggctcggggccaggcctgg

SEQ ID NO: 10904 - DNA, 74 bp, Homo sapiens
  misc_feature 1..74: note = chr11:67895805-67895879
  misc_feature 1..74: note = hyper
  source 1..74: mol_type = genomic DNA
cccagcgctactgcccgggccgaattccaaggccagcggctgcccgctgagaaggaatccggaccaacgggatt

SEQ ID NO: 10905 - DNA, 30 bp, Homo sapiens
  misc_feature 1..30: note = chr11:69452211-69452241
  misc_feature 1..30: note = hyper
  source 1..30: mol_type = genomic DNA
tgcgggggagagggccgaacgtgacctccg

SEQ ID NO: 10906 - DNA, 282 bp, Homo sapiens
  misc_feature 1..282: note = chr11:69517132-69517414
  misc_feature 1..282: note = hyper
  source 1..282: mol_type = genomic DNA
ggggccccgggcaggcgcggccacccccgccctggcccctgctccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacagg

SEQ ID NO: 10907 - DNA, 285 bp, Homo sapiens
  misc_feature 1..285: note = chr11:69518290-69518575
  misc_feature 1..285: note = hyper
  source 1..285: mol_type = genomic DNA
aggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggg

SEQ ID NO: 10908 - DNA, 30 bp, Homo sapiens
  misc_feature 1..30: note = chr11:69519421-69519451
  misc_feature 1..30: note = hyper
  source 1..30: mol_type = genomic DNA
ttgcaattcctgccccgccccttttatccg

SEQ ID NO: 10909 - DNA, 180 bp, Homo sapiens
  misc_feature 1..180: note = chr11:69588904-69589084
  misc_feature 1..180: note = hyper
  source 1..180: mol_type = genomic DNA
gggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctg

SEQ ID NO: 10910 - DNA, 100 bp, Homo sapiens
  misc_feature 1..100: note = chr11:69589407-69589507
  misc_feature 1..100: note = hyper
  source 1..100: mol_type = genomic DNA
ccccgagcaggtgcccgccgagggtctcagagtgtgactgagcgggttggcccggcggccgttgccccccgcccccgccccttcgcgcctggccgcgcca

SEQ ID NO: 10911 - DNA, 282 bp, Homo sapiens
  misc_feature 1..282: note = chr11:69589831-69590113
  misc_feature 1..282: note = hyper
  source 1..282: mol_type = genomic DNA
ggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 10912 - DNA, 353 bp, Homo sapiens
  misc_feature 1..353: note = chr11:69590114-69590467
  misc_feature 1..353: note = hyper
  source 1..353: mol_type = genomic DNA
cccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagcc

SEQ ID NO: 10913 - DNA, 531 bp, Homo sapiens
  misc_feature 1..531: note = chr11:71318279-71318810
  misc_feature 1..531: note = hyper
  source 1..531: mol_type = genomic DNA
ggggaaggtgcggggcgaggcggccgcggctccctggcatccctctccttacccccaggctaagctggcggtgctgctggtgacgctggtggcggccgcggtctcctacctgcggatggagcagaagctgcggcggggcgtgcgccagccccgcatcccgtggccccagcacaaggtgcgcagttaccgctacttggaggaggacaactcggacgagagcgacgcggagggcgagcatggggacggcgcggaggaggaggcgccgcccgcggggaccaggcctggtcccgagcaggctggactcggccgccggccctgcccgtaggaacaggcgcaggggggcgactggccagaggagcagtgaggggccgcctggtccacggactcagcctccctcctcgccggccttagtttaccacttcttaggtcggggggaccccctccgagtcccgcgctgtcttcaaaggcccctgtctcccgtcccccacgttggggacgcccctcccagagcccaggtcacctccgggcttc

SEQ ID NO: 10914 - DNA, 66 bp, Homo sapiens
  misc_feature 1..66: note = chr11:71318952-71319018
  misc_feature 1..66: note = hyper
  source 1..66: mol_type = genomic DNA
cgctccagatccccccagctctcggcggcggacccgggccgcgtgtgagcgcgctttgcacctcct

SEQ ID NO: 10915 - DNA, 86 bp, Homo sapiens
  misc_feature 1..86: note = chr11:71951583-71951669
  misc_feature 1..86: note = hyper
  source 1..86: mol_type = genomic DNA
ggagtgttccagggccgtggagagcagtttagggcgccagtaaaccttttgtctagggcatccagtcaaggcgggccaactgaaca

SEQ ID NO: 10916 - DNA, 30 bp, Homo sapiens
  misc_feature 1..30: note = chr11:71952340-71952370
  misc_feature 1..30: note = hyper
  source 1..30: mol_type = genomic DNA
tgtgtgcaggggggccggggggggggcaaa

SEQ ID NO: 10917 - DNA, 30 bp, Homo sapiens
  misc_feature 1..30: note = chr11:71954593-71954623
  misc_feature 1..30: note = hyper
  source 1..30: mol_type = genomic DNA
ttgacctgaagggcacgagacagagatttg

SEQ ID NO: 10918 - DNA, 165 bp, Homo sapiens; identical to SEQ ID NO: 3771
  misc_feature 1..165: note = chr11:71955215-71955380
  misc_feature 1..165: note = hyper
  source 1..165: mol_type = genomic DNA

SEQ ID NO: 10919 - DNA, 134 bp, Homo sapiens
  misc_feature 1..134: note = chr11:71956243-71956377
  misc_feature 1..134: note = hyper
  source 1..134: mol_type = genomic DNA
ggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 10920 - DNA, 236 bp, Homo sapiens
  misc_feature 1..236: note = chr11:72432837-72433073
  misc_feature 1..236: note = hyper
  source 1..236: mol_type = genomic DNA
agggcctccctcctacgtgcccaacagcaacaacagcaacggcggcacctcgcttaccctcagacgcctgctgggtcttggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggt

SEQ ID NO: 10921 - DNA, 146 bp, Homo sapiens
  misc_feature 1..146: note = chr11:74394454-74394600
  misc_feature 1..146: note = hyper
  source 1..146: mol_type = genomic DNA
ggctgggcacccccacgccgcccgggcactgctcgcggccgcgctttacaagcgaaaacaaacacggccacaagcagcccctgtgcgacgcggccccgcgcccgccagcgccgccgccgcccggtcaaagccggctttgtgcccgt

SEQ ID NO: 10922 - DNA, 30 bp, Homo sapiens
  misc_feature 1..30: note = chr11:74441845-74441875
  misc_feature 1..30: note = hyper
  source 1..30: mol_type = genomic DNA
acttacgggctcgagcgtgggagtccaggg

SEQ ID NO: 10923 - DNA, 388 bp, Homo sapiens
  misc_feature 1..388: note = chr11:74442255-74442643
  misc_feature 1..388: note = hyper
  source 1..388: mol_type = genomic DNA
aggaccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccggga

SEQ ID NO: 10924 - DNA, 49 bp, Homo sapiens
  misc_feature 1..49: note = chr11:74442705-74442754
  misc_feature 1..49: note = hyper
  source 1..49: mol_type = genomic DNA
cgggccacggggtttaacccctgactccccgcgacgccaagaatgcagg

SEQ ID NO: 10925 - DNA, 33 bp, Homo sapiens
  misc_feature 1..33: note = chr11:74952180-74952213
  misc_feature 1..33: note = hyper
  source 1..33: mol_type = genomic DNA
ccagtgctactgcttcggcggccccaagctgct

SEQ ID NO: 10926 - skipped

SEQ ID NO: 10927 - DNA, 198 bp, Homo sapiens
  misc_feature 1..198: note = chr11:75141367-75141565
  misc_feature 1..198: note = hyper
  source 1..198: mol_type = genomic DNA
gcgccgccgccgccccggccgggctcgtgcctggcgcctcgggagctactggcaccactggcaccacggccgggccgcgctcgggccgcccggccgcgaacaagctgcggaagtaggcgctgcccgcgctgagcgccgcgcggtggcacggaaagtcgcgcccgccggcgcgcagcaccacgtcggtgagggtgccgc

SEQ ID NO: 10928 - DNA, 553 bp, Homo sapiens
  misc_feature 1..553: note = chr11:75378696-75379249
  misc_feature 1..553: note = hyper
  source 1..553: mol_type = genomic DNA
tgcgcgtgtcgcgctcgtccgccccggacgcctttccggccgccaggccacccgctccgccgggggccgcctcctgctcccgggcctcagcggcggcctgcactggccagcgctcctggctctgcggccggcgcttgggcgccccgagaatgggcgccgacgcctgggaggccgcagagatctgcacgggcttggggatccacgggtggtccccgcggcgcggcagcggccaggcgcggaagtccttctggtactgggtctcgcgctcgaagggagcgtcggagggctggtattcgctgcgcggccggcagctgggctcgggccgctgcaccttccaggctcggtaatcctgccgcatcaccgagtccgcggggccggaggtggagccggagcccaggcccgggcccggcccgctccggccggggcccgccgccggctcgcgctcgccggtaggcccaggcgctggccccgttgcccgggcaactgcatccaactcgccctgggctggctgcgtctctatggcaaccgcgcgcgccgaggggggcgcgagcgc

SEQ ID NO: 10929 - DNA, 791 bp, Homo sapiens
  misc_feature 1..791: note = chr11:75379282-75380073
  misc_feature 1..791: note = hyper
  source 1..791: mol_type = genomic DNA
cggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgc

SEQ ID NO: 10930 - DNA, 138 bp, Homo sapiens
  misc_feature 1..138: note = chr11:75863325-75863463
  misc_feature 1..138: note = hyper
  source 1..138: mol_type = genomic DNA
ctgacctcagccctgcgggccccgttcccgccattccttcctgcctctcacgttgactgggctccccctgtcggtcggcactggctgaacagccatggagtggcgctttggggaaaccacgggcgaccaggaaagatc

SEQ ID NO: 10931 - DNA, 156 bp, Homo sapiens
  misc_feature 1..156: note = chr11:76032912-76033068
  misc_feature 1..156: note = hyper
  source 1..156: mol_type = genomic DNA
gccccacaaggcccacgcttgcgccctcgggctgcgcagggcgagggtttgggggcgcggtactgacgggtgtccaggcctctcctcgaagggttccgcgcgcagaaaggtgggccggggccagaagacgcgctggaaaggcgttttctgccccct

SEQ ID NO: 10932 - DNA, 30 bp, Homo sapiens
  misc_feature 1..30: note = chr11:76382193-76382223
  misc_feature 1..30: note = hyper
  source 1..30: mol_type = genomic DNA
gcgggggcaaacaggcgaggtgacggcggg

SEQ ID NO: 10933 - DNA, 176 bp, Homo sapiens; identical to SEQ ID NO: 3772
  misc_feature 1..176: note = chr11:78672891-78673067
  misc_feature 1..176: note = hyper
  source 1..176: mol_type = genomic DNA

SEQ ID NO: 10934 - DNA, 30 bp, Homo sapiens
  misc_feature 1..30: note = chr11:78673274-78673304
  misc_feature 1..30: note = hyper
  source 1..30: mol_type = genomic DNA
ttggctgggccacaccgttgcctagcaacc

SEQ ID NO: 10935 - DNA, 142 bp, Homo sapiens
  misc_feature 1..142: note = chr11:79148873-79149015
  misc_feature 1..142: note = hyper
  source 1..142: mol_type = genomic DNA
cttcctggattcccacggctggaccagagcccctctggcagccgggttaaaggctccttcagcaaggtcaaggcgcggccggctggcacctggggatttttttccagccgagcactggcttttcaatcgcattgttaaggat

SEQ ID NO: 10936 - DNA, 30 bp, Homo sapiens
  misc_feature 1..30: note = chr11:79149278-79149308
  misc_feature 1..30: note = hyper
  source 1..30: mol_type = genomic DNA
ttatccccctacagacgaaaatcaagattt

SEQ ID NO: 10937 - DNA, 42 bp, Homo sapiens
  misc_feature 1..42: note = chr11:79149528-79149570
  misc_feature 1..42: note = hyper
  source 1..42: mol_type = genomic DNA
gtaagggtggcagcccggcagagccagcgttctactccctct

SEQ ID NO: 10938 - DNA, 61 bp, Homo sapiens
  misc_feature 1..61: note = chr11:79150941-79151002
  misc_feature 1..61: note = hyper
  source 1..61: mol_type = genomic DNA
gacgaacatcaataccgcggccgggcgcccggtgaggagaggcgggcgccccgcgggttgc

SEQ ID NO: 10939 - DNA, 137 bp, Homo sapiens
  misc_feature 1..137: note = chr11:79152080-79152217
  misc_feature 1..137: note = hyper
  source 1..137: mol_type = genomic DNA
cggtagccaatcctacgaggccggcgagccgcgcggcgcactggcgctgggagcagggccgcactccggcgcgggggggcgccacgcaggtgatgggcgcctctccgggggccacgcgcggccgctccctcacccca

SEQ ID NO: 10940 - DNA, 20 bp, Homo sapiens
  misc_feature 1..20: note = chr11:82443549-82443569
  misc_feature 1..20: note = hyper
  source 1..20: mol_type = genomic DNA
aaaggctggaataggcggtg

SEQ ID NO: 10941 - DNA, 69 bp, Homo sapiens
  misc_feature 1..69: note = chr11:82443651-82443720
  misc_feature 1..69: note = hyper
  source 1..69: mol_type = genomic DNA
cgaaagaggccaaatggccccgcccgtcctccccgccgggagaatccgcagcggcggggtacagggggc

SEQ ID NO: 10942 - DNA, 32 bp, Homo sapiens
  misc_feature 1..32: note = chr11:82444153-82444185
  misc_feature 1..32: note = hyper
  source 1..32: mol_type = genomic DNA
tgccacgtcccctcccgcgcccccagtgcccg

SEQ ID NO: 10943 - DNA, 549 bp, Homo sapiens; identical to SEQ ID NO: 3773
  misc_feature 1..549: note = chr11:82444635-82445184
  misc_feature 1..549: note = hyper
  source 1..549: mol_type = genomic DNA

SEQ ID NO: 10944 - DNA, 79 bp, Homo sapiens
  misc_feature 1..79: note = chr11:84431621-84431700
  misc_feature 1..79: note = hyper
  source 1..79: mol_type = genomic DNA
cccttccctggggaacgaggcgtgtggggggagggacagaaccaagaaagaatttttccccctacggtgaatttggggg

SEQ ID NO: 10945 - DNA, 30 bp, Homo sapiens
  misc_feature 1..30: note = chr11:84432138-84432168
  misc_feature 1..30: note = hyper
  source 1..30: mol_type = genomic DNA
accgctacagccacccgagggtagaagacc

SEQ ID NO: 10946 - DNA, 76 bp, Homo sapiens; identical to SEQ ID NO: 3774
  misc_feature 1..76: note = chr11:86085786-86085862
  misc_feature 1..76: note = hyper
  source 1..76: mol_type = genomic DNA

SEQ ID NO: 10947 - DNA, 60 bp, Homo sapiens; identical to SEQ ID NO: 3775
  misc_feature 1..60: note = chr11:86085931-86085991
  misc_feature 1..60: note = hyper
  source 1..60: mol_type = genomic DNA

SEQ ID NO: 10948 - DNA, 38 bp, Homo sapiens; identical to SEQ ID NO: 988
  misc_feature 1..38: note = chr11:88241938-88241976
  misc_feature 1..38: note = hyper
  source 1..38: mol_type = genomic DNA

SEQ ID NO: 10949 - DNA, 145 bp, Homo sapiens; identical to SEQ ID NO: 989
  misc_feature 1..145: note = chr11:88242130-88242275
  misc_feature 1..145: note = hyper
  source 1..145: mol_type = genomic DNA

SEQ ID NO: 10950 - DNA, 42 bp, Homo sapiens; identical to SEQ ID NO: 990
  misc_feature 1..42: note = chr11:88242358-88242400
  misc_feature 1..42: note = hyper
  source 1..42: mol_type = genomic DNA

SEQ ID NO: 10951 - DNA, 111 bp, Homo sapiens; identical to SEQ ID NO: 3779
  misc_feature 1..111: note = chr11:88798820-88798931
  misc_feature 1..111: note = hyper
  source 1..111: mol_type = genomic DNA

SEQ ID NO: 10952 - DNA, 170 bp, Homo sapiens; identical to SEQ ID NO: 3780
  misc_feature 1..170: note = chr11:88798965-88799135
  misc_feature 1..170: note = hyper
  source 1..170: mol_type = genomic DNA

SEQ ID NO: 10953 - DNA, 34 bp, Homo sapiens
  misc_feature 1..34: note = chr11:89224559-89224593
  misc_feature 1..34: note = hyper
  source 1..34: mol_type = genomic DNA
ggcgccgagccagcccgggcggggtctgctaccc

SEQ ID NO: 10954 - DNA, 517 bp, Homo sapiens
  misc_feature 1..517: note = chr11:91957315-91957832
  misc_feature 1..517: note = hyper
  source 1..517: mol_type = genomic DNA
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccg

SEQ ID NO: 10955 - DNA, 120 bp, Homo sapiens; identical to SEQ ID NO: 3781
  misc_feature 1..120: note = chr11:91958730-91958850
  misc_feature 1..120: note = hyper
  source 1..120: mol_type = genomic DNA

SEQ ID NO: 10956 - DNA, 30 bp, Homo sapiens
  misc_feature 1..30: note = chr11:91959509-91959539
  misc_feature 1..30: note = hyper
  source 1..30: mol_type = genomic DNA
catgattgggctttgcggaaagcaactttt

SEQ ID NO: 10957 - DNA, 32 bp, Homo sapiens
  misc_feature 1..32: note = chr11:91960082-91960114
  misc_feature 1..32: note = hyper
  source 1..32: mol_type = genomic DNA
gcccccagactctggcgcgtttgttttccaag

SEQ ID NO: 10958 - DNA, 80 bp, Homo sapiens
  misc_feature 1..80: note = chr11:91960369-91960449
  misc_feature 1..80: note = hyper
  source 1..80: mol_type = genomic DNA
ttctcccacttgcctcggacatattaattttctggccccgacgctagtcttttcaaaggcgagtccggggtagtgggagg

SEQ ID NO: 10959 - DNA, 124 bp, Homo sapiens
  misc_feature 1..124: note = chr11:93063613-93063737
  misc_feature 1..124: note = hyper
  source 1..124: mol_type = genomic DNA
cagcgaggtcgcgctcgcgcggggtgaggttggaggcagccgaggagccgcacagggcagcgcctgccgccgccgccgcgcccatcccccactccgacggccacgagttcgggccgcgacgtcc

SEQ ID NO: 10960 - DNA, 49 bp, Homo sapiens
  misc_feature 1..49: note = chr11:94134067-94134116
  misc_feature 1..49: note = hyper
  source 1..49: mol_type = genomic DNA
caactgccaggttgacgatgaagaggctggtggccgagtgcattcgctg

SEQ ID NO: 10961 - DNA, 118 bp, Homo sapiens
  misc_feature 1..118: note = chr11:94134346-94134464
  misc_feature 1..118: note = hyper
  source 1..118: mol_type = genomic DNA
ggccctcgtggggctcggtggctcgcaccaaggggaggagacagagcagcaagaggtgagggaccattttgcaggagccacccctcccctgggagcctgcgggccgggcgtcccctcc

SEQ ID NO: 10962 - DNA, 125 bp, Homo sapiens
  misc_feature 1..125: note = chr11:94134716-94134841
  misc_feature 1..125: note = hyper
  source 1..125: mol_type = genomic DNA
ctccccccaccctaccgggtggcgccgttgctgaccccacgcccagccgttcccactcccgcctgaaactcctccgacagggcttcgcttcgggggctcagtccccagcgcgtacacactcgcgt

SEQ ID NO: 10963 - DNA, 75 bp, Homo sapiens; identical to SEQ ID NO: 3782
  misc_feature 1..75: note = chr11:94473596-94473671
  misc_feature 1..75: note = hyper
  source 1..75: mol_type = genomic DNA

SEQ ID NO: 10964 - DNA, 97 bp, Homo sapiens; identical to SEQ ID NO: 3783
  misc_feature 1..97: note = chr11:94473672-94473769
  misc_feature 1..97: note = hyper
  source 1..97: mol_type = genomic DNA

SEQ ID NO: 10965 - DNA, 96 bp, Homo sapiens; identical to SEQ ID NO: 3784
  misc_feature 1..96: note = chr11:94473802-94473898
  misc_feature 1..96: note = hyper
  source 1..96: mol_type = genomic DNA

SEQ ID NO: 10966 - DNA, 30 bp, Homo sapiens
  misc_feature 1..30: note = chr11:94474489-94474519
  misc_feature 1..30: note = hyper
  source 1..30: mol_type = genomic DNA
ggcttctgaaacctgcgctcatcttgccgg

SEQ ID NO: 10967 - DNA, 521 bp, Homo sapiens
  misc_feature 1..521: note = chr11:94501445-94501966
  misc_feature 1..521: note = hyper
  source 1..521: mol_type = genomic DNA
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttg

SEQ ID NO: 10968 - DNA, 34 bp, Homo sapiens
  misc_feature 1..34: note = chr11:98891367-98891401
  misc_feature 1..34: note = hyper
  source 1..34: mol_type = genomic DNA
gttgcagagcagaaacgctcggggaaggggggca

SEQ ID NO: 10969 - DNA, 30 bp, Homo sapiens
  misc_feature 1..30: note = chr11:98891804-98891834
  misc_feature 1..30: note = hyper
  source 1..30: mol_type = genomic DNA
gggtcccgtctgctgcgagaggcagggcaa

SEQ ID NO: 10970 - DNA, 708 bp, Homo sapiens; identical to SEQ ID NO: 3785
  misc_feature 1..708: note = chr11:100997686-100998394
  misc_feature 1..708: note = hyper
  source 1..708: mol_type = genomic DNA

SEQ ID NO: 10971 - DNA, 30 bp, Homo sapiens
  misc_feature 1..30: note = chr11:100999675-100999705
  misc_feature 1..30: note = hyper
  source 1..30: mol_type = genomic DNA
cgaggtctggctccccgggaacggacctgc

SEQ ID NO: 10972 - DNA, 375 bp, Homo sapiens; identical to SEQ ID NO: 3786
  misc_feature 1..375: note = chr11:101453090-101453465
  misc_feature 1..375: note = hyper
  source 1..375: mol_type = genomic DNA

SEQ ID NO: 10973 - DNA, 64 bp, Homo sapiens
  misc_feature 1..64: note = chr11:101454510-101454574
  misc_feature 1..64: note = hyper
  source 1..64: mol_type = genomic DNA
gggcagagagggcacaggcggggccgctggtggtagcgaagcgtaagagcggagagcaagggag

SEQ ID NO: 10974 - DNA, 35 bp, Homo sapiens
  misc_feature 1..35: note = chr11:101918471-101918506
  misc_feature 1..35: note = hyper
  source 1..35: mol_type = genomic DNA
ggtgggatcggttatcggtgcgctctgagagggtg

SEQ ID NO: 10975 - DNA, 345 bp, Homo sapiens; identical to SEQ ID NO: 3787
  misc_feature 1..345: note = chr11:104034409-104034754
  misc_feature 1..345: note = hyper
  source 1..345: mol_type = genomic DNA

SEQ ID NO: 10976 - DNA, 463 bp, Homo sapiens; identical to SEQ ID NO: 3788
  misc_feature 1..463: note = chr11:104034755-104035218
  misc_feature 1..463: note = hyper
  source 1..463: mol_type = genomic DNA

SEQ ID NO: 10977 - DNA, 312 bp, Homo sapiens
  misc_feature 1..312: note = chr11:105481005-105481317
  misc_feature 1..312: note = hyper
  source 1..312: mol_type = genomic DNA
aaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcgcgctcgaggaggggacgccaggagggcagcgatgctccgggctggtgcaggcttgctgggggatgtcggctgatgcgagctggagagcgcgtgtggcggcc

SEQ ID NO: 10978-10979 - skipped (2 entries)

SEQ ID NO: 10980 - DNA, 207 bp, Homo sapiens
  misc_feature 1..207: note = chr11:105481323-105481530
  misc_feature 1..207: note = hyper
  source 1..207: mol_type = genomic DNA
ccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaag

SEQ ID NO: 10981 - DNA, 203 bp, Homo sapiens
  misc_feature 1..203: note = chr11:106888283-106888486
  misc_feature 1..203: note = hyper
  source 1..203: mol_type = genomic DNA
tgtagtcccctcttccgccctagcctaggggatcctctgtcgccggagccactggaaccctaggccgtgcagggtaaggccgggccgccccccagcggtcgggctctgcgctcgcgccccggctcgcccagcgccaactttacagatccgcgttctctcccccgaaggcggtccccccttccgccccccgctcaccgagggcg

SEQ ID NO: 10982 - DNA, 127 bp, Homo sapiens
  misc_feature 1..127: note = chr11:106888697-106888824
  misc_feature 1..127: note = hyper
  source 1..127: mol_type = genomic DNA
ctccccctcctcctccgggctggtctccaggtagtcggagcccagggagctgaaggactcggacgaaatcttccttcgagacatgctgccggcggagctgcagcggccgaggcggtggcggcgagga

SEQ ID NO: 10983 - DNA, 15 bp, Homo sapiens
  misc_feature 1..15: note = chr11:106889400-106889415
  misc_feature 1..15: note = hyper
  source 1..15: mol_type = genomic DNA
cgttgctgtcctctg

SEQ ID NO: 10984 - DNA, 286 bp, Homo sapiens
  misc_feature 1..286: note = chr11:106889690-106889976
  misc_feature 1..286: note = hyper
  source 1..286: mol_type = genomic DNA
ccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgt

SEQ ID NO: 10985 - DNA, 323 bp, Homo sapiens
  misc_feature 1..323: note = chr11:107462128-107462451
  misc_feature 1..323: note = hyper
  source 1..323: mol_type = genomic DNA
agtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcggcccgggcgtaggtcgcctagcgacctaacgccgag

SEQ ID NO: 10986 - DNA, 448 bp, Homo sapiens
  misc_feature 1..448: note = chr11:107799357-107799805
  misc_feature 1..448: note = hyper
  source 1..448: mol_type = genomic DNA
tcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcaggtagggaccccggggaccttgggcaccgcgccgccccctcagcccgcccggacgccccttccccaggcgtccgccccgccggccctggtcgggagaggctctggcccttccctctcgaaagtgcaaacactccattctcgcttcccctttgcccctcctcttccagggacgacttcctcctccgcaatttctcacttctttctttggcgcccatttcctgcgccccctttccatctttcctttcccgcctgaaccggggtcgtcctcgccgccccctcttcccc

SEQ ID NO: 10987 - DNA, 15 bp, Homo sapiens
  misc_feature 1..15: note = chr11:109292815-109292830
  misc_feature 1..15: note = hyper
  source 1..15: mol_type = genomic DNA
tctggcaataggctg

SEQ ID NO: 10988 - DNA, 284 bp, Homo sapiens
  misc_feature 1..284: note = chr11:109292891-109293175
  misc_feature 1..284: note = hyper
  source 1..284: mol_type = genomic DNA
cgcggctcggtctctggtccattcactccacgctttctgcagccgccactgcagccgcgcggcgggggctccctccttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgcaacagtt

SEQ ID NO: 10989 - DNA, 18 bp, Homo sapiens
  misc_feature 1..18: note = chr11:109293746-109293764
  misc_feature 1..18: note = hyper
  source 1..18: mol_type = genomic DNA
agaaaagaggagagccgg

SEQ ID NO: 10990 - DNA, 26 bp, Homo sapiens
  misc_feature 1..26: note = chr11:109293873-109293899
  misc_feature 1..26: note = hyper
  source 1..26: mol_type = genomic DNA
cgcggtgccggcgcagaccccatcct

SEQ ID NO: 10991 - DNA, 141 bp, Homo sapiens
  misc_feature 1..141: note = chr11:110581773-110581914
  misc_feature 1..141: note = hyper
  source 1..141: mol_type = genomic DNA
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccgg

SEQ ID NO: 10992 - DNA, 283 bp, Homo sapiens
  misc_feature 1..283: note = chr11:110582137-110582420
  misc_feature 1..283: note = hyper
  source 1..283: mol_type = genomic DNA
cgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgcc

SEQ ID NO: 10993 - DNA, 114 bp, Homo sapiens
  misc_feature 1..114: note = chr11:110582421-110582535
  misc_feature 1..114: note = hyper
  source 1..114: mol_type = genomic DNA
gccctgactttggggctgacaccgccaaagggcagtcagtgctcgcccaggccacttcgggaggcccaggggcacggcgaggggtcggggaaaggcgatcgcccactacagccc

SEQ ID NO: 10994 - DNA, 140 bp, Homo sapiens; identical to SEQ ID NO: 3789
  misc_feature 1..140: note = chr11:110582889-110583029
  misc_feature 1..140: note = hyper
  source 1..140: mol_type = genomic DNA

SEQ ID NO: 10995 - DNA, 853 bp, Homo sapiens; identical to SEQ ID NO: 3790
  misc_feature 1..853: note = chr11:110583043-110583896
  misc_feature 1..853: note = hyper
  source 1..853: mol_type = genomic DNA

SEQ ID NO: 10996 - DNA, 30 bp, Homo sapiens
  misc_feature 1..30: note = chr11:110584122-110584152
  misc_feature 1..30: note = hyper
  source 1..30: mol_type = genomic DNA
ctagagaagcagtggcggattagtgaggaa

SEQ ID NO: 10997 - DNA, 383 bp, Homo sapiens; identical to SEQ ID NO: 3791
  misc_feature 1..383: note = chr11:111383132-111383515
  misc_feature 1..383: note = hyper
  source 1..383: mol_type = genomic DNA

SEQ ID NO: 10998 - DNA, 16 bp, Homo sapiens
  misc_feature 1..16: note = chr11:111383516-111383532
  misc_feature 1..16: note = hyper
  source 1..16: mol_type = genomic DNA
ggggtcccgctgggcc

SEQ ID NO: 10999 - DNA, 348 bp, Homo sapiens; identical to SEQ ID NO: 3793
  misc_feature 1..348: note = chr11:111383557-111383905
  misc_feature 1..348: note = hyper
  source 1..348: mol_type = genomic DNA

SEQ ID NO: 11000 - DNA, 286 bp, Homo sapiens; identical to SEQ ID NO: 991
  misc_feature 1..286: note = chr11:111411296-111411582
  misc_feature 1..286: note = hyper
  source 1..286: mol_type = genomic DNA

SEQ ID NO: 11001 - DNA, 391 bp, Homo sapiens; identical to SEQ ID NO: 992
  misc_feature 1..391: note = chr11:111411821-111412212
  misc_feature 1..391: note = hyper
  source 1..391: mol_type = genomic DNA

SEQ ID NO: 11002 - DNA, 320 bp, Homo sapiens
  misc_feature 1..320: note = chr11:113345418-113345738
  misc_feature 1..320: note = hyper
  source 1..320: mol_type = genomic DNA
ggggaagtgccctcccgagattgtggggagcggcctccctcccgccctccgatgccgcggctccgccgtgctgccctgggcgccccgcggggaggctgccccagctgcgcccgctcgtgctcggggagaggattcccttctaagtggcgaggaggctactgagaaggagggagaggggatagcagccgcgggctccagacgccctctgcccccgcccgacggggagcccatgcagagccggatcccaggcgggcgctcccgagcaggcggccaggagtggccgcacaaacttctggtcctggcctcgctccccttggagg

SEQ ID NO: 11003 - DNA, 58 bp, Homo sapiens
  misc_feature 1..58: note = chr11:113346283-113346341
  misc_feature 1..58: note = hyper
  source 1..58: mol_type = genomic DNA
tcccttgttttgaggcgggaacgcaaccctcgaccgcccactgcgctcccacccacac

SEQ ID NO: 11004 - DNA, 120 bp, Homo sapiens
  misc_feature 1..120: note = chr11:113929618-113929738
  misc_feature 1..120: note = hyper
  source 1..120: mol_type = genomic DNA
ttggcctccagcaatcgcgacagctaaaaacgggtgtctcgcttcgacaatagatccccgcggaccttctggcacctggttcactagcgcccgcgaactctgcctcgggagacttattga

SEQ ID NO: 11005 - DNA, 352 bp, Homo sapiens
  misc_feature 1..352: note = chr11:113930374-113930726
  misc_feature 1..352: note = hyper
  source 1..352: mol_type = genomic DNA
ggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgcc

SEQ ID NO: 11006 - DNA, 46 bp, Homo sapiens
  misc_feature 1..46: note = chr11:113931651-113931697
  misc_feature 1..46: note = hyper
  source 1..46: mol_type = genomic DNA
tttgtgcttccccttcgccgcggggcgggtccgcctcccctgccgc

SEQ ID NO: 11007 - DNA, 510 bp, Homo sapiens
  misc_feature 1..510: note = chr11:115373899-115374409
  misc_feature 1..510: note = hyper
  source 1..510: mol_type = genomic DNA
gctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgccccccccgcggggccgggccggggaactttccccgcctggagccgggccaaaaagacccgcagcagagccgagggggcggagggctgcgaacggccggagggaaacacgagaggcgtgcagtttgggga

SEQ ID NO: 11008 - DNA, 38 bp, Homo sapiens; identical to SEQ ID NO: 993
  misc_feature 1..38: note = chr11:115530058-115530096
  misc_feature 1..38: note = hyper
  source 1..38: mol_type = genomic DNA

SEQ ID NO: 11009 - DNA, 201 bp, Homo sapiens; identical to SEQ ID NO: 994
  misc_feature 1..201: note = chr11:115530221-115530422
  misc_feature 1..201: note = hyper
  source 1..201: mol_type = genomic DNA

SEQ ID NO: 11010 - DNA, 50 bp, Homo sapiens; identical to SEQ ID NO: 3798
  misc_feature 1..50: note = chr11:115630424-115630474
  misc_feature 1..50: note = hyper
  source 1..50: mol_type = genomic DNA

SEQ ID NO: 11011 - DNA, 99 bp, Homo sapiens; identical to SEQ ID NO: 3799
  misc_feature 1..99: note = chr11:115630530-115630629
  misc_feature 1..99: note = hyper
  source 1..99: mol_type = genomic DNA

SEQ ID NO: 11012 - DNA, 259 bp, Homo sapiens; identical to SEQ ID NO: 3800
  misc_feature 1..259: note = chr11:115630630-115630889
  misc_feature 1..259: note = hyper
  source 1..259: mol_type = genomic DNA

SEQ ID NO: 11013 - DNA, 94 bp, Homo sapiens; identical to SEQ ID NO: 3801
  misc_feature 1..94: note = chr11:115630890-115630984
  misc_feature 1..94: note = hyper
  source 1..94: mol_type = genomic DNA

SEQ ID NO: 11014 - DNA, 57 bp, Homo sapiens; identical to SEQ ID NO: 3802
  misc_feature 1..57: note = chr11:115631307-115631364
  misc_feature 1..57: note = hyper
  source 1..57: mol_type = genomic DNA

SEQ ID NO: 11015 - DNA, 36 bp, Homo sapiens
  misc_feature 1..36: note = chr11:116706540-116706576
  misc_feature 1..36: note = hyper
  source 1..36: mol_type = genomic DNA
tcttagtgtactcctcgagagcgctcaggaagctga

SEQ ID NO: 11016 - DNA, 30 bp, Homo sapiens
  misc_feature 1..30: note = chr11:117667351-117667381
  misc_feature 1..30: note = hyper
  source 1..30: mol_type = genomic DNA
ctaggtcaagagtcacggcctgaggacccc

SEQ ID NO: 11017 - DNA, 40 bp, Homo sapiens
  misc_feature 1..40: note = chr11:117667865-117667905
  misc_feature 1..40: note = hyper
  source 1..40: mol_type = genomic DNA
cagcgcgctcccagccgcccgcactcggcgccccgctctc

SEQ ID NO: 11018 - DNA, 40 bp, Homo sapiens
  misc_feature 1..40: note = chr11:118663162-118663202
  misc_feature 1..40: note = hyper
  source 1..40: mol_type = genomic DNA
tgaagaaagtaggggcggaggaggccgggccctccactaa

SEQ ID NO: 11019 - DNA, 177 bp, Homo sapiens
  misc_feature 1..177: note = chr11:119210471-119210648
  misc_feature 1..177: note = hyper
  source 1..177: mol_type = genomic DNA
gcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgc

SEQ ID NO: 11020 - DNA, 32 bp, Homo sapiens
  misc_feature 1..32: note = chr11:119211201-119211233
  misc_feature 1..32: note = hyper
  source 1..32: mol_type = genomic DNA
ctctccccaccccggcgcggcccagtcggtcc

SEQ ID NO: 11021 - DNA, 33 bp, Homo sapiens
  misc_feature 1..33: note = chr11:119293352-119293385
  misc_feature 1..33: note = hyper
  source 1..33: mol_type = genomic DNA
cggcactgcggcttccttctcctccggtgcccc

SEQ ID NO: 11022 - DNA, 39 bp, Homo sapiens
  misc_feature 1..39: note = chr11:119293386-119293425
  misc_feature 1..39: note = hyper
  source 1..39: mol_type = genomic DNA
cacccagcccgccgcgaggtcacccggcagattccctct

SEQ ID NO: 11023 - DNA, 218 bp, Homo sapiens
  misc_feature 1..218: note = chr11:119293708-119293926
  misc_feature 1..218: note = hyper
  source 1..218: mol_type = genomic DNA
cccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggaga

SEQ ID NO: 11024 - DNA, 68 bp, Homo sapiens
  misc_feature 1..68: note = chr11:119612200-119612268
  misc_feature 1..68: note = hyper
  source 1..68: mol_type = genomic DNA
gtccctgtccttccccgtgtgggacctgcaaccgccccatagcgcagagtccgggaggctccagccac

SEQ ID NO: 11025 - DNA, 76 bp, Homo sapiens
  misc_feature 1..76: note = chr11:119612323-119612399
  misc_feature 1..76: note = hyper
  source 1..76: mol_type = genomic DNA
cgtacttttactggggtacggggagccctgccccacggctgtcagctcgggtcgggcgcgccgggtgcccaggagg

SEQ ID NO: 11026 - DNA, 86 bp, Homo sapiens
  misc_feature 1..86: note = chr11:119613014-119613100
  misc_feature 1..86: note = hyper
  source 1..86: mol_type = genomic DNA
ccgcgcctgacactccgcagggcccgggggtgggtgggcaggggtgcgagggggcgtggggctgggcgcgccggcctggggggaaa

SEQ ID NO: 11027 - DNA, 30 bp, Homo sapiens
  misc_feature 1..30: note = chr11:119613389-119613419
  misc_feature 1..30: note = hyper
  source 1..30: mol_type = genomic DNA
tgcagtaatgcatcacgggctgagggaggg

SEQ ID NO: 11028 - DNA, 48 bp, Homo sapiens
  misc_feature 1..48: note = chr11:119884295-119884343
  misc_feature 1..48: note = hyper
  source 1..48: mol_type = genomic DNA
aagttgtgctgctgccggtgctcggatggaccccggggagcagcagcc

SEQ ID NO: 11029 - DNA, 60 bp, Homo sapiens
  misc_feature 1..60: note = chr11:120110879-120110939
  misc_feature 1..60: note = hyper
  source 1..60: mol_type = genomic DNA
cccgggccggagcagcggagcgcgcgacagtggcggcgacggctccggcagcggctcccg

SEQ ID NO: 11030 - DNA, 35 bp, Homo sapiens
  misc_feature 1..35: note = chr11:120382869-120382904
  misc_feature 1..35: note = hyper
  source 1..35: mol_type = genomic DNA
ctccagtcttcaccccggtccgtctccctccctcc

SEQ ID NO: 11031 - DNA, 318 bp, Homo sapiens
  misc_feature 1..318: note = chr11:120435559-120435877
  misc_feature 1..318: note = hyper
  source 1..318: mol_type = genomic DNA
cgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctct

SEQ ID NO: 11032 - DNA, 92 bp, Homo sapiens
  misc_feature 1..92: note = chr11:121593544-121593636
  misc_feature 1..92: note = hyper
  source 1..92: mol_type = genomic DNA
tgaacgcgcacggcccgaccaggcttcccccaagctgctaagatttcatttcacctccgacaggcttcatggggactcgctgttaaaagatc

SEQ ID NO: 11033 - DNA, 588 bp, Homo sapiens; identical to SEQ ID NO: 3803
  misc_feature 1..588: note = chr11:122847170-122847758
  misc_feature 1..588: note = hyper
  source 1..588: mol_type = genomic DNA

SEQ ID NO: 11034 - DNA, 190 bp, Homo sapiens
  misc_feature 1..190: note = chr11:122848415-122848605
  misc_feature 1..190: note = hyper
  source 1..190: mol_type = genomic DNA
ctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatt

SEQ ID NO: 11035 - DNA, 323 bp, Homo sapiens; identical to SEQ ID NO: 995
  misc_feature 1..323: note = chr11:122849801-122850124
  misc_feature 1..323: note = hyper
  source 1..323: mol_type = genomic DNA

SEQ ID NO: 11036 - DNA, 232 bp, Homo sapiens; identical to SEQ ID NO: 996
  misc_feature 1..232: note = chr11:122850148-122850380
  misc_feature 1..232: note = hyper
  source 1..232: mol_type = genomic DNA

SEQ ID NO: 11037 - DNA, 308 bp, Homo sapiens; identical to SEQ ID NO: 997
  misc_feature 1..308: note = chr11:122850901-122851209
  misc_feature 1..308: note = hyper
  source 1..308: mol_type = genomic DNA

SEQ ID NO: 11038 - DNA, 177 bp, Homo sapiens
  misc_feature 1..177: note = chr11:122852438-122852615
  misc_feature 1..177: note = hyper
  source 1..177: mol_type = genomic DNA
gtctccaagcctgctcgaaagccggcaaccaccctccgaggctcgaatctccgctgctctctcccgggcctgggctaccccgggcgctggagaggcaagaagacaagctcctgggtaggttgggtctctgtgttggagaattggcagcttggagaggggggccgggagagccaatga

SEQ ID NO: 11039 - DNA, 114 bp, Homo sapiens
  misc_feature 1..114: note = chr11:122854915-122855029
  misc_feature 1..114: note = hyper
  source 1..114: mol_type = genomic DNA
ggccctgctctcaggcggagaagccaggagcgatgaggggcggggcggctcccggcgccctcttttccagccccgctcccgcgctgccgccggagagggactcggggcgcagcc

SEQ ID NO: 11040 - DNA, 18 bp, Homo sapiens
  misc_feature 1..18: note = chr11:122855030-122855048
  misc_feature 1..18: note = hyper
  source 1..18: mol_type = genomic DNA
ccccgcctctgccggggc

SEQ ID NO: 11041 - DNA, 200 bp, Homo sapiens
  misc_feature 1..200: note = chr11:123065544-123065744
  misc_feature 1..200: note = hyper
  source 1..200: mol_type = genomic DNA
aaccggcgtctttcccggacgcagggctgcgtttgcccacggccatccaaactcccgccctcccagaggcactcacctagcaagaggagaaggaggagggacatcccgatccccggacgcgggcgcttccccgctcagctgctgcttggctccggggcggccgggcgcctccgacggacctcgggcgagctgggcgcggc

SEQ ID NO: 11042 - DNA, 243 bp, Homo sapiens
  misc_feature 1..243: note = chr11:123172620-123172863
  misc_feature 1..243: note = hyper
  source 1..243: mol_type = genomic DNA
cggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaac

SEQ ID NO: 11043 - DNA, 24 bp, Homo sapiens
  misc_feature 1..24: note = chr11:123172915-123172939
  misc_feature 1..24: note = hyper
  source 1..24: mol_type = genomic DNA
cgtggttgacgaagccattccctc

SEQ ID NO: 11044 - DNA, 15 bp, Homo sapiens
  misc_feature 1..15: note = chr11:123228701-123228716
  misc_feature 1..15: note = hyper
  source 1..15: mol_type = genomic DNA
ctttccataccttcc

SEQ ID NO: 11045 - DNA, 392 bp, Homo sapiens; identical to SEQ ID NO: 999
  misc_feature 1..392: note = chr11:123228788-123229180
  misc_feature 1..392: note = hyper
  source 1..392: mol_type = genomic DNA

SEQ ID NO: 11046 - DNA, 226 bp, Homo sapiens; identical to SEQ ID NO: 1000
  misc_feature 1..226: note = chr11:123229181-123229407
  misc_feature 1..226: note = hyper
  source 1..226: mol_type = genomic DNA

SEQ ID NO: 11047 - DNA, 15 bp, Homo sapiens
  misc_feature 1..15: note = chr11:123301014-123301029
  misc_feature 1..15: note = hyper
  source 1..15: mol_type = genomic DNA
actgcctcttcctcc

SEQ ID NO: 11048 - DNA, 944 bp, Homo sapiens; identical to SEQ ID NO: 1002
  misc_feature 1..944: note = chr11:123301082-123302026
  misc_feature 1..944: note = hyper
  source 1..944: mol_type = genomic DNA

SEQ ID NO: 11049 - DNA, 41 bp, Homo sapiens
  misc_feature 1..41: note = chr11:123524936-123524977
  misc_feature 1..41: note = hyper
  source 1..41: mol_type = genomic DNA
tcgcctccccaggatcggttgcgttccgactggaatcctcc

SEQ ID NO: 11050 - DNA, 152 bp, Homo sapiens
  misc_feature 1..152: note = chr11:124631577-124631729
  misc_feature 1..152: note = hyper
  source 1..152: mol_type = genomic DNA
gcttgtatgtggggtcggggatgagagggggctagagttaagtccttaagctctttagccagtgtctcatctagcggctcagctcatccggctctgctgggtggggggtggggagtggacagggtgaggaatggttccgataactcacccca

SEQ ID NO: 11051 - DNA, 32 bp, Homo sapiens
  misc_feature 1..32: note = chr11:124709117-124709149
  misc_feature 1..32: note = hyper
  source 1..32: mol_type = genomic DNA
ctgcaaaccagaagacgcggcctgggaggggc

SEQ ID NO: 11052 - DNA, 126 bp, Homo sapiens
  misc_feature 1..126: note = chr11:124709539-124709665
  misc_feature 1..126: note = hyper
  source 1..126: mol_type = genomic DNA
ctgcacgcaggatcccgggctgggcaacggcctagaccgcctctcgccaaacctcccacgccagcgccagtccgacgaacaggagctggtccagcgaacaataaaaggccccggggctggggaggg

SEQ ID NO: 11053 - DNA, 49 bp, Homo sapiens
  misc_feature 1..49: note = chr11:124735054-124735103
  misc_feature 1..49: note = hyper
  source 1..49: mol_type = genomic DNA
acagggaaaatctctcgccgcgtccagaacggaacgctgggcttggggt

SEQ ID NO: 11054 - DNA, 487 bp, Homo sapiens
  misc_feature 1..487: note = chr11:124735437-124735924
  misc_feature 1..487: note = hyper
  source 1..487: mol_type = genomic DNA
cccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgg

SEQ ID NO: 11055 - DNA, 56 bp, Homo sapiens
  misc_feature 1..56: note = chr11:124736196-124736252
  misc_feature 1..56: note = hyper
  source 1..56: mol_type = genomic DNA
ccggcagagctgtggcgggcgggcggagctggcggcgaggtcgttaccgctaatta

SEQ ID NO: 11056 - DNA, 74 bp, Homo sapiens
  misc_feature 1..74: note = chr11:124738461-124738535
  misc_feature 1..74: note = hyper
  source 1..74: mol_type = genomic DNA
gatccctctactaaccggcctgtctgtaggcatcttcctttgagacgaggaacgcggaacgtctgccaataagg

SEQ ID NO: 11057 - DNA, 254 bp, Homo sapiens
  misc_feature 1..254: note = chr11:124738755-124739009
  misc_feature 1..254: note = hyper
  source 1..254: mol_type = genomic DNA
gctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcct

SEQ ID NO: 11058 - DNA, 204 bp, Homo sapiens
  misc_feature 1..204: note = chr11:124933444-124933648
  misc_feature 1..204: note = hyper
  source 1..204: mol_type = genomic DNA
ggggggacttggtcccgagctcctccagcggcgcccgcctcggaggttgataaccctccctgcccaactccgcccgcgctcccccagaccccgcgacgctggctcggtgacactggggaagaacaggctgccagggagggtctccatcgtttcccgtttccatcctcccctcctaacacacatccggggcgccttcagagcgcc

SEQ ID NO: 11059 - DNA, 528 bp, Homo sapiens
  misc_feature 1..528: note = chr11:125035692-125036220
  misc_feature 1..528: note = hyper
  source 1..528: mol_type = genomic DNA
agagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttg

SEQ ID NO: 11060 - DNA, 220 bp, Homo sapiens
  misc_feature 1..220: note = chr11:125365065-125365285
  misc_feature 1..220: note = hyper
  source 1..220: mol_type = genomic DNA
ctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacct

SEQ ID NO: 11061 - DNA, 197 bp, Homo sapiens
  misc_feature 1..197: note = chr11:125365752-125365949
  misc_feature 1..197: note = hyper
  source 1..197: mol_type = genomic DNA
tgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttacc

SEQ ID NO: 11062 - DNA, 125 bp, Homo sapiens
  misc_feature 1..125: note = chr11:125366167-125366292
  misc_feature 1..125: note = hyper
  source 1..125: mol_type = genomic DNA
gcccggctccgctcccgcctccaccccaccccttccccgcgctcgtgcccgggctccgggggcgcgcccgcgctcgggcacccacccaactggcacgcgcgggagctggacgtcatcccctcgtt

SEQ ID NO: 11063 - DNA, 181 bp, Homo sapiens; identical to SEQ ID NO: 1003
  misc_feature 1..181: note = chr11:125773880-125774061
  misc_feature 1..181: note = hyper
  source 1..181: mol_type = genomic DNA

SEQ ID NO: 11064 - DNA, 312 bp, Homo sapiens; identical to SEQ ID NO: 1004
  misc_feature 1..312: note = chr11:125774122-125774434
  misc_feature 1..312: note = hyper
  source 1..312: mol_type = genomic DNA

SEQ ID NO: 11065 - DNA, 15 bp, Homo sapiens
  misc_feature 1..15: note = chr11:126870486-126870501
  misc_feature 1..15: note = hyper
  source 1..15: mol_type = genomic DNA
ctccgccggtcctct

SEQ ID NO: 11066 - DNA, 113 bp, Homo sapiens
  misc_feature 1..113: note = chr11:126870524-126870637
  misc_feature 1..113: note = hyper
  source 1..113: mol_type = genomic DNA
cgtccgtgggtccctccgggtggcttcggtctctttgtgcctctgggtatctgcagccagccgacacaaactgcctgttcttagccgcctcgggaagccgggattgtcagcaa

SEQ ID NO: 11067 - DNA, 207 bp, Homo sapiens
  misc_feature 1..207: note = chr11:126873186-126873393
  misc_feature 1..207: note = hyper
  source 1..207: mol_type = genomic DNA
cctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagagggga

SEQ ID NO: 11068 - DNA, 65 bp, Homo sapiens
  misc_feature 1..65: note = chr11:126873727-126873792
  misc_feature 1..65: note = hyper
  source 1..65: mol_type = genomic DNA
ccccacctccgccagcggggcgagccggagctgggtgacccagaccctcgcggaggcgggagcct

SEQ ID NO: 11069 - DNA, 64 bp, Homo sapiens
  misc_feature 1..64: note = chr11:128556994-128557058
  misc_feature 1..64: note = hyper
  source 1..64: mol_type = genomic DNA
ctgtttgcatgtgggcgtgtgtatgtggggttgtgtgcgggtatgcgggcgccacgcgcttctc

SEQ ID NO: 11070 - DNA, 330 bp, Homo sapiens; identical to SEQ ID NO: 3814
  misc_feature 1..330: note = chr11:128562856-128563186
  misc_feature 1..330: note = hyper
  source 1..330: mol_type = genomic DNA

SEQ ID NO: 11071 - DNA, 37 bp, Homo sapiens; identical to SEQ ID NO: 3815
  misc_feature 1..37: note = chr11:128563336-128563373
  misc_feature 1..37: note = hyper
  source 1..37: mol_type = genomic DNA

SEQ ID NO: 11072 - DNA, 167 bp, Homo sapiens; identical to SEQ ID NO: 3816
  misc_feature 1..167: note = chr11:128563669-128563836
  misc_feature 1..167: note = hyper
  source 1..167: mol_type = genomic DNA

SEQ ID NO: 11073 - DNA, 500 bp, Homo sapiens; identical to SEQ ID NO: 3817
  misc_feature 1..500: note = chr11:128563896-128564396
  misc_feature 1..500: note = hyper
  source 1..500: mol_type = genomic DNA

SEQ ID NO: 11074 - DNA, 189 bp, Homo sapiens; identical to SEQ ID NO: 1005
  misc_feature 1..189: note = chr11:128564685-128564874
  misc_feature 1..189: note = hyper
  source 1..189: mol_type = genomic DNA

SEQ ID NO: 11075 - skipped

SEQ ID NO: 11076 - DNA, 308 bp, Homo sapiens; identical to SEQ ID NO: 1007
  misc_feature 1..308: note = chr11:128564991-128565299
  misc_feature 1..308: note = hyper
  source 1..308: mol_type = genomic DNA

SEQ ID NO: 11077 - DNA, 459 bp, Homo sapiens; identical to SEQ ID NO: 1008
  misc_feature 1..459: note = chr11:129242783-129243242
  misc_feature 1..459: note = hyper
  source 1..459: mol_type = genomic DNA

SEQ ID NO: 11078 - DNA, 350 bp, Homo sapiens; identical to SEQ ID NO: 1009
  misc_feature 1..350: note = chr11:129243304-129243654
  misc_feature 1..350: note = hyper
  source 1..350: mol_type = genomic DNA

SEQ ID NO: 11079 - DNA, 347 bp, Homo sapiens; identical to SEQ ID NO: 1010
  misc_feature 1..347: note = chr11:129243954-129244301
  misc_feature 1..347: note = hyper
  source 1..347: mol_type = genomic DNA

SEQ ID NO: 11080 - DNA, 204 bp, Homo sapiens; identical to SEQ ID NO: 1011
  misc_feature 1..204: note = chr11:129244440-129244644
  misc_feature 1..204: note = hyper
  source 1..204: mol_type = genomic DNA

SEQ ID NO: 11081 - DNA, 203 bp, Homo sapiens; identical to SEQ ID NO: 1012
  misc_feature 1..203: note = chr11:131780876-131781079
  misc_feature 1..203: note = hyper
  source 1..203: mol_type = genomic DNA

SEQ ID NO: 11082 - DNA, 43 bp, Homo sapiens
  misc_feature 1..43: note = chr11:132813715-132813758
  misc_feature 1..43: note = hyper
  source 1..43: mol_type = genomic DNA
ggacgcggcacgagacgcggggacgcgcggacgccacgctcag

SEQ ID NO: 11083 - DNA, 32 bp, Homo sapiens
  misc_feature 1..32: note = chr11:132864177-132864209
  misc_feature 1..32: note = hyper
  source 1..32: mol_type = genomic DNA
attaaaaagcccaggcgcgattttctaattaa

SEQ ID NO: 11084 - DNA, 41 bp, Homo sapiens
  misc_feature 1..41: note = chr11:132934044-132934085
  misc_feature 1..41: note = hyper
  source 1..41: mol_type = genomic DNA
gagtgaggggtggagcggagcccagccgagggagggaagga

SEQ ID NO: 11085 - DNA, 83 bp, Homo sapiens
  misc_feature 1..83: note = chr11:132934490-132934573
  misc_feature 1..83: note = hyper
  source 1..83: mol_type = genomic DNA
gcctgaattcttgtccgggtgggactggcctcggtgaaggatccgggaatgggacttccgggccgggccggaggggaagtgtc

SEQ ID NO: 11086 - DNA, 449 bp, Homo sapiens; identical to SEQ ID NO: 1013
  misc_feature 1..449: note = chr11:132952552-132953001
  misc_feature 1..449: note = hyper
  source 1..449: mol_type = genomic DNA

SEQ ID NO: 11087 - DNA, 30 bp, Homo sapiens
  misc_feature 1..30: note = chr11:132953290-132953320
  misc_feature 1..30: note = hyper
  source 1..30: mol_type = genomic DNA
tcgggtcgctggctgcggagagggctggcc

SEQ ID NO: 11088 - DNA, 122 bp, Homo sapiens
  misc_feature 1..122: note = chr11:133402168-133402290
  misc_feature 1..122: note = hyper
  source 1..122: mol_type = genomic DNA
gagcagggcagttgtcgccgagaagacgacccagtaggcaggatggtacatctcgacgctgcggtgctctcagctgccgggcttgctactgcttctgctgctgctaccgctgctgccttcct

SEQ ID NO: 11089 - DNA, 263 bp, Homo sapiens; identical to SEQ ID NO: 3827
  misc_feature 1..263: note = chr11:133825226-133825489
  misc_feature 1..263: note = hyper
  source 1..263: mol_type = genomic DNA

SEQ ID NO: 11090 - DNA, 126 bp, Homo sapiens
  misc_feature 1..126: note = chr11:133826138-133826264
  misc_feature 1..126: note = hyper
  source 1..126: mol_type = genomic DNA
gcgcctccctgcaggcgctcctcgcggcgcggggctctagcgtgctgcagcctgcccggagaccgcaaactcccgcagccagagtttcccgcagctctgggaggcggccgccgggcaggaggcgac

SEQ ID NO: 11091 - DNA, 80 bp, Homo sapiens
  misc_feature 1..80: note = chr11:133826978-133827058
  misc_feature 1..80: note = hyper
  source 1..80: mol_type = genomic DNA
gctcagccttccgcccgtcgcggcgcgaaggaggcgagcccatttcaaggtgcgttgaagtgtggcgagcacagagccgc

SEQ ID NO: 11092 - DNA, 151 bp, Homo sapiens; identical to SEQ ID NO: 3828
  misc_feature 1..151: note = chr11:133906799-133906950
  misc_feature 1..151: note = hyper
  source 1..151: mol_type = genomic DNA

SEQ ID NO: 11093 - DNA, 16 bp, Homo sapiens
  misc_feature 1..16: note = chr11:133938772-133938788
  misc_feature 1..16: note = hyper
  source 1..16: mol_type = genomic DNA
agagaacccatgtgcc

SEQ ID NO: 11094 - DNA, 275 bp, Homo sapiens; identical to SEQ ID NO: 3830
  misc_feature 1..275: note = chr11:133938789-133939064
  misc_feature 1..275: note = hyper
  source 1..275: mol_type = genomic DNA

SEQ ID NO: 11095 - DNA, 316 bp, Homo sapiens; identical to SEQ ID NO: 3831
  misc_feature 1..316: note = chr11:133939065-133939381
  misc_feature 1..316: note = hyper
  source 1..316: mol_type = genomic DNA

SEQ ID NO: 11096 - DNA, 44 bp, Homo sapiens
  misc_feature 1..44: note = chr11:133994700-133994744
  misc_feature 1..44: note = hyper
  source 1..44: mol_type = genomic DNA
gcttgtcagcgaaaacgctgtgctgagcccggcagaagtctgcc

SEQ ID NO: 11097 - DNA, 774 bp, Homo sapiens; identical to SEQ ID NO: 1014
  misc_feature 1..774: note = chr11:134145653-134146427
  misc_feature 1..774: note = hyper
  source 1..774: mol_type = genomic DNA

SEQ ID NO: 11098 - DNA, 232 bp, Homo sapiens; identical to SEQ ID NO: 1015
  misc_feature 1..232: note = chr11:134146444-134146676
  misc_feature 1..232: note = hyper
  source 1..232: mol_type = genomic DNA

SEQ ID NO: 11099 - DNA, 217 bp, Homo sapiens; identical to SEQ ID NO: 1016
  misc_feature 1..217: note = chr11:134146677-134146894
  misc_feature 1..217: note = hyper
  source 1..217: mol_type = genomic DNA

SEQ ID NO: 11100 - DNA, 279 bp, Homo sapiens
  misc_feature 1..279: note = chr11:134201829-134202108
  misc_feature 1..279: note = hyper
  source 1..279: mol_type = genomic DNA
tgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggtgagagagagcttcgcgcagcacctgccggaccccacattccccagccctccgcacctcgggttct

SEQ ID NO: 11101 - DNA, 97 bp, Homo sapiens
  misc_feature 1..97: note = chr11:134281434-134281531
  misc_feature 1..97: note = hyper
  source 1..97: mol_type = genomic DNA
ctcttcccctaatcccggtcgacgagggcaggctgtgccgggttttgtttcgcagcccctcggcagcagcgcctcccagcccgagctcggttctcgg

SEQ ID NO: 11102 - DNA, 52 bp, Homo sapiens
  misc_feature 1..52: note = chr11:134281591-134281643
  misc_feature 1..52: note = hyper
  source 1..52: mol_type = genomic DNA
acacacaccccagcgcgcgcccgggaggacatggcgtgggcaccgatgggga

SEQ ID NO: 11103 - DNA, 70 bp, Homo sapiens
  misc_feature 1..70: note = chr11:134282862-134282932
  misc_feature 1..70: note = hyper
  source 1..70: mol_type = genomic DNA
ccgcggtgtgttggtcggcgggggacggaggccagtgagtgggcgcgcacttggacgtatgtgggtgcac

SEQ ID NO: 11104 - DNA, 32 bp, Homo sapiens
  misc_feature 1..32: note = chr12:1059315-1059347
  misc_feature 1..32: note = hyper
  source 1..32: mol_type = genomic DNA
ggacctggtggttctcgcggcctctcaccacc

SEQ ID NO: 11105 - DNA, 244 bp, Homo sapiens; identical to SEQ ID NO: 3835
  misc_feature 1..244: note = chr12:1639107-1639351
  misc_feature 1..244: note = hyper
  source 1..244: mol_type = genomic DNA

SEQ ID NO: 11106 - DNA, 197 bp, Homo sapiens
  misc_feature 1..197: note = chr12:2161529-2161726
  misc_feature 1..197: note = hyper
  source 1..197: mol_type = genomic DNA
gatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggc

SEQ ID NO: 11107 - DNA, 285 bp, Homo sapiens; identical to SEQ ID NO: 3836
  misc_feature 1..285: note = chr12:2162554-2162839
  misc_feature 1..285: note = hyper
  source 1..285: mol_type = genomic DNA

SEQ ID NO: 11108 - DNA, 400 bp, Homo sapiens; identical to SEQ ID NO: 3837
  misc_feature 1..400: note = chr12:2163110-2163510
  misc_feature 1..400: note = hyper
  source 1..400: mol_type = genomic DNA

SEQ ID NO: 11109 - DNA, 39 bp, Homo sapiens
  misc_feature 1..39: note = chr12:2800124-2800163
  misc_feature 1..39: note = hyper
  source 1..39: mol_type = genomic DNA
cacccaggagctggccgacgcctgcgacatgaccataga

SEQ ID NO: 11110 - DNA, 112 bp, Homo sapiens
  misc_feature 1..112: note = chr12:2862031-2862143
  misc_feature 1..112: note = hyper
  source 1..112: mol_type = genomic DNA
ggcccccagtggcaacggtgagagcagtggcccagaaggccagtaccgggaacgacgatggcgggcacaagggtgggcttgcagcagctgctgctggtgctcccacaggctg

SEQ ID NO: 11111 - DNA, 30 bp, Homo sapiens
  misc_feature 1..30: note = chr12:2862442-2862472
  misc_feature 1..30: note = hyper
  source 1..30: mol_type = genomic DNA
gtcacacactcaccacggggagaggccgcg

SEQ ID NO: 11112 - DNA, 53 bp, Homo sapiens
  misc_feature 1..53: note = chr12:3475605-3475658
  misc_feature 1..53: note = hyper
  source 1..53: mol_type = genomic DNA
gctttcaaacctccccgcgctccgcagcccccagcccccgccctacccgccct

SEQ ID NO: 11113 - DNA, 61 bp, Homo sapiens; identical to SEQ ID NO: 3838
  misc_feature 1..61: note = chr12:3600168-3600229
  misc_feature 1..61: note = hyper
  source 1..61: mol_type = genomic DNA

SEQ ID NO: 11114 - DNA, 115 bp, Homo sapiens; identical to SEQ ID NO: 3839
  misc_feature 1..115: note = chr12:3600230-3600345
  misc_feature 1..115: note = hyper
  source 1..115: mol_type = genomic DNA

SEQ ID NO: 11115 - DNA, 15 bp, Homo sapiens
  misc_feature 1..15: note = chr12:3600768-3600783
  misc_feature 1..15: note = hyper
  source 1..15: mol_type = genomic DNA
tcaccaaacccttgc

SEQ ID NO: 11116 - DNA, 30 bp, Homo sapiens
  misc_feature 1..30: note = chr12:3601542-3601572
  misc_feature 1..30: note = hyper
  source 1..30: mol_type = genomic DNA
cagcaccagggacagcgtccgcccctgcag

SEQ ID NO: 11117 - DNA, 555 bp, Homo sapiens; identical to SEQ ID NO: 3840
  misc_feature 1..555: note = chr12:3602162-3602717
  misc_feature 1..555: note = hyper
  source 1..555: mol_type = genomic DNA

SEQ ID NO: 11118 - DNA, 15 bp, Homo sapiens
  misc_feature 1..15: note = chr12:3602864-3602879
  misc_feature 1..15: note = hyper
  source 1..15: mol_type = genomic DNA
cgctcccccttctca

SEQ ID NO: 11119 - DNA, 335 bp, Homo sapiens; identical to SEQ ID NO: 1017
  misc_feature 1..335: note = chr12:4274054-4274389
  misc_feature 1..335: note = hyper
  source 1..335: mol_type = genomic DNA

SEQ ID NO: 11120 - DNA, 547 bp, Homo sapiens
  misc_feature 1..547: note = chr12:4377981-4378528
  misc_feature 1..547: note = hyper
  source 1..547: mol_type = genomic DNA
gcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgc

SEQ ID NO: 11121 - DNA, 929 bp, Homo sapiens
  misc_feature 1..929: note = chr12:4378806-4379735
  misc_feature 1..929: note = hyper
  source 1..929: mol_type = genomic DNA
agagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatca

SEQ ID NO: 11122 - DNA, 288 bp, Homo sapiens
  misc_feature 1..288: note = chr12:4383699-4383987
  misc_feature 1..288: note = hyper
  source 1..288: mol_type = genomic DNA
gcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctc

SEQ ID NO: 11123 - DNA, 808 bp, Homo sapiens; identical to SEQ ID NO: 1018
  misc_feature 1..808: note = chr12:5017990-5018798
  misc_feature 1..808: note = hyper
  source 1..808: mol_type = genomic DNA

SEQ ID NO: 11124 - skipped

SEQ ID NO: 11125 - DNA, 229 bp, Homo sapiens; identical to SEQ ID NO: 1020
  misc_feature 1..229: note = chr12:5018806-5019035
  misc_feature 1..229: note = hyper
  source 1..229: mol_type = genomic DNA

SEQ ID NO: 11126 - DNA, 659 bp, Homo sapiens; identical to SEQ ID NO: 1021
  misc_feature 1..659: note = chr12:5019084-5019743
  misc_feature 1..659: note = hyper
  source 1..659: mol_type = genomic DNA

SEQ ID NO: 11127 - DNA, 397 bp, Homo sapiens; identical to SEQ ID NO: 1022
  misc_feature 1..397: note = chr12:5019793-5020190
  misc_feature 1..397: note = hyper
  source 1..397: mol_type = genomic DNA

SEQ ID NO: 11128 - DNA, 94 bp, Homo sapiens
  misc_feature 1..94: note = chr12:5153193-5153287
  misc_feature 1..94: note = hyper
  source 1..94: mol_type = genomic DNA
tccccagagaggggccggccgaccgctggagcggagcctgacgccaggcgcccgcggagcgtgagtagggggcgcgggagccggtcagctgggg

SEQ ID NO: 11129 - DNA, 104 bp, Homo sapiens
  misc_feature 1..104: note = chr12:5153357-5153461
  misc_feature 1..104: note = hyper
  source 1..104: mol_type = genomic DNA
cgtcagaggaggcgatgaggcccgggcaggctgcggccaggccacagggggagagctccagtgtcccccgacggctgggctcagcgatgggcccaaggagccgg

SEQ ID NO: 11130 - DNA, 35 bp, Homo sapiens
  misc_feature 1..35: note = chr12:5541088-5541123
  misc_feature 1..35: note = hyper
  source 1..35: mol_type = genomic DNA
aaatgaccccttccccgccacgggtcccgaagtga

SEQ ID NO: 11131 - DNA, 146 bp, Homo sapiens
  misc_feature 1..146: note = chr12:5541504-5541650
  misc_feature 1..146: note = hyper
  source 1..146: mol_type = genomic DNA
cacggtaaggggaggcggcgggcaccttgggtgggcaggtttggggatgggggtccacgtggggagggattttccagtggactggtgcggggggccccagatccgcatcccgccccacccccatcgcgccgcgctcactcactttc

SEQ ID NO: 11132 - DNA, 712 bp, Homo sapiens; identical to SEQ ID NO: 3848
  misc_feature 1..712: note = chr12:5542090-5542802
  misc_feature 1..712: note = hyper
  source 1..712: mol_type = genomic DNA

SEQ ID NO: 11133 - DNA, 153 bp, Homo sapiens; identical to SEQ ID NO: 3849
  misc_feature 1..153: note = chr12:6664370-6664523
  misc_feature 1..153: note = hyper
  source 1..153: mol_type = genomic DNA

SEQ ID NO: 11134 - DNA, 32 bp, Homo sapiens
  misc_feature 1..32: note = chr12:8123148-8123180
  misc_feature 1..32: note = hyper
  source 1..32: mol_type = genomic DNA
tctccctttcttgcactcgtctttatcttcta

SEQ ID NO: 11135 - DNA, 424 bp, Homo sapiens; identical to SEQ ID NO: 3850
  misc_feature 1..424: note = chr12:8171321-8171745
  misc_feature 1..424: note = hyper
  source 1..424: mol_type = genomic DNA

SEQ ID NO: 11136 - DNA, 57 bp, Homo sapiens
  misc_feature 1..57: note = chr12:10306356-10306413
  misc_feature 1..57: note = hyper
  source 1..57: mol_type = genomic DNA
cccagccagcacatccgccatcctgcaccccaggttccggcacgggctgcgacgggg

SEQ ID NO: 11137 - DNA, 48 bp, Homo sapiens
  misc_feature 1..48: note = chr12:11653509-11653557
  misc_feature 1..48: note = hyper
  source 1..48: mol_type = genomic DNA
cgacgagctggagcggcggctgaacgagctgagcgcctagaatcgcag

SEQ ID NO: 11138 - DNA, 30 bp, Homo sapiens
  misc_feature 1..30: note = chr12:11653758-11653788
  misc_feature 1..30: note = hyper
  source 1..30: mol_type = genomic DNA
gctcctggcgcaacccgagccagaccctgg

SEQ ID NO: 11139 - DNA, 30 bp, Homo sapiens
  misc_feature 1..30: note = chr12:12869188-12869218
  misc_feature 1..30: note = hyper
  source 1..30: mol_type = genomic DNA
tctggagtttgaccccgaggggagtatttt

SEQ ID NO: 11140 - DNA, 49 bp, Homo sapiens
  misc_feature 1..49: note = chr12:13154617-13154666
  misc_feature 1..49: note = hyper
  source 1..49: mol_type = genomic DNA
cctgggacgcaaccccgggcaatgcctccggccgcggggagcaaatcaa

SEQ ID NO: 11141 - DNA, 68 bp, Homo sapiens; identical to SEQ ID NO: 1023
  misc_feature 1..68: note = chr12:14133813-14133881
  misc_feature 1..68: note = hyper
  source 1..68: mol_type = genomic DNA

SEQ ID NO: 11142 - DNA, 50 bp, Homo sapiens
  misc_feature 1..50: note = chr12:14134167-14134217
  misc_feature 1..50: note = hyper
  source 1..50: mol_type = genomic DNA
acctcatgccagattcgttcacgatttcacggcttcgaccctttatctgc

SEQ ID NO: 11143 - DNA, 777 bp, Homo sapiens; identical to SEQ ID NO: 3852
  misc_feature 1..777: note = chr12:14134478-14135255
  misc_feature 1..777: note = hyper
  source 1..777: mol_type = genomic DNA

SEQ ID NO: 11144 - DNA, 218 bp, Homo sapiens
  misc_feature 1..218: note = chr12:15374309-15374527
  misc_feature 1..218: note = hyper
  source 1..218: mol_type = genomic DNA
ctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttcccttttt

SEQ ID NO: 11145 - DNA, 30 bp, Homo sapiens
  misc_feature 1..30: note = chr12:16500494-16500524
  misc_feature 1..30: note = hyper
  source 1..30: mol_type = genomic DNA
gggtcgggctttaaacgtgggagggctaat

SEQ ID NO: 11146 - DNA, 107 bp, Homo sapiens
  misc_feature 1..107: note = chr12:16757928-16758035
  misc_feature 1..107: note = hyper
  source 1..107: mol_type = genomic DNA
gtgcgcagcctacaccgccgaggaccgactattgtgaagccactttgggagcgggtcggagtggcggcagggggtgggggaagggatgaggacggccagacaagaca

SEQ ID NO: 11147 - DNA, 39 bp, Homo sapiens
  misc_feature 1..39: note = chr12:20521231-20521270
  misc_feature 1..39: note = hyper
  source 1..39: mol_type = genomic DNA
cttaaagaaagaaagcggaattgtcgatcactccagttg

SEQ ID NO: 11148 - DNA, 45 bp, Homo sapiens
  misc_feature 1..45: note = chr12:20521792-20521837
  misc_feature 1..45: note = hyper
  source 1..45: mol_type = genomic DNA
ccccggctcctccagcgtcagcggctcctgcgcgcgggatgcatt

SEQ ID NO: 11149 - DNA, 124 bp, Homo sapiens
  misc_feature 1..124: note = chr12:20522363-20522487
  misc_feature 1..124: note = hyper
  source 1..124: mol_type = genomic DNA
acctggtgctgcagccgctccggagctctcggaaactttcctccgcgctgtgcgcgggctccctgtcctttctgctggcgctgctggtgaggctggtccgcggggaggtcggctgtgacctgga

SEQ ID NO: 11150 - DNA, 33 bp, Homo sapiens
  misc_feature 1..33: note = chr12:20522739-20522772
  misc_feature 1..33: note = hyper
  source 1..33: mol_type = genomic DNA
ccagattgggctgggcgtcggggaggatcactt

SEQ ID NO: 11151 - DNA, 585 bp, Homo sapiens
  misc_feature 1..585: note = chr12:21680435-21681020
  misc_feature 1..585: note = hyper
  source 1..585: mol_type = genomic DNA
gcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 11152 - DNA, 85 bp, Homo sapiens
  misc_feature 1..85: note = chr12:21927273-21927358
  misc_feature 1..85: note = hyper
  source 1..85: mol_type = genomic DNA
tttttttttttacaacgaaggaatcaaatatacaaggtgcgggggggaaaaaacccaagacaacagcctgcgggttgcagtaggg

SEQ ID NO: 11153 - DNA, 30 bp, Homo sapiens
  misc_feature 1..30: note = chr12:21927922-21927952
  misc_feature 1..30: note = hyper
  source 1..30: mol_type = genomic DNA
cgacccgggggagggcgggacctgcagagc

SEQ ID NO: 11154 - DNA, 71 bp, Homo sapiens; identical to SEQ ID NO: 1024
  misc_feature 1..71: note = chr12:22093889-22093960
  misc_feature 1..71: note = hyper
  source 1..71: mol_type = genomic DNA

SEQ ID NO: 11155 - DNA, 308 bp, Homo sapiens; identical to SEQ ID NO: 1025
  misc_feature 1..308: note = chr12:22093961-22094269
  misc_feature 1..308: note = hyper
  source 1..308: mol_type = genomic DNA

SEQ ID NO: 11156 - DNA, 471 bp, Homo sapiens; identical to SEQ ID NO: 1026
  misc_feature 1..471: note = chr12:22094577-22095048
  misc_feature 1..471: note = hyper
  source 1..471: mol_type = genomic DNA

SEQ ID NO: 11157 - DNA, 83 bp, Homo sapiens; identical to SEQ ID NO: 1027
  misc_feature 1..83: note = chr12:22486799-22486882
  misc_feature 1..83: note = hyper
  source 1..83: mol_type = genomic DNA

SEQ ID NO: 11158 - DNA, 300 bp, Homo sapiens; identical to SEQ ID NO: 1028
  misc_feature 1..300: note = chr12:22487133-22487433
  misc_feature 1..300: note = hyper
  source 1..300: mol_type = genomic DNA

SEQ ID NO: 11159 - DNA, 575 bp, Homo sapiens
  misc_feature 1..575: note = chr12:22487691-22488266
  misc_feature 1..575: note = hyper
  source 1..575: mol_type = genomic DNA
ccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgcgcgc

SEQ ID NO: 11160 - DNA, 322 bp, Homo sapiens
  misc_feature 1..322: note = chr12:22488339-22488661
  misc_feature 1..322: note = hyper
  source 1..322: mol_type = genomic DNA
cgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagc

SEQ ID NO: 11161 - DNA, 92 bp, Homo sapiens
  misc_feature 1..92: note = chr12:24714812-24714904
  misc_feature 1..92: note = hyper
  source 1..92: mol_type = genomic DNA
gccttggacattggccgcgatgcccagcacagcccagggttctccccgcactctcctctcgcatcaaccacctccaccgccaccacttacaa

SEQ ID NO: 11162 - DNA, 30 bp, Homo sapiens
  misc_feature 1..30: note = chr12:24715353-24715383
  misc_feature 1..30: note = hyper
  source 1..30: mol_type = genomic DNA
tgggttttggtggctcgcctttttcactct

SEQ ID NO: 11163 - DNA, 172 bp, Homo sapiens
  misc_feature 1..172: note = chr12:24716032-24716204
  misc_feature 1..172: note = hyper
  source 1..172: mol_type = genomic DNA
ttgtcaacttcttcccggcgcctgagcctcagccgctgctctgcgcccaggacctggcccctcccggccccctagtccagtggtcaggcggtcgggccggcagggagggcgcgcgcggggggctgcggggtccgtggaacctttccgggaggcgagccgcgggctgctgggc

SEQ ID NO: 11164 - DNA, 212 bp, Homo sapiens
  misc_feature 1..212: note = chr12:24716205-24716417
  misc_feature 1..212: note = hyper
  source 1..212: mol_type = genomic DNA
cggaggctggagccgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggtggttgaactggtttggttttgtgttaagcgaagccaaaaaaaa

SEQ ID NO: 11165 - DNA, 194 bp, Homo sapiens; identical to SEQ ID NO: 3858
  misc_feature 1..194: note = chr12:25056242-25056436
  misc_feature 1..194: note = hyper
  source 1..194: mol_type = genomic DNA

SEQ ID NO: 11166 - DNA, 601 bp, Homo sapiens; identical to SEQ ID NO: 3859
  misc_feature 1..601: note = chr12:25101397-25101998
  misc_feature 1..601: note = hyper
  source 1..601: mol_type = genomic DNA

SEQ ID NO: 11167 - DNA, 77 bp, Homo sapiens; identical to SEQ ID NO: 3860
  misc_feature 1..77: note = chr12:25102009-25102086
  misc_feature 1..77: note = hyper
  source 1..77: mol_type = genomic DNA

SEQ ID NO: 11168 - DNA, 219 bp, Homo sapiens
  misc_feature 1..219: note = chr12:28122168-28122387
  misc_feature 1..219: note = hyper
  source 1..219: mol_type = genomic DNA
cccgggctcaggccccggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcagga

SEQ ID NO: 11169 - DNA, 392 bp, Homo sapiens
  misc_feature 1..392: note = chr12:28127822-28128214
  misc_feature 1..392: note = hyper
  source 1..392: mol_type = genomic DNA
attaggaagctgatccgcagggacggggcaggcttggctcctggggatcttaggctccatgggaacttcgggggtctcggggcccgtgagcggatctagctactacttcccctaggttctcctcgggcttcagtccctaagagtctggactccggactgccgcacagaatccttcttgcccggagcggtattattgaggtctttgcgttctgccccgccctgtcccgccggcttgggtgcttggtttctaacccgagtatactcggagtctctggtcctgcgcgcccccctcctcccgggagagccccgtatctggctgcgggtaagggaaaacttcgggaaccccgagacccaaggacagggtcggagggagcgcgcgaacttcctctgag

SEQ ID NO: 11170 - DNA, 372 bp, Homo sapiens; identical to SEQ ID NO: 3861
  misc_feature 1..372: note = chr12:28128699-28129071
  misc_feature 1..372: note = hyper
  source 1..372: mol_type = genomic DNA

SEQ ID NO: 11171 - DNA, 236 bp, Homo sapiens
  misc_feature 1..236: note = chr12:29937107-29937343
  misc_feature 1..236: note = hyper
  source 1..236: mol_type = genomic DNA
ctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgc

SEQ ID NO: 11172 - DNA, 58 bp, Homo sapiens
  misc_feature 1..58: note = chr12:29937344-29937402
  misc_feature 1..58: note = hyper
  source 1..58: mol_type = genomic DNA
ctcgcgtccagtcgccggctctgtgctctcctgcccgggctttctctcacccgcccgg

SEQ ID NO: 11173 - DNA, 23 bp, Homo sapiens
  misc_feature 1..23: note = chr12:30322902-30322925
  misc_feature 1..23: note = hyper
  source 1..23: mol_type = genomic DNA
cccagcagagcgaggcgctgggc

SEQ ID NO: 11174 - DNA, 426 bp, Homo sapiens; identical to SEQ ID NO: 3863
  misc_feature 1..426: note = chr12:30323014-30323440
  misc_feature 1..426: note = hyper
  source 1..426: mol_type = genomic DNA

SEQ ID NO: 11175 - DNA, 24 bp, Homo sapiens
  misc_feature 1..24: note = chr12:30323502-30323526
  misc_feature 1..24: note = hyper
  source 1..24: mol_type = genomic DNA
cgccagcttcgtgatcttctgccc

SEQ ID NO: 11176 - DNA, 533 bp, Homo sapiens; identical to SEQ ID NO: 3865
  misc_feature 1..533: note = chr12:30975388-30975921
  misc_feature 1..533: note = hyper
  source 1..533: mol_type = genomic DNA

SEQ ID NO: 11177 - DNA, 100 bp, Homo sapiens; identical to SEQ ID NO: 3866
  misc_feature 1..100: note = chr12:31079268-31079368
  misc_feature 1..100: note = hyper
  source 1..100: mol_type = genomic DNA

SEQ ID NO: 11178 - DNA, 247 bp, Homo sapiens; identical to SEQ ID NO: 3867
  misc_feature 1..247: note = chr12:31079417-31079664
  misc_feature 1..247: note = hyper
  source 1..247: mol_type = genomic DNA

SEQ ID NO: 11179 - DNA, 117 bp, Homo sapiens; identical to SEQ ID NO: 3868
  misc_feature 1..117: note = chr12:31079693-31079810
  misc_feature 1..117: note = hyper
  source 1..117: mol_type = genomic DNA

SEQ ID NO: 11180 - DNA, 30 bp, Homo sapiens
  misc_feature 1..30: note = chr12:33591774-33591804
  misc_feature 1..30: note = hyper
  source 1..30: mol_type = genomic DNA
agccgcgggttacctcggaggccaaggcag

SEQ ID NO: 11181 - DNA, 28 bp, Homo sapiens
  misc_feature 1..28: note = chr12:33592057-33592085
  misc_feature 1..28: note = hyper
  source 1..28: mol_type = genomic DNA
cggcgccgggaggcgggaagcggaccag

SEQ ID NO: 11182 - DNA, 29 bp, Homo sapiens
  misc_feature 1..29: note = chr12:33592613-33592642
  misc_feature 1..29: note = hyper
  source 1..29: mol_type = genomic DNA
acgttggccccatggcgggagcggagggc

SEQ ID NO: 11183 - DNA, 13 bp, Homo sapiens
  misc_feature 1..13: note = chr12:33592643-33592656
  misc_feature 1..13: note = hyper
  source 1..13: mol_type = genomic DNA
taggggaaggaga

SEQ ID NO: 11184 - DNA, 73 bp, Homo sapiens
  misc_feature 1..73: note = chr12:33592961-33593034
  misc_feature 1..73: note = hyper
  source 1..73: mol_type = genomic DNA
gggagggagggagggcgggcggcccggcgcccctgccgaggccggggatgctcatcgttgcccagagttggcc

SEQ ID NO: 11185 - DNA, 40 bp, Homo sapiens
  misc_feature 1..40: note = chr12:33593092-33593132
  misc_feature 1..40: note = hyper
  source 1..40: mol_type = genomic DNA
cgcctttgtctctccaacttttccacggatgtattctact

SEQ ID NO: 11186 - DNA, 30 bp, Homo sapiens
  misc_feature 1..30: note = chr12:39298600-39298630
  misc_feature 1..30: note = hyper
  source 1..30: mol_type = genomic DNA
actcagatgtgggcccgaaaacaaatcaaa

SEQ ID NO: 11187 - DNA, 167 bp, Homo sapiens
  misc_feature 1..167: note = chr12:39299475-39299642
  misc_feature 1..167: note = hyper
  source 1..167: mol_type = genomic DNA
agggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctg

SEQ ID NO: 11188 - DNA, 30 bp, Homo sapiens
  misc_feature 1..30: note = chr12:39300375-39300405
  misc_feature 1..30: note = hyper
  source 1..30: mol_type = genomic DNA
agaactgagacctgacggataaaagcagag

SEQ ID NO: 11189 - DNA, 41 bp, Homo sapiens
  misc_feature 1..41: note = chr12:40618628-40618669
  misc_feature 1..41: note = hyper
  source 1..41: mol_type = genomic DNA
gagttctgcgcggcccgtcgcctcggcggagcctctggcag

SEQ ID NO: 11190 - DNA, 30 bp, Homo sapiens
  misc_feature 1..30: note = chr12:41086182-41086212
  misc_feature 1..30: note = hyper
  source 1..30: mol_type = genomic DNA
tttccctgtggtccccgccccactttccct

SEQ ID NO: 11191 - DNA, 37 bp, Homo sapiens
  misc_feature 1..37: note = chr12:41086835-41086872
  misc_feature 1..37: note = hyper
  source 1..37: mol_type = genomic DNA
tgggcgcctggctagcgcatcccggaaaacctgggag

SEQ ID NO: 11192 - DNA, 337 bp, Homo sapiens
  misc_feature 1..337: note = chr12:41582473-41582810
  misc_feature 1..337: note = hyper
  source 1..337: mol_type = genomic DNA
ctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgagg

SEQ ID NO: 11193 - DNA, 241 bp, Homo sapiens
  misc_feature 1..241: note = chr12:41583049-41583290
  misc_feature 1..241: note = hyper
  source 1..241: mol_type = genomic DNA
cctgtcattatcttacgaatggattggcgtcgaagttaaggattgtcccttttctgattatattacgattggaaagagttaaacagattcgattctaactttcccccgggaaagtaggaattgtgaaaactcattttccatccagactctcgttttccatctttcaccctcctgcccaccgtctctgcctattttttgagcacttgtcccgtgcctgaagcaaatccgagaaggaaagaca

SEQ ID NO: 11194 - DNA, 443 bp, Homo sapiens
  misc_feature 1..443: note = chr12:42983315-42983758
  misc_feature 1..443: note = hyper
  source 1..443: mol_type = genomic DNA
ggggctgctgggctgcggggctgcggggctgaggagctgcggtccgcggcgtcaggggtgggcgagggtgagcagcgcacgaaccatccagagcccagaaagtctccgtgccgaccgcggcgcgtctcggggaagtcagcgcaggctgcgcgaggctggcatgttccgggcgcgctgtcgggcggcggcggccgcgggagacggcgctggcagctgggctgcaggcggagtgcgctcgggctccggagccgcgcgctgcggcgccgccgcgcaccccgccctcggccgcggggcccggcgcgagcgaaaacgcggagcgcggacgccgccgcgggatcgaggccgctgggcgcgcgcccacgcgtaccccggctcggccctgaaagcgaggtcgggcccggctcgggccgcgcccgggggcagggctgcgagcaggcctggga

SEQ ID NO: 11195 - DNA, 15 bp, Homo sapiens
  misc_feature 1..15: note = chr12:43945109-43945124
  misc_feature 1..15: note = hyper
  source 1..15: mol_type = genomic DNA
cgttcctcattgtcc

SEQ ID NO: 11196 - DNA, 117 bp, Homo sapiens
  misc_feature 1..117: note = chr12:43945664-43945781
  misc_feature 1..117: note = hyper
  source 1..117: mol_type = genomic DNA
cctggtgatgaagagcgagagatggtagagcagcccagtcagccacttggccacccacatggttccaccctggggaccccgatcggggaggcccaccagagccgccggcagccaagc

SEQ ID NO: 11197 - DNA, 217 bp, Homo sapiens
  misc_feature 1..217: note = chr12:43946202-43946419
  misc_feature 1..217: note = hyper
  source 1..217: mol_type = genomic DNA
cgacttgctgagtagccccaaggcccggctgggcaccaattccggacctatgaaaccgagcgagatgcaagcacccgcgtacgtgaaaggtgcctagggttttgagctcttagatgaaatgacaagcatcagatagaacgtttctgttttttatgttttacggtacttttaggcttctcaaacaaaataaaataagctacaacggaagttcttgtag

SEQ ID NO: 11198 - DNA, 101 bp, Homo sapiens
  misc_feature 1..101: note = chr12:45269011-45269112
  misc_feature 1..101: note = hyper
  source 1..101: mol_type = genomic DNA
aaagagaaaggctttcgtcccattatgcagccccgggacctgacgcactccggtcgtggactccccaagttctaactctgttaagacgtcaatctgtaggg

SEQ ID NO: 11199 - DNA, 162 bp, Homo sapiens
  misc_feature 1..162: note = chr12:45269494-45269656
  misc_feature 1..162: note = hyper
  source 1..162: mol_type = genomic DNA
gacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtg

SEQ ID NO: 11200 - DNA, 35 bp, Homo sapiens
  misc_feature 1..35: note = chr12:45270707-45270742
  misc_feature 1..35: note = hyper
  source 1..35: mol_type = genomic DNA
gctggagagcttccccggcgcggagagcttcccgg

SEQ ID NO: 11201 - DNA, 30 bp, Homo sapiens
  misc_feature 1..30: note = chr12:45444296-45444326
  misc_feature 1..30: note = hyper
  source 1..30: mol_type = genomic DNA
agctggctcacctggcgctgaaggctggaa

SEQ ID NO: 11202 - DNA, 140 bp, Homo sapiens
  misc_feature 1..140: note = chr12:45444542-45444682
  misc_feature 1..140: note = hyper
  source 1..140: mol_type = genomic DNA
cggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccgg

SEQ ID NO: 11203 - DNA, 112 bp, Homo sapiens
  misc_feature 1..112: note = chr12:45444714-45444826
  misc_feature 1..112: note = hyper
  source 1..112: mol_type = genomic DNA
cggcgccaaccggtctgctgcgcgcccgccttgcgcccgcctgtcgcccgggcgccccgcaccgcacccagagccgcagcttctcgccgccgcctcccgcagggctggagcg

SEQ ID NO: 11204 - DNA, 237 bp, Homo sapiens
  misc_feature 1..237: note = chr12:45445162-45445399
  misc_feature 1..237: note = hyper
  source 1..237: mol_type = genomic DNA
gtgggaggaggtgggcgtggaggcgacgtgaatcgggcgcgctcgccacctccccgctgccgtgcagagccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtca

SEQ ID NO: 11205 - DNA, 96 bp, Homo sapiens; identical to SEQ ID NO: 3869
  misc_feature 1..96: note = chr12:47225381-47225477
  misc_feature 1..96: note = hyper
  source 1..96: mol_type = genomic DNA

SEQ ID NO: 11206 - DNA, 65 bp, Homo sapiens; identical to SEQ ID NO: 3870
  misc_feature 1..65: note = chr12:47225550-47225615
  misc_feature 1..65: note = hyper
  source 1..65: mol_type = genomic DNA

SEQ ID NO: 11207 - DNA, 51 bp, Homo sapiens
  misc_feature 1..51: note = chr12:48396843-48396894
  misc_feature 1..51: note = hyper
  source 1..51: mol_type = genomic DNA
ggctggaatcccagccgtcggaaacgtgcccaaacacgtggaaaaaaaaat

SEQ ID NO: 11208 - DNA, 1227 bp, Homo sapiens; identical to SEQ ID NO: 1029
  misc_feature 1..1227: note = chr12:48397123-48398350
  misc_feature 1..1227: note = hyper
  source 1..1227: mol_type = genomic DNA

SEQ ID NO: 11209 - DNA, 374 bp, Homo sapiens
  misc_feature 1..374: note = chr12:48577898-48578272
  misc_feature 1..374: note = hyper
  source 1..374: mol_type = genomic DNA
ccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgc

SEQ ID NO: 11210 - DNA, 113 bp, Homo sapiens; identical to SEQ ID NO: 3872
  misc_feature 1..113: note = chr12:49297802-49297915
  misc_feature 1..113: note = hyper
  source 1..113: mol_type = genomic DNA

SEQ ID NO: 11211 - DNA, 44 bp, Homo sapiens
  misc_feature 1..44: note = chr12:49366387-49366431
  misc_feature 1..44: note = hyper
  source 1..44: mol_type = genomic DNA
agcgaacgggttaggcgccaccgtgctcccgcctgactcaccct

SEQ ID NO: 11212 - DNA, 275 bp, Homo sapiens
  misc_feature 1..275: note = chr12:49374100-49374375
  misc_feature 1..275: note = hyper
  source 1..275: mol_type = genomic DNA
ctcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgactt

SEQ ID NO: 11213 - DNA, 90 bp, Homo sapiens; identical to SEQ ID NO: 1030
  misc_feature 1..90: note = chr12:49374937-49375027
  misc_feature 1..90: note = hyper
  source 1..90: mol_type = genomic DNA

SEQ ID NO: 11214 - DNA, 57 bp, Homo sapiens; identical to SEQ ID NO: 1031
  misc_feature 1..57: note = chr12:49375115-49375172
  misc_feature 1..57: note = hyper
  source 1..57: mol_type = genomic DNA

SEQ ID NO: 11215 - DNA, 111 bp, Homo sapiens
  misc_feature 1..111: note = chr12:49375410-49375521
  misc_feature 1..111: note = hyper
  source 1..111: mol_type = genomic DNA
cgagtgtctgtgaggcgctgcgcggactcgcccccaggaacgctctcctcgagccctcccccaaacagactcgctagcactcaagacccggttattcgcccacccgagtac

SEQ ID NO: 11216 - DNA, 255 bp, Homo sapiens; identical to SEQ ID NO: 1032
  misc_feature 1..255: note = chr12:49390850-49391105
  misc_feature 1..255: note = hyper
  source 1..255: mol_type = genomic DNA

SEQ ID NO: 11217 - DNA, 788 bp, Homo sapiens; identical to SEQ ID NO: 1033
  misc_feature 1..788: note = chr12:49391146-49391934
  misc_feature 1..788: note = hyper
  source 1..788: mol_type = genomic DNA

SEQ ID NO: 11218 - DNA, 239 bp, Homo sapiens
  misc_feature 1..239: note = chr12:49483977-49484216
  misc_feature 1..239: note = hyper
  source 1..239: mol_type = genomic DNA
gtcgcctggcgcgggcgccggccctcgagcggcaaacaccaggtgccagggcgtgagcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgca

SEQ ID NO: 11219 - DNA, 25 bp, Homo sapiens
  misc_feature 1..25: note = chr12:49727091-49727116
  misc_feature 1..25: note = hyper
  source 1..25: mol_type = genomic DNA
cgaaggcggccgggcagccgccgca

SEQ ID NO: 11220 - DNA, 634 bp, Homo sapiens; identical to SEQ ID NO: 1034
  misc_feature 1..634: note = chr12:49729728-49730362
  misc_feature 1..634: note = hyper
  source 1..634: mol_type = genomic DNA

SEQ ID NO: 11221 - DNA, 94 bp, Homo sapiens; identical to SEQ ID NO: 1035
  misc_feature 1..94: note = chr12:50297461-50297555
  misc_feature 1..94: note = hyper
  source 1..94: mol_type = genomic DNA

SEQ ID NO: 11222 - DNA, 115 bp, Homo sapiens; identical to SEQ ID NO: 1036
  misc_feature 1..115: note = chr12:50297973-50298088
  misc_feature 1..115: note = hyper
  source 1..115: mol_type = genomic DNA

SEQ ID NO: 11223 - DNA, 186 bp, Homo sapiens
  misc_feature 1..186: note = chr12:50355598-50355784
  misc_feature 1..186: note = hyper
  source 1..186: mol_type = genomic DNA
ggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccg

SEQ ID NO: 11224 - DNA, 53 bp, Homo sapiens
  misc_feature 1..53: note = chr12:50426787-50426840
  misc_feature 1..53: note = hyper
  source 1..53: mol_type = genomic DNA
caggcgaactgtcatcgacgatccctggacgcgggcgtcgggggcagggaggc

SEQ ID NO: 11225 - DNA, 51 bp, Homo sapiens
  misc_feature 1..51: note = chr12:50444372-50444423
  misc_feature 1..51: note = hyper
  source 1..51: mol_type = genomic DNA
caactcccctttctgcgccagcgccgctgcctctcccgtctgtttgcccct

SEQ ID NO: 11226 - DNA, 41 bp, Homo sapiens
  misc_feature 1..41: note = chr12:52208682-52208723
  misc_feature 1..41: note = hyper
  source 1..41: mol_type = genomic DNA
gcgggaaccagggaccgaggactgtgcggggacggggacgt

SEQ ID NO: 11227 - DNA, 146 bp, Homo sapiens
  misc_feature 1..146: note = chr12:52262960-52263106
  misc_feature 1..146: note = hyper
  source 1..146: mol_type = genomic DNA
ctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccag

SEQ ID NO: 11228 - DNA, 114 bp, Homo sapiens
  misc_feature 1..114: note = chr12:52301192-52301306
  misc_feature 1..114: note = hyper
  source 1..114: mol_type = genomic DNA
tgggcaataaggaaacggtttattaggagggagtggtggagctgggccaggcaggaagacgctggaataagaaacatttttgctccagcccccatcccagtcccgggaggctgc

SEQ ID NO: 11229 - DNA, 198 bp, Homo sapiens; identical to SEQ ID NO: 3880
  misc_feature 1..198: note = chr12:52400709-52400907
  misc_feature 1..198: note = hyper
  source 1..198: mol_type = genomic DNA

SEQ ID NO: 11230 - DNA, 508 bp, Homo sapiens; identical to SEQ ID NO: 3881
  misc_feature 1..508: note = chr12:52400908-52401416
  misc_feature 1..508: note = hyper
  source 1..508: mol_type = genomic DNA

SEQ ID NO: 11231 - DNA, 14 bp, Homo sapiens
  misc_feature 1..14: note = chr12:52627272-52627286
  misc_feature 1..14: note = hyper
  source 1..14: mol_type = genomic DNA
gaggtcaccattaa

SEQ ID NO: 11232 - DNA, 79 bp, Homo sapiens; identical to SEQ ID NO: 1037
  misc_feature 1..79: note = chr12:52652141-52652220
  misc_feature 1..79: note = hyper
  source 1..79: mol_type = genomic DNA

SEQ ID NO: 11233 - DNA, 14 bp, Homo sapiens
  misc_feature 1..14: note = chr12:52652599-52652613
  misc_feature 1..14: note = hyper
  source 1..14: mol_type = genomic DNA
gagtggaacccctc

SEQ ID NO: 11234 - DNA, 211 bp, Homo sapiens
  misc_feature 1..211: note = chr12:52702362-52702573
  misc_feature 1..211: note = hyper
  source 1..211: mol_type = genomic DNA
gtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctct

SEQ ID NO: 11235 - DNA, 386 bp, Homo sapiens
  misc_feature 1..386: note = chr12:53108080-53108466
  misc_feature 1..386: note = hyper
  source 1..386: mol_type = genomic DNA
actggggtccgaggacgcccctggcgcggggttcagaatttgtggcgggaccgccagctctaggaggagctttgttctctctggcggcgctgctgccgccgccgccgccaccccggctgacggcgcaggagtcccggagccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggca

SEQ ID NO: 11236 - DNA, 15 bp, Homo sapiens
  misc_feature 1..15: note = chr12:53359301-53359316
  misc_feature 1..15: note = hyper
  source 1..15: mol_type = genomic DNA
tagggagctgctccc

SEQ ID NO: 11237 - DNA, 178 bp, Homo sapiens; identical to SEQ ID NO: 3885
  misc_feature 1..178: note = chr12:53359385-53359563
  misc_feature 1..178: note = hyper
  source 1..178: mol_type = genomic DNA

SEQ ID NO: 11238 - DNA, 30 bp, Homo sapiens
  misc_feature 1..30: note = chr12:54089321-54089351
  misc_feature 1..30: note = hyper
  source 1..30: mol_type = genomic DNA
cgcctctgcccacaccggcccctgcggcct

SEQ ID NO: 11239 - DNA, 48 bp, Homo sapiens
  misc_feature 1..48: note = chr12:54145906-54145954
  misc_feature 1..48: note = hyper
  source 1..48: mol_type = genomic DNA
ctccaaggtcccctccgctcgcccctctctgcccgctgccgccgccgc

SEQ ID NO: 11240 - DNA, 378 bp, Homo sapiens; identical to SEQ ID NO: 1039
  misc_feature 1..378: note = chr12:54321250-54321628
  misc_feature 1..378: note = hyper
  source 1..378: mol_type = genomic DNA

SEQ ID NO: 11241 - DNA, 30 bp, Homo sapiens
  misc_feature 1..30: note = chr12:54322140-54322170
  misc_feature 1..30: note = hyper
  source 1..30: mol_type = genomic DNA
cccccacgcgccagtcgagcctacgcagct

SEQ ID NO: 11242 - DNA, 236 bp, Homo sapiens
  misc_feature 1..236: note = chr12:54324560-54324796
  misc_feature 1..236: note = hyper
  source 1..236: mol_type = genomic DNA
gggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcg

SEQ ID NO: 11243 - DNA, 30 bp, Homo sapiens
  misc_feature 1..30: note = chr12:54329604-54329634
  misc_feature 1..30: note = hyper
  source 1..30: mol_type = genomic DNA
cgaaggccggcggggcgcgcccgggtgagc

SEQ ID NO: 11244 - DNA, 461 bp, Homo sapiens
  misc_feature 1..461: note = chr12:54332944-54333405
  misc_feature 1..461: note = hyper
  source 1..461: mol_type = genomic DNA
gggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacc

SEQ ID NO: 11245 - DNA, 114 bp, Homo sapiens; identical to SEQ ID NO: 3887
  misc_feature 1..114: note = chr12:54338704-54338818
  misc_feature 1..114: note = hyper
  source 1..114: mol_type = genomic DNA

SEQ ID NO: 11246 - DNA, 17 bp, Homo sapiens
  misc_feature 1..17: note = chr12:54338978-54338995
  misc_feature 1..17: note = hyper
  source 1..17: mol_type = genomic DNA
ggcgggtcaaagagaag

SEQ ID NO: 11247 - DNA, 178 bp, Homo sapiens
  misc_feature 1..178: note = chr12:54339242-54339420
  misc_feature 1..178: note = hyper
  source 1..178: mol_type = genomic DNA
tccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaatt

SEQ ID NO: 11248 - DNA, 150 bp, Homo sapiens
  misc_feature 1..150: note = chr12:54343665-54343815
  misc_feature 1..150: note = hyper
  source 1..150: mol_type = genomic DNA
acacagaggaggtgtcgtctccagtctagacaagggcgctaataacgcccataaaaggcggcctctccagagatgctctggcaactccgctcccgcgcgcctgccgctggccgctttctccacctccccccgccccgcccttctctgata

SEQ ID NO: 11249 - DNA, 48 bp, Homo sapiens; identical to SEQ ID NO: 1040
  misc_feature 1..48: note = chr12:54345611-54345659
  misc_feature 1..48: note = hyper
  source 1..48: mol_type = genomic DNA

SEQ ID NO: 11250 - DNA, 14 bp, Homo sapiens
  misc_feature 1..14: note = chr12:54345965-54345979
  misc_feature 1..14: note = hyper
  source 1..14: mol_type = genomic DNA
ggtgggtctcaggg

SEQ ID NO: 11251 - DNA, 50 bp, Homo sapiens
  misc_feature 1..50: note = chr12:54348934-54348984
  misc_feature 1..50: note = hyper
  source 1..50: mol_type = genomic DNA
tctcaaccctcccttcggccgcacgtgcgagctggcgcgcgtggaggacg

SEQ ID NO: 11252 - DNA, 64 bp, Homo sapiens
  misc_feature 1..64: note = chr12:54349272-54349336
  misc_feature 1..64: note = hyper
  source 1..64: mol_type = genomic DNA
ccggcagcttggtatcgccgttgaaccccggcggcgggctctcggccagcggtaaggaccccgg

SEQ ID NO: 11253 - DNA, 180 bp, Homo sapiens; identical to SEQ ID NO: 1042
  misc_feature 1..180: note = chr12:54354514-54354694
  misc_feature 1..180: note = hyper
  source 1..180: mol_type = genomic DNA

SEQ ID NO: 11254 - DNA, 38 bp, Homo sapiens; identical to SEQ ID NO: 1043
  misc_feature 1..38: note = chr12:54354814-54354852
  misc_feature 1..38: note = hyper
  source 1..38: mol_type = genomic DNA

SEQ ID NO: 11255 - DNA, 19 bp, Homo sapiens
  misc_feature 1..19: note = chr12:54359664-54359683
  misc_feature 1..19: note = hyper
  source 1..19: mol_type = genomic DNA
ttgctctccctcgcccggg

SEQ ID NO: 11256 - DNA, 78 bp, Homo sapiens
  misc_feature 1..78: note = chr12:54359960-54360038
  misc_feature 1..78: note = hyper
  source 1..78: mol_type = genomic DNA
tctggctccgctccccgccagctggggacccttccctccctccttcctccccctcccttcccccgcctctctttttct

SEQ ID NO: 11257 - DNA, 30 bp, Homo sapiens
  misc_feature 1..30: note = chr12:54366936-54366966
  misc_feature 1..30: note = hyper
  source 1..30: mol_type = genomic DNA
gataacgcgtcatctcgccttcccaaattt

SEQ ID NO: 11258 - DNA, 95 bp, Homo sapiens
  misc_feature 1..95: note = chr12:54367200-54367295
  misc_feature 1..95: note = hyper
  source 1..95: mol_type = genomic DNA
tctcctatccctactcggcccaagtgcccccggtccgggaggtctcctacggcctggagccatccggcaagtggcaccatcggaacagctactcc

SEQ ID NO: 11259 - DNA, 39 bp, Homo sapiens
  misc_feature 1..39: note = chr12:54367525-54367564
  misc_feature 1..39: note = hyper
  source 1..39: mol_type = genomic DNA
cgagcccccctgctccggcaagggcgaggccaaggggga

SEQ ID NO: 11260 - DNA, 94 bp, Homo sapiens
  misc_feature 1..94: note = chr12:54378085-54378179
  misc_feature 1..94: note = hyper
  source 1..94: mol_type = genomic DNA
tctcgggtcggggatcgggtgcctctggtctctggcttcctctttcccctaccccgcgtccattcggaacctccttttccgagcagccatgaag

SEQ ID NO: 11261 - DNA, 284 bp, Homo sapiens
  misc_feature 1..284: note = chr12:54379174-54379458
  misc_feature 1..284: note = hyper
  source 1..284: mol_type = genomic DNA
gaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttg

SEQ ID NO: 11262 - DNA, 43 bp, Homo sapiens; identical to SEQ ID NO: 1044
  misc_feature 1..43: note = chr12:54379888-54379931
  misc_feature 1..43: note = hyper
  source 1..43: mol_type = genomic DNA

SEQ ID NO: 11263 - DNA, 406 bp, Homo sapiens; identical to SEQ ID NO: 1045
  misc_feature 1..406: note = chr12:54379958-54380364
  misc_feature 1..406: note = hyper
  source 1..406: mol_type = genomic DNA

SEQ ID NO: 11264 - DNA, 467 bp, Homo sapiens
  misc_feature 1..467: note = chr12:54387842-54388309
  misc_feature 1..467: note = hyper
  source 1..467: mol_type = genomic DNA
gtctctgagatctctcgtcggctgctggggctccggctcagcctggcagatccgctgtggcctctctgggacctcgccccggcccacggcctgacttcggctcggagatgcagcccttcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggcggcgaggcgggcaaccgcatgttgagtctatagaaaggaccttgaggtctgctgggtgtttgggctgccctgggggcggcggcccagagtgtgg

SEQ ID NO: 11265 - DNA, 30 bp, Homo sapiens
  misc_feature 1..30: note = chr12:54388653-54388683
  misc_feature 1..30: note = hyper
  source 1..30: mol_type = genomic DNA
tccccaggcgggagccgcctgtcctgtatc

SEQ ID NO: 11266 - DNA, 15 bp, Homo sapiens
  misc_feature 1..15: note = chr12:54391399-54391414
  misc_feature 1..15: note = hyper
  source 1..15: mol_type = genomic DNA
cgcctccctctctgc

SEQ ID NO: 11267 - DNA, 245 bp, Homo sapiens
  misc_feature 1..245: note = chr12:54393479-54393724
  misc_feature 1..245: note = hyper
  source 1..245: mol_type = genomic DNA
ttcctccacctacctcggtcggcctccccgcccctgcggggctcccgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaat

SEQ ID NO: 11268 - DNA, 621 bp, Homo sapiens
  misc_feature 1..621: note = chr12:54393798-54394419
  misc_feature 1..621: note = hyper
  source 1..621: mol_type = genomic DNA
cgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctg

SEQ ID NO: 11269 - DNA, 195 bp, Homo sapiens
  misc_feature 1..195: note = chr12:54394466-54394661
  misc_feature 1..195: note = hyper
  source 1..195: mol_type = genomic DNA
cgccggcagcaagcacaaagaggagaaggccgacctggaccccagtaagttgggagcaattttcctttacaaccggcgcgggaggggaggggaggacgggcgggggcagccgaattacagccctcccgaaccgtgcagggagcgcgggagaggggcgagggggcgaggactcaataaaagcgaattaccttgggg

SEQ ID NO: 11270 - DNA, 208 bp, Homo sapiens
  misc_feature 1..208: note = chr12:54398888-54399096
  misc_feature 1..208: note = hyper
  source 1..208: mol_type = genomic DNA
cgcgggcttggaggaccctgaggaaagcatgggatgcagaacaggcccacccggcccggcccactgttcaatcccagcccagcctgcaggtcaggattggaatcattttttattcgctatcatttacgaattaacaacacaacacgcatctggggaaagaaatgaaagctgggggtagagaggggctagcaaacgccctcttccccta

SEQ ID NO: 11271 - DNA, 106 bp, Homo sapiens
  misc_feature 1..106: note = chr12:54399540-54399646
  misc_feature 1..106: note = hyper
  source 1..106: mol_type = genomic DNA
gaggactttagggtgcgcgccgcgggcaagccgtcgtgggagcctcggagcgtgcatccgcgttcgcggagatgttccaagcccagaaatgcgcctgaatgggggg

SEQ ID NO: 11272 - DNA, 120 bp, Homo sapiens; identical to SEQ ID NO: 3895
  misc_feature 1..120: note = chr12:54402676-54402796
  misc_feature 1..120: note = hyper
  source 1..120: mol_type = genomic DNA

SEQ ID NO: 11273 - DNA, 504 bp, Homo sapiens; identical to SEQ ID NO: 3896
  misc_feature 1..504: note = chr12:54402856-54403360
  misc_feature 1..504: note = hyper
  source 1..504: mol_type = genomic DNA

SEQ ID NO: 11274 - DNA, 383 bp, Homo sapiens
  misc_feature 1..383: note = chr12:54408343-54408726
  misc_feature 1..383: note = hyper
  source 1..383: mol_type = genomic DNA
agcattaaatggctccgaagggcctcgccgccttttccccacaccaaatgtgccatttatcccttgtcctgttcagcaatgtccgtggccccaagcccggcgcgtcggagggcggggtgcgtctggcgcccggctttactcgagatgccaggcatggagagggctaagccgagggagccccagccaccccctcatgcagtacccgctcccccacccctcctgcccaccgcctctgttttctcgtttggaaagaaatggaggtaaaaacccgttttatgggggaacgtaattgtgagcgggatgcgctctctttagaatcgcgtcctcccaaatgctcccgccgtcccattaccggaatggggaccattcggctgctgcagata

SEQ ID NO: 11275 - DNA, 110 bp, Homo sapiens
  misc_feature 1..110: note = chr12:54425031-54425141
  misc_feature 1..110: note = hyper
  source 1..110: mol_type = genomic DNA
cggggggcgccgtgagagcaagccccaggcccgcgccaagctggctgttgcgaaacgtagcggaggcggagagcggagggaaagagaagaccgcgggactggagccctgt

SEQ ID NO: 11276 - DNA, 30 bp, Homo sapiens
  misc_feature 1..30: note = chr12:54440926-54440956
  misc_feature 1..30: note = hyper
  source 1..30: mol_type = genomic DNA
gcgtcgcgcttcctccgggcttaatccaga

SEQ ID NO: 11277 - DNA, 30 bp, Homo sapiens
  misc_feature 1..30: note = chr12:54447923-54447953
  misc_feature 1..30: note = hyper
  source 1..30: mol_type = genomic DNA
aggggcccggcaattcgcgaggccacgggc

SEQ ID NO: 11278 - DNA, 129 bp, Homo sapiens
  misc_feature 1..129: note = chr12:54520065-54520194
  misc_feature 1..129: note = hyper
  source 1..129: mol_type = genomic DNA
ctccctccagttccccgggcccgcccggccctgatggccactcacgctatagcgcccactctgtcctgggccatcccgcgccagcagtgtagcccccagcccgggcgcctgaatgctctccctccggat

SEQ ID NO: 11279 - DNA, 129 bp, Homo sapiens
  misc_feature 1..129: note = chr12:54520221-54520350
  misc_feature 1..129: note = hyper
  source 1..129: mol_type = genomic DNA
cgtgcccccgagtcctgcttccccggggcctgctctgtatcaggcgcctgcgccttcaagggtacccggcccgcctgccctccccaagagccgagtttgcgctcctcccggaatcgtttgagagaagga

SEQ ID NO: 11280 - DNA, 250 bp, Homo sapiens
  misc_feature 1..250: note = chr12:54520710-54520960
  misc_feature 1..250: note = hyper
  source 1..250: mol_type = genomic DNA
aacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaa

SEQ ID NO: 11281 - DNA, 553 bp, Homo sapiens; identical to SEQ ID NO: 3897
  misc_feature 1..553: note = chr12:54812069-54812622
  misc_feature 1..553: note = hyper
  source 1..553: mol_type = genomic DNA

SEQ ID NO: 11282 - DNA, 37 bp, Homo sapiens
  misc_feature 1..37: note = chr12:54943371-54943408
  misc_feature 1..37: note = hyper
  source 1..37: mol_type = genomic DNA
aggcggctctggcagcgcgcggcggcggcggcggtag

SEQ ID NO: 11283 - DNA, 14 bp, Homo sapiens
  misc_feature 1..14: note = chr12:57619110-57619124
  misc_feature 1..14: note = hyper
  source 1..14: mol_type = genomic DNA
gggcctgtccccca

SEQ ID NO: 11284 - DNA, 37 bp, Homo sapiens
  misc_feature 1..37: note = chr12:57870111-57870148
  misc_feature 1..37: note = hyper
  source 1..37: mol_type = genomic DNA
cccgcacccatcctgcgcctctcgctcacactcaccc

SEQ ID NO: 11285 - DNA, 340 bp, Homo sapiens; identical to SEQ ID NO: 3899
  misc_feature 1..340: note = chr12:57943845-57944185
  misc_feature 1..340: note = hyper
  source 1..340: mol_type = genomic DNA

SEQ ID NO: 11286 - DNA, 94 bp, Homo sapiens
  misc_feature 1..94: note = chr12:58004814-58004908
  misc_feature 1..94: note = hyper
  source 1..94: mol_type = genomic DNA
aagactccccatacacgcaccccgtaccagggggcctctgtccactcggccggggacagccccaaacccagaacatcttcgcacaggccaaggc

SEQ ID NO: 11287 - DNA, 158 bp, Homo sapiens
  misc_feature 1..158: note = chr12:58015011-58015169
  misc_feature 1..158: note = hyper
  source 1..158: mol_type = genomic DNA
tctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggt

SEQ ID NO: 11288 - DNA, 166 bp, Homo sapiens; identical to SEQ ID NO: 3900
  misc_feature 1..166: note = chr12:58021293-58021459
  misc_feature 1..166: note = hyper
  source 1..166: mol_type = genomic DNA

SEQ ID NO: 11289 - DNA, 88 bp, Homo sapiens; identical to SEQ ID NO: 1046
  misc_feature 1..88: note = chr12:58025646-58025734
  misc_feature 1..88: note = hyper
  source 1..88: mol_type = genomic DNA

SEQ ID NO: 11290 - DNA, 156 bp, Homo sapiens
  misc_feature 1..156: note = chr12:58026100-58026256
  misc_feature 1..156: note = hyper
  source 1..156: mol_type = genomic DNA
ggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggca

SEQ ID NO: 11291 - DNA, 190 bp, Homo sapiens; identical to SEQ ID NO: 1047
  misc_feature 1..190: note = chr12:62584823-62585013
  misc_feature 1..190: note = hyper
  source 1..190: mol_type = genomic DNA

SEQ ID NO: 11292 - DNA, 963 bp, Homo sapiens; identical to SEQ ID NO: 1048
  misc_feature 1..963: note = chr12:62585030-62585993
  misc_feature 1..963: note = hyper
  source 1..963: mol_type = genomic DNA

SEQ ID NO: 11293 - DNA, 30 bp, Homo sapiens
  misc_feature 1..30: note = chr12:62829269-62829299
  misc_feature 1..30: note = hyper
  source 1..30: mol_type = genomic DNA
accagacaggaaactcgccctgggtctctc

SEQ ID NO: 11294 - DNA, 462 bp, Homo sapiens; identical to SEQ ID NO: 3904
  misc_feature 1..462: note = chr12:63543848-63544310
  misc_feature 1..462: note = hyper
  source 1..462: mol_type = genomic DNA

SEQ ID NO: 11295 - DNA, 88 bp, Homo sapiens; identical to SEQ ID NO: 1049
  misc_feature 1..88: note = chr12:63544512-63544600
  misc_feature 1..88: note = hyper
  source 1..88: mol_type = genomic DNA

SEQ ID NO: 11296 - DNA, 146 bp, Homo sapiens; identical to SEQ ID NO: 1050
  misc_feature 1..146: note = chr12:63544728-63544874
  misc_feature 1..146: note = hyper
  source 1..146: mol_type = genomic DNA

SEQ ID NO: 11297 - DNA, 30 bp, Homo sapiens
  misc_feature 1..30: note = chr12:63545313-63545343
  misc_feature 1..30: note = hyper
  source 1..30: mol_type = genomic DNA
cctgaacctggctctcgacctcacctcctc

SEQ ID NO: 11298 - DNA, 165 bp, Homo sapiens; identical to SEQ ID NO: 3907
  misc_feature 1..165: note = chr12:64061785-64061950
  misc_feature 1..165: note = hyper
  source 1..165: mol_type = genomic DNA

SEQ ID NO: 11299 - DNA, 293 bp, Homo sapiens
  misc_feature 1..293: note = chr12:64062205-64062498
  misc_feature 1..293: note = hyper
  source 1..293: mol_type = genomic DNA
caggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctcc

SEQ ID NO: 11300 - DNA, 27 bp, Homo sapiens
  misc_feature 1..27: note = chr12:64062499-64062526
  misc_feature 1..27: note = hyper
  source 1..27: mol_type = genomic DNA
gtgcgcgcaggccccaagcccacatgc

SEQ ID NO: 11301 - DNA, 624 bp, Homo sapiens
  misc_feature 1..624: note = chr12:64062527-64063151
  misc_feature 1..624: note = hyper
  source 1..624: mol_type = genomic DNA
cagtcctcaccttgcgcgcagccccatgtacagccccggacgggctcccagccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacacgttaattaacgaggtattaaagggaaagatctcagctgaaagaaatgactgtaggaagtgtgtcagggaagccaacggaaccgccggcccgccggcggtgcgcccggcattaggaacgtctctactcccctacgatcgctgaggtatcggacagtcagtgcccgttgccaacgcagagggaacgggccgagactgcgggcaacaagtggcagagccggcgtgagtccggtgggtctgatcccagagcctcaggttgacgccacttccttggcacgggacagcgtttactgaatctt

SEQ ID NO: 11302 - DNA, 55 bp, Homo sapiens
  misc_feature 1..55: note = chr12:64784115-64784170
  misc_feature 1..55: note = hyper
  source 1..55: mol_type = genomic DNA
cgcagagccactacccgccggatggacttgggcgggttctcggttaggtagacga

SEQ ID NO: 11303 - DNA, 174 bp, Homo sapiens
  misc_feature 1..174: note = chr12:64784390-64784564
  misc_feature 1..174: note = hyper
  source 1..174: mol_type = genomic DNA
agctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaa

SEQ ID NO: 11304 - DNA, 232 bp, Homo sapiens; identical to SEQ ID NO: 1051
  misc_feature 1..232: note = chr12:65218319-65218551
  misc_feature 1..232: note = hyper
  source 1..232: mol_type = genomic DNA

SEQ ID NO: 11305 - DNA, 281 bp, Homo sapiens; identical to SEQ ID NO: 1052
  misc_feature 1..281: note = chr12:65218900-65219181
  misc_feature 1..281: note = hyper
  source 1..281: mol_type = genomic DNA

SEQ ID NO: 11306 - DNA, 179 bp, Homo sapiens; identical to SEQ ID NO: 1053
  misc_feature 1..179: note = chr12:65219605-65219784
  misc_feature 1..179: note = hyper
  source 1..179: mol_type = genomic DNA

SEQ ID NO: 11307 - DNA, 327 bp, Homo sapiens; identical to SEQ ID NO: 3911
  misc_feature 1..327: note = chr12:65220112-65220439
  misc_feature 1..327: note = hyper
  source 1..327: mol_type = genomic DNA

SEQ ID NO: 11308 - DNA, 200 bp, Homo sapiens; identical to SEQ ID NO: 3912
  misc_feature 1..200: note = chr12:65514835-65515035
  misc_feature 1..200: note = hyper
  source 1..200: mol_type = genomic DNA

SEQ ID NO: 11309 - DNA, 215 bp, Homo sapiens
  misc_feature 1..215: note = chr12:65515260-65515475
  misc_feature 1..215: note = hyper
  source 1..215: mol_type = genomic DNA
gaggccagcagtcagcggggcaaatagagcgagaacagaagagcgggaagggctggcgcgagcgaggtgcgagcgaggagtggggcccgcgaggcctgggcggccgccacttgggggcgctgtggggcccccccgggggcggggccgcgagggacccccgaggctgcattcacagtgcggtgcgcccagtggagcgcccgcgaagtgggcgtgta

SEQ ID NO: 11310 - DNA, 151 bp, Homo sapiens
  misc_feature 1..151: note = chr12:66122419-66122570
  misc_feature 1..151: note = hyper
  source 1..151: mol_type = genomic DNA
atgtaacaatttgtccgtgttcatataataatctgtcaactctgtgatttgcttattatgtgaattaactccataatcgctctgagattgaattcagtgacaccgtttaactgcttctggtttgggggcttttactcgatatttttaggta

SEQ ID NO: 11311 - DNA, 112 bp, Homo sapiens
  misc_feature 1..112: note = chr12:66122818-66122930
  misc_feature 1..112: note = hyper
  source 1..112: mol_type = genomic DNA
cccgaagcaaggggacgtttgcgaggagggagaaatttaaacccccttcgctccgcgccacctgggagcactttggcgccgcagactcaggagccgacgccatctccaggac

SEQ ID NO: 11312 - DNA, 139 bp, Homo sapiens; identical to SEQ ID NO: 3913
  misc_feature 1..139: note = chr12:66123380-66123519
  misc_feature 1..139: note = hyper
  source 1..139: mol_type = genomic DNA

SEQ ID NO: 11313 - DNA, 48 bp, Homo sapiens
  misc_feature 1..48: note = chr12:66135151-66135199
  misc_feature 1..48: note = hyper
  source 1..48: mol_type = genomic DNA
tctctggcccagctgcggagggggaaaggtgatcgatcttgctggggg

SEQ ID NO: 11314 - DNA, 117 bp, Homo sapiens
  misc_feature 1..117: note = chr12:66135452-66135569
  misc_feature 1..117: note = hyper
  source 1..117: mol_type = genomic DNA
ccccaatctccctagcgctgtgggggtggctgcagctccccgcgcgctccctcctttgggggggtttctgggctcgtgacttttttttaaataaagaatgagcggatgcccgtgaca

SEQ ID NO: 11315 - DNA, 98 bp, Homo sapiens
  misc_feature 1..98: note = chr12:66135998-66136096
  misc_feature 1..98: note = hyper
  source 1..98: mol_type = genomic DNA
ccgccagttctccctcggtcgcgccggcgcacgctcgtccccttctgccccggagcccgcccgcgccgcacggtggccccttgcgctggcctgatcgt

SEQ ID NO: 11316 - DNA, 72 bp, Homo sapiens
  misc_feature 1..72: note = chr12:66217530-66217602
  misc_feature 1..72: note = hyper
  source 1..72: mol_type = genomic DNA
gcgcatgaatgcccccgtgtccacgtgtatctgcgtgcatgtgcttacacgcgtgttcgtgtgtatctgcat

SEQ ID NO: 11317 - DNA, 30 bp, Homo sapiens
  misc_feature 1..30: note = chr12:66219066-66219096
  misc_feature 1..30: note = hyper
  source 1..30: mol_type = genomic DNA
agggcgcggggcagccgtccacttcagccc

SEQ ID NO: 11318 - DNA, 221 bp, Homo sapiens
  misc_feature 1..221: note = chr12:66582827-66583048
  misc_feature 1..221: note = hyper
  source 1..221: mol_type = genomic DNA
ggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactcc

SEQ ID NO: 11319 - DNA, 207 bp, Homo sapiens
  misc_feature 1..207: note = chr12:66583049-66583256
  misc_feature 1..207: note = hyper
  source 1..207: mol_type = genomic DNA
cctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcg

SEQ ID NO: 11320 - DNA, 30 bp, Homo sapiens
  misc_feature 1..30: note = chr12:68759101-68759131
  misc_feature 1..30: note = hyper
  source 1..30: mol_type = genomic DNA
caccacctaacacatcggggctggtgcagc

SEQ ID NO: 11321 - DNA, 61 bp, Homo sapiens
  misc_feature 1..61: note = chr12:69326653-69326714
  misc_feature 1..61: note = hyper
  source 1..61: mol_type = genomic DNA
acacatgagggcaggcgggggcatcaccagctacgtctcggtactccggtctcagggtctc

SEQ ID NO: 11322 - DNA, 350 bp, Homo sapiens
  misc_feature 1..350: note = chr12:69327082-69327432
  misc_feature 1..350: note = hyper
  source 1..350: mol_type = genomic DNA
cgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcctgggcagccacagggcgctccaccgagggacactctctgtcgcagactgcagccgcttgggagacgtttagggctcggcgggtttcctgcggttggcggtgccggggcccacctggagccgggacgcatgcggagtcctgagtgccctgagccccgcgcgggctcctgcggga

SEQ ID NO: 11323 - DNA, 176 bp, Homo sapiens
  misc_feature 1..176: note = chr12:71314436-71314612
  misc_feature 1..176: note = hyper
  source 1..176: mol_type = genomic DNA
gcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatc

SEQ ID NO: 11324 - DNA, 63 bp, Homo sapiens
  misc_feature 1..63: note = chr12:71314613-71314676
  misc_feature 1..63: note = hyper
  source 1..63: mol_type = genomic DNA
ctggggtggtggttgggggtgggggtgggggtggggaagggggaagtgcgggggagacacttg

SEQ ID NO: 11325 - DNA, 30 bp, Homo sapiens
  misc_feature 1..30: note = chr12:72332641-72332671
  misc_feature 1..30: note = hyper
  source 1..30: mol_type = genomic DNA
cagggttctggacagcgccccaagcaggca

SEQ ID NO: 11326 - DNA, 34 bp, Homo sapiens
  misc_feature 1..34: note = chr12:72665392-72665426
  misc_feature 1..34: note = hyper
  source 1..34: mol_type = genomic DNA
cctttcctgcctcctcgcgcgctccctctccttt

SEQ ID NO: 11327 - DNA, 122 bp, Homo sapiens; identical to SEQ ID NO: 3914
  misc_feature 1..122: note = chr12:72666686-72666808
  misc_feature 1..122: note = hyper
  source 1..122: mol_type = genomic DNA

SEQ ID NO: 11328 - DNA, 389 bp, Homo sapiens; identical to SEQ ID NO: 3915
  misc_feature 1..389: note = chr12:72666997-72667386
  misc_feature 1..389: note = hyper
  source 1..389: mol_type = genomic DNA

SEQ ID NO: 11329 - DNA, 38 bp, Homo sapiens; identical to SEQ ID NO: 3916
  misc_feature 1..38: note = chr12:72667387-72667425
  misc_feature 1..38: note = hyper
  source 1..38: mol_type = genomic DNA

SEQ ID NO: 11330 - DNA, 30 bp, Homo sapiens
  misc_feature 1..30: note = chr12:75601190-75601220
  misc_feature 1..30: note = hyper
  source 1..30: mol_type = genomic DNA
gcccagcctcttggccgccaggtcctcgtc

SEQ ID NO: 11331 - DNA, 20 bp, Homo sapiens
  misc_feature 1..20: note = chr12:75601480-75601500
  misc_feature 1..20: note = hyper
  source 1..20: mol_type = genomic DNA
ggtcgctggccctgccgccg

SEQ ID NO: 11332 - DNA, 247 bp, Homo sapiens; identical to SEQ ID NO: 1055
  misc_feature 1..247: note = chr12:75601695-75601942
  misc_feature 1..247: note = hyper
  source 1..247: mol_type = genomic DNA

SEQ ID NO: 11333 - DNA, 274 bp, Homo sapiens
  misc_feature 1..274: note = chr12:75603075-75603349
  misc_feature 1..274: note = hyper
  source 1..274: mol_type = genomic DNA
tgagccgcccttctccgacgagaaactacttgttggcgttttccggattcaggtggttgagccgcttccctgggcgctggggtgggggagaaagcccccgccggccgccggccgcgctccccgccttcattctgtgatctgcggatttgccagtcgccaacctccgcgcccagagtcaccatcgcgcagggttgggcaaaccatggagctcggggcgggtccagccggcactgcccgacccctccgggagcgggcagatcggctggccgtgaat

SEQ ID NO: 11334 - DNA, 92 bp, Homo sapiens
  misc_feature 1..92: note = chr12:75728380-75728472
  misc_feature 1..92: note = hyper
  source 1..92: mol_type = genomic DNA
gggctcgagcctgtgcggcaggatggagccaagggagagcgtggtgcgggggcgtggggaaatcgggttgccccagccgttactggtccgcg

SEQ ID NO: 11335 - DNA, 64 bp, Homo sapiens
  misc_feature 1..64: note = chr12:77719516-77719580
  misc_feature 1..64: note = hyper
  source 1..64: mol_type = genomic DNA
tccttcccactcccccgcccctcttcgggattctctctttctctttccccgtcctcatttcttt

SEQ ID NO: 11336 - DNA, 271 bp, Homo sapiens
  misc_feature 1..271: note = chr12:79257826-79258097
  misc_feature 1..271: note = hyper
  source 1..271: mol_type = genomic DNA
agcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctg

SEQ ID NO: 11337 - DNA, 122 bp, Homo sapiens
  misc_feature 1..122: note = chr12:79258316-79258438
  misc_feature 1..122: note = hyper
  source 1..122: mol_type = genomic DNA
tcccaggtccctgtccgctgtggggatggagagacactaacagaactgggatgggcgatgttggctgaacggatccacctattattagtgcgcggggattggctccttggcgcagcgtaccc

SEQ ID NO: 11338 - DNA, 411 bp, Homo sapiens
  misc_feature 1..411: note = chr12:79258439-79258850
  misc_feature 1..411: note = hyper
  source 1..411: mol_type = genomic DNA
aggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactgg

SEQ ID NO: 11339 - DNA, 194 bp, Homo sapiens; identical to SEQ ID NO: 3919
  misc_feature 1..194: note = chr12:81102236-81102430
  misc_feature 1..194: note = hyper
  source 1..194: mol_type = genomic DNA

SEQ ID NO: 11340 - DNA, 30 bp, Homo sapiens
  misc_feature 1..30: note = chr12:81330816-81330846
  misc_feature 1..30: note = hyper
  source 1..30: mol_type = genomic DNA
tctgccttgccctttcggcagagggcagct

SEQ ID NO: 11341 - DNA, 48 bp, Homo sapiens
  misc_feature 1..48: note = chr12:81331829-81331877
  misc_feature 1..48: note = hyper
  source 1..48: mol_type = genomic DNA
aatggtcagaatatacgtgtgtgcatgcgggtgcgtgtgtgtataagg

SEQ ID NO: 11342 - DNA, 90 bp, Homo sapiens
  misc_feature 1..90: note = chr12:81472021-81472111
  misc_feature 1..90: note = hyper
  source 1..90: mol_type = genomic DNA
cccgcggggcggtctcgggggccggggatgcagggcactgtcctccggcagtggcagcgagtacaagacccacttcgcagcctcggtgac

SEQ ID NO: 11343 - DNA, 30 bp, Homo sapiens
  misc_feature 1..30: note = chr12:82153211-82153241
  misc_feature 1..30: note = hyper
  source 1..30: mol_type = genomic DNA
tgcagtggtttccaccggcccttaaataaa

SEQ ID NO: 11344 - DNA, 191 bp, Homo sapiens
  misc_feature 1..191: note = chr12:85305054-85305245
  misc_feature 1..191: note = hyper
  source 1..191: mol_type = genomic DNA
ttcatttctcccatacgtcttaagtagtgaaccgcaaggatggtgcagactaagattgggtctacctataagatctggaggggaaaacggcaagaccagaagaaaccgtcgcagacttatttgcataagcacccaaacactgcttacgtcactgcgccggagtccggaccccgccccgtcttactccagcc

SEQ ID NO: 11345 - DNA, 37 bp, Homo sapiens
  misc_feature 1..37: note = chr12:85305657-85305694
  misc_feature 1..37: note = hyper
  source 1..37: mol_type = genomic DNA
cagccacgtgcctttcgtacggcgaaaggcccccttt

SEQ ID NO: 11346 - DNA, 34 bp, Homo sapiens
  misc_feature 1..34: note = chr12:85306519-85306553
  misc_feature 1..34: note = hyper
  source 1..34: mol_type = genomic DNA
gccagggaaacagcacgggatacaggcgcgcggg

SEQ ID NO: 11347 - skipped

SEQ ID NO: 11348 - DNA, 28 bp, Homo sapiens
  misc_feature 1..28: note = chr12:85306798-85306826
  misc_feature 1..28: note = hyper
  source 1..28: mol_type = genomic DNA
tcttcccagagcccggggctgtgcccgc

SEQ ID NO: 11349 - DNA, 349 bp, Homo sapiens
  misc_feature 1..349: note = chr12:85667272-85667621
  misc_feature 1..349: note = hyper
  source 1..349: mol_type = genomic DNA
actcctccacctatgcgcgtttaaccacagagttgttcttgattgtaagggacttcgcccacttggttgaagtggagagccggtcctcattccagacgtcccgcacggcagtcgctcatggctccctccaggccgggagccaggaaggtggtccttcaccgaggtgcgcaccaagcggcggtccacccaggcaatggggtgcaccaatttgcctccaaaaatttgctgcgcacacaacctgttcacagttcctgatcagaaagggctaacgagatgtctgtctacagctgtctctgggcgagggcgcaggctttgggaagtggttcagcgcgatcggggacaccgcttg

SEQ ID NO: 11350 - DNA, 108 bp, Homo sapiens
  misc_feature 1..108: note = chr12:85673127-85673235
  misc_feature 1..108: note = hyper
  source 1..108: mol_type = genomic DNA
caaagggaagggtggcgaagagggtgtagggaattggttggcattagtataatggcttcattgcctcttgctcggcttctctctcccacccatcgccaccgcgtccac

SEQ ID NO: 11351 - DNA, 375 bp, Homo sapiens; identical to SEQ ID NO: 3920
  misc_feature 1..375: note = chr12:85673460-85673835
  misc_feature 1..375: note = hyper
  source 1..375: mol_type = genomic DNA

SEQ ID NO: 11352 - DNA, 345 bp, Homo sapiens
  misc_feature 1..345: note = chr12:85674038-85674383
  misc_feature 1..345: note = hyper
  source 1..345: mol_type = genomic DNA
tatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaag

SEQ ID NO: 11353 - DNA, 59 bp, Homo sapiens
  misc_feature 1..59: note = chr12:85674599-85674658
  misc_feature 1..59: note = hyper
  source 1..59: mol_type = genomic DNA
tgagtcaagacagaacgcttcctctgcgagcccgccttgcagtccgggcggtaggaact

SEQ ID NO: 11354 - DNA, 224 bp, Homo sapiens; identical to SEQ ID NO: 3921
  misc_feature 1..224: note = chr12:93966429-93966653
  misc_feature 1..224: note = hyper
  source 1..224: mol_type = genomic DNA

SEQ ID NO: 11355 - DNA, 149 bp, Homo sapiens; identical to SEQ ID NO: 3922
  misc_feature 1..149: note = chr12:93967067-93967216
  misc_feature 1..149: note = hyper
  source 1..149: mol_type = genomic DNA

SEQ ID NO: 11356 - DNA, 544 bp, Homo sapiens
  misc_feature 1..544: note = chr12:94543178-94543722
  misc_feature 1..544: note = hyper
  source 1..544: mol_type = genomic DNA
caactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccacc

SEQ ID NO: 11357 - DNA, 272 bp, Homo sapiens
  misc_feature 1..272: note = chr12:95266922-95267194
  misc_feature 1..272: note = hyper
  source 1..272: mol_type = genomic DNA
cctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccggg

SEQ ID NO: 11358 - skipped

SEQ ID NO: 11359 - DNA, 15 bp, Homo sapiens
  misc_feature 1..15: note = chr12:95267666-95267681
  misc_feature 1..15: note = hyper
  source 1..15: mol_type = genomic DNA
ccggggcctttctgc

SEQ ID NO: 11360 - skipped

SEQ ID NO: 11361 - DNA, 14 bp, Homo sapiens
  misc_feature 1..14: note = chr12:95942964-95942978
  misc_feature 1..14: note = hyper
  source 1..14: mol_type = genomic DNA
gcgtggcaaactcc

SEQ ID NO: 11362 - DNA, 269 bp, Homo sapiens
  misc_feature 1..269: note = chr12:96883445-96883714
  misc_feature 1..269: note = hyper
  source 1..269: mol_type = genomic DNA
ctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttggtaagcgctg

SEQ ID NO: 11363 - DNA, 30 bp, Homo sapiens
  misc_feature 1..30: note = chr12:99287423-99287453
  misc_feature 1..30: note = hyper
  source 1..30: mol_type = genomic DNA
caattccaaagttcccgtgtctctaatcta

SEQ ID NO: 11364 - DNA, 107 bp, Homo sapiens; identical to SEQ ID NO: 3924
  misc_feature 1..107: note = chr12:99288301-99288408
  misc_feature 1..107: note = hyper
  source 1..107: mol_type = genomic DNA

SEQ ID NO: 11365 - DNA, 155 bp, Homo sapiens; identical to SEQ ID NO: 3925
  misc_feature 1..155: note = chr12:99288782-99288937
  misc_feature 1..155: note = hyper
  source 1..155: mol_type = genomic DNA

SEQ ID NO: 11366 - skipped

SEQ ID NO: 11367 - DNA, 93 bp, Homo sapiens; identical to SEQ ID NO: 3927
  misc_feature 1..93: note = chr12:99289161-99289254
  misc_feature 1..93: note = hyper
  source 1..93: mol_type = genomic DNA

SEQ ID NO: 11368 - DNA, 136 bp, Homo sapiens
  misc_feature 1..136: note = chr12:101111302-101111438
  misc_feature 1..136: note = hyper
  source 1..136: mol_type = genomic DNA
gatggcctccctcaccgcatacggtaactggggccgtcgcgggttcctggggcggcggggcggaagggaggggcccagggagccgtcgaaacacccggggaaacttcggggttcgcctctgcggaggggtctggaa

SEQ ID NO: 11369 - DNA, 30 bp, Homo sapiens
  misc_feature 1..30: note = chr12:103311260-103311290
  misc_feature 1..30: note = hyper
  source 1..30: mol_type = genomic DNA
aggtttaggcacttccgggactctcagaag

SEQ ID NO: 11370 - DNA, 60 bp, Homo sapiens
  misc_feature 1..60: note = chr12:103350244-103350304
  misc_feature 1..60: note = hyper
  source 1..60: mol_type = genomic DNA
ggccccgccgggctccgctcccagtcgcctgccaccgggccgccgggcacacgcctgggg

SEQ ID NO: 11371 - DNA, 139 bp, Homo sapiens
  misc_feature 1..139: note = chr12:103350383-103350522
  misc_feature 1..139: note = hyper
  source 1..139: mol_type = genomic DNA
cgccatcactcaacccccgccccgcatctttcttctccgagggtctgggagtatcccagagcactcccttctttatgatatccgctaagctggtccggaaataatctttatggggagggggtggcggtagggggcgatg

SEQ ID NO: 11372 - DNA, 485 bp, Homo sapiens; identical to SEQ ID NO: 1057
  misc_feature 1..485: note = chr12:103351501-103351986
  misc_feature 1..485: note = hyper
  source 1..485: mol_type = genomic DNA

SEQ ID NO: 11373 - DNA, 104 bp, Homo sapiens; identical to SEQ ID NO: 1058
  misc_feature 1..104: note = chr12:103352051-103352155
  misc_feature 1..104: note = hyper
  source 1..104: mol_type = genomic DNA

SEQ ID NO: 11374 - DNA, 97 bp, Homo sapiens; identical to SEQ ID NO: 1059
  misc_feature 1..97: note = chr12:103352170-103352267
  misc_feature 1..97: note = hyper
  source 1..97: mol_type = genomic DNA

SEQ ID NO: 11375 - DNA, 15 bp, Homo sapiens
  misc_feature 1..15: note = chr12:103352268-103352283
  misc_feature 1..15: note = hyper
  source 1..15: mol_type = genomic DNA
cccaagcaagtcaag

SEQ ID NO: 11376 - DNA, 259 bp, Homo sapiens; identical to SEQ ID NO: 1061
  misc_feature 1..259: note = chr12:103352313-103352572
  misc_feature 1..259: note = hyper
  source 1..259: mol_type = genomic DNA

SEQ ID NO: 11377 - DNA, 214 bp, Homo sapiens
  misc_feature 1..214: note = chr12:103358685-103358899
  misc_feature 1..214: note = hyper
  source 1..214: mol_type = genomic DNA
atggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttgattggctgcaggcatgcgtccgctgtcagctgcgc

SEQ ID NO: 11378 - DNA, 177 bp, Homo sapiens
  misc_feature 1..177: note = chr12:103359395-103359572
  misc_feature 1..177: note = hyper
  source 1..177: mol_type = genomic DNA
actttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagc

SEQ ID NO: 11379 - DNA, 69 bp, Homo sapiens
  misc_feature 1..69: note = chr12:103359573-103359642
  misc_feature 1..69: note = hyper
  source 1..69: mol_type = genomic DNA
cagccagccccaccgcctccggactcgaccccaccatagccccgccgtccgaatcgtctctgaaccaaa

SEQ ID NO: 11380 - DNA, 263 bp, Homo sapiens; identical to SEQ ID NO: 1062
  misc_feature 1..263: note = chr12:103889253-103889516
  misc_feature 1..263: note = hyper
  source 1..263: mol_type = genomic DNA

SEQ ID NO: 11381 - DNA, 197 bp, Homo sapiens; identical to SEQ ID NO: 1063
  misc_feature 1..197: note = chr12:103889517-103889714
  misc_feature 1..197: note = hyper
  source 1..197: mol_type = genomic DNA

SEQ ID NO: 11382 - DNA, 24 bp, Homo sapiens
  misc_feature 1..24: note = chr12:103889788-103889812
  misc_feature 1..24: note = hyper
  source 1..24: mol_type = genomic DNA
cgcagtcgccgggcaaccacaatg

SEQ ID NO: 11383 - DNA, 78 bp, Homo sapiens; identical to SEQ ID NO: 1065
  misc_feature 1..78: note = chr12:104609448-104609526
  misc_feature 1..78: note = hyper
  source 1..78: mol_type = genomic DNA

SEQ ID NO: 11384 - DNA, 270 bp, Homo sapiens; identical to SEQ ID NO: 1066
  misc_feature 1..270: note = chr12:104609527-104609797
  misc_feature 1..270: note = hyper
  source 1..270: mol_type = genomic DNA

SEQ ID NO: 11385 - DNA, 194 bp, Homo sapiens
  misc_feature 1..194: note = chr12:104851020-104851214
  misc_feature 1..194: note = hyper
  source 1..194: mol_type = genomic DNA
ccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtga

SEQ ID NO: 11386 - DNA, 68 bp, Homo sapiens
  misc_feature 1..68: note = chr12:104852083-104852151
  misc_feature 1..68: note = hyper
  source 1..68: mol_type = genomic DNA
aggtcctgggctgaccgtccgtttgcatcccccacttctgggatccgagcaacgggaatcccccgggc

SEQ ID NO: 11387 - DNA, 287 bp, Homo sapiens
  misc_feature 1..287: note = chr12:104852152-104852439
  misc_feature 1..287: note = hyper
  source 1..287: mol_type = genomic DNA
gcgtgggaatgaaccccattcctccggtcccttgtggctcaggcaaagttccacgtccgaaatctggactgggggagggacgaggctcgtcgcttcctaggggtgcgagggaaagtttgggttctggagagggaggggcgccctcgagcgcggcggccgggggtgagcagctcggctgcgaagcccaacaggtagaacgttccgagaagccttccgggtaacgcgggtctccccgccaagccgtggctcccctgctcccttttaccctcccttagcagccccctgcc

SEQ ID NO: 11388 - skipped

SEQ ID NO: 11389 - DNA, 61 bp, Homo sapiens
  misc_feature 1..61: note = chr12:104852447-104852508
  misc_feature 1..61: note = hyper
  source 1..61: mol_type = genomic DNA
ttggctcagaaatccattttctacgcctccgagttgcctttctcagcgtagtcacagcaat

SEQ ID NO: 11390 - DNA, 60 bp, Homo sapiens
  misc_feature 1..60: note = chr12:104852725-104852785
  misc_feature 1..60: note = hyper
  source 1..60: mol_type = genomic DNA
cagattccttgacagcgcagggacagacggcccctttgccccactcggtctggagcagtt

SEQ ID NO: 11391 - DNA, 30 bp, Homo sapiens
  misc_feature 1..30: note = chr12:106974353-106974383
  misc_feature 1..30: note = hyper
  source 1..30: mol_type = genomic DNA
cccacctccactctgcgtgcaaaaattata

SEQ ID NO: 11392 - DNA, 41 bp, Homo sapiens
  misc_feature 1..41: note = chr12:106974919-106974960
  misc_feature 1..41: note = hyper
  source 1..41: mol_type = genomic DNA
ctgagaccagggtgacgcaaaggtgtcggccggttaggcac

SEQ ID NO: 11393 - DNA, 38 bp, Homo sapiens
  misc_feature 1..38: note = chr12:106975290-106975328
  misc_feature 1..38: note = hyper
  source 1..38: mol_type = genomic DNA
ggggagggggcggaccgagggggcggggggcgtctttc

SEQ ID NO: 11394 - DNA, 39 bp, Homo sapiens
  misc_feature 1..39: note = chr12:106975543-106975582
  misc_feature 1..39: note = hyper
  source 1..39: mol_type = genomic DNA
cactttatcggggcccgcaggagacgcagcttgctcccc

SEQ ID NO: 11395 - DNA, 50 bp, Homo sapiens
  misc_feature 1..50: note = chr12:106976472-106976522
  misc_feature 1..50: note = hyper
  source 1..50: mol_type = genomic DNA
agccaattttgatttcgcctataatgagtgccgggcgaaggctggagaag

SEQ ID NO: 11396 - DNA, 11 bp, Homo sapiens
  misc_feature 1..11: note = chr12:106976842-106976853
  misc_feature 1..11: note = hyper
  source 1..11: mol_type = genomic DNA
cgctttttctc

SEQ ID NO: 11397 - DNA, 380 bp, Homo sapiens
  misc_feature 1..380: note = chr12:106977375-106977755
  misc_feature 1..380: note = hyper
  source 1..380: mol_type = genomic DNA
gcgcgcgaaggagcgcgctttcgcttgccctggacacaaagttacgtaaagatgcgctggctcgcggcgagctcgaggtgccacttgcagaaactttgccagccgaccgccccctcccggacccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttt

SEQ ID NO: 11398 - DNA, 30 bp, Homo sapiens
  misc_feature 1..30: note = chr12:106979261-106979291
  misc_feature 1..30: note = hyper
  source 1..30: mol_type = genomic DNA
ggtgacatttcactccgacttgcaaaaccg

SEQ ID NO: 11399 - DNA, 89 bp, Homo sapiens
  misc_feature 1..89: note = chr12:106979906-106979995
  misc_feature 1..89: note = hyper
  source 1..89: mol_type = genomic DNA
aaagccccagcttgccgcgcgccgcggtgctccggcaggaggcaaaggcgacaggcgcgcgcaggggcagtcgacgcaccttctggccg

SEQ ID NO: 11400 - DNA, 164 bp, Homo sapiens
  misc_feature 1..164: note = chr12:106980293-106980457
  misc_feature 1..164: note = hyper
  source 1..164: mol_type = genomic DNA
tcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtg

SEQ ID NO: 11401 - DNA, 628 bp, Homo sapiens; identical to SEQ ID NO: 1067
  misc_feature 1..628: note = chr12:106980911-106981539
  misc_feature 1..628: note = hyper
  source 1..628: mol_type = genomic DNA

SEQ ID NO: 11402 - DNA, 298 bp, Homo sapiens
  misc_feature 1..298: note = chr12:107714866-107715164
  misc_feature 1..298: note = hyper
  source 1..298: mol_type = genomic DNA
aggaaatggtagaaacgtaactggagactctaaaggcgaaataaaactttgttacatattcggcggtttggccagaggttgcgcggttggagctgaaatgcagtctttctgggcagatttcattcatgttgctgcctgtctgtttcccgggggctggaggagcactgcggtgggcggtgccaagggtgtgcatgtgcgtgtgagagtctgtgtgcgcgcgcgtctgtgcgtgtgtaagtgtgcttgtgagtgtgcgcaggaacaagcgggcgcgcagggcgcccggctccagccgaag

SEQ ID NO: 11403 - DNA, 492 bp, Homo sapiens; identical to SEQ ID NO: 1068
  misc_feature 1..492: note = chr12:108168922-108169414
  misc_feature 1..492: note = hyper
  source 1..492: mol_type = genomic DNA

SEQ ID NO: 11404 - DNA, 34 bp, Homo sapiens; identical to SEQ ID NO: 1069
  misc_feature 1..34: note = chr12:108169549-108169583
  misc_feature 1..34: note = hyper
  source 1..34: mol_type = genomic DNA

SEQ ID NO: 11405 - DNA, 255 bp, Homo sapiens; identical to SEQ ID NO: 3941
  misc_feature 1..255: note = chr12:108238259-108238514
  misc_feature 1..255: note = hyper
  source 1..255: mol_type = genomic DNA

SEQ ID NO: 11406 - DNA, 345 bp, Homo sapiens
  misc_feature 1..345: note = chr12:108297411-108297756
  misc_feature 1..345: note = hyper
  source 1..345: mol_type = genomic DNA
tgattcctagaaactcgcagggcggcacagcacggcggctcgtggcagcagaagaggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccggcgccgacttggcgatggccagctacacaggtccggcgggggcggcagccatgtggggcgcgggctggcgtggggagcagccc

SEQ ID NO: 11407 - DNA, 43 bp, Homo sapiens
  misc_feature 1..43: note = chr12:110271088-110271131
  misc_feature 1..43: note = hyper
  source 1..43: mol_type = genomic DNA
agatgtccccaggggcgcgaggggacctcggctgagccgcccc

SEQ ID NO: 11408 - DNA, 30 bp, Homo sapiens
  misc_feature 1..30: note = chr12:111127300-111127330
  misc_feature 1..30: note = hyper
  source 1..30: mol_type = genomic DNA
cccgccaacccctttcggggagcttctgct

SEQ ID NO: 11409 - DNA, 372 bp, Homo sapiens
  misc_feature 1..372: note = chr12:111284662-111285034
  misc_feature 1..372: note = hyper
  source 1..372: mol_type = genomic DNA
cttgtcctctcctcccgagggccctgtgccctcccagcggacttgcaggggagaacgtccatgtttgtgcgagtcacaaaggcgcccgttccaggggtcccagaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactggtaagtttcgccgcccgcccggccgcgcctgctgcgccacagctccccctgccagggaaaaggaaagagcggtcgcggtccccagtccattcatatctcgctgccctaagcgttgaaagtatcag

SEQ ID NO: 11410 - DNA, 553 bp, Homo sapiens; identical to SEQ ID NO: 3942
  misc_feature 1..553: note = chr12:111471407-111471960
  misc_feature 1..553: note = hyper
  source 1..553: mol_type = genomic DNA

SEQ ID NO: 11411 - DNA, 138 bp, Homo sapiens; identical to SEQ ID NO: 3943
  misc_feature 1..138: note = chr12:111472058-111472196
  misc_feature 1..138: note = hyper
  source 1..138: mol_type = genomic DNA

SEQ ID NO: 11412 - DNA, 161 bp, Homo sapiens; identical to SEQ ID NO: 3944
  misc_feature 1..161: note = chr12:111472356-111472517
  misc_feature 1..161: note = hyper
  source 1..161: mol_type = genomic DNA

SEQ ID NO: 11413 - DNA, 95 bp, Homo sapiens; identical to SEQ ID NO: 3945
  misc_feature 1..95: note = chr12:111472577-111472672
  misc_feature 1..95: note = hyper
  source 1..95: mol_type = genomic DNA

SEQ ID NO: 11414 - DNA, 166 bp, Homo sapiens; identical to SEQ ID NO: 3946
  misc_feature 1..166: note = chr12:111472851-111473017
  misc_feature 1..166: note = hyper
  source 1..166: mol_type = genomic DNA

SEQ ID NO: 11415 - DNA, 325 bp, Homo sapiens; identical to SEQ ID NO: 1070
  misc_feature 1..325: note = chr12:113012954-113013279
  misc_feature 1..325: note = hyper
  source 1..325: mol_type = genomic DNA

SEQ ID NO: 11416 - DNA, 502 bp, Homo sapiens
  misc_feature 1..502: note = chr12:113494535-113495037
  misc_feature 1..502: note = hyper
  source 1..502: mol_type = genomic DNA
cccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggc

SEQ ID NO: 11417 - DNA, 13 bp, Homo sapiens
  misc_feature 1..13: note = chr12:113495038-113495051
  misc_feature 1..13: note = hyper
  source 1..13: mol_type = genomic DNA
ccccccaggcgga

SEQ ID NO: 11418 - DNA, 79 bp, Homo sapiens; identical to SEQ ID NO: 1071
  misc_feature 1..79: note = chr12:113541522-113541601
  misc_feature 1..79: note = hyper
  source 1..79: mol_type = genomic DNA

SEQ ID NO: 11419 - DNA, 438 bp, Homo sapiens; identical to SEQ ID NO: 1072
  misc_feature 1..438: note = chr12:113541661-113542099
  misc_feature 1..438: note = hyper
  source 1..438: mol_type = genomic DNA

SEQ ID NO: 11420 - DNA, 271 bp, Homo sapiens
  misc_feature 1..271: note = chr12:113592127-113592398
  misc_feature 1..271: note = hyper
  source 1..271: mol_type = genomic DNA
tccaataataaggaacgctggcggccaggtgggatggagagggtaaggcactgcaggcccatgtgagtcccttccccgcccccgactctagttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctg

SEQ ID NO: 11421 - DNA, 401 bp, Homo sapiens; identical to SEQ ID NO: 1073
  misc_feature 1..401: note = chr12:113900758-113901159
  misc_feature 1..401: note = hyper
  source 1..401: mol_type = genomic DNA

SEQ ID NO: 11422 - DNA, 24 bp, Homo sapiens
  misc_feature 1..24: note = chr12:113901407-113901431
  misc_feature 1..24: note = hyper
  source 1..24: mol_type = genomic DNA
cgaagtaggcgggggacccgggac

SEQ ID NO: 11423 - DNA, 124 bp, Homo sapiens
  misc_feature 1..124: note = chr12:113902065-113902189
  misc_feature 1..124: note = hyper
  source 1..124: mol_type = genomic DNA
gaacctccagagaagcggaggctgacaggcccggggagaggaaccgggcagggacaaaccagcggacagagcagagcgcgaaatggttgagaccgggaagcgacctggccgggggaaactggat

SEQ ID NO: 11424 - DNA, 522 bp, Homo sapiens
  misc_feature 1..522: note = chr12:113903021-113903543
  misc_feature 1..522: note = hyper
  source 1..522: mol_type = genomic DNA
taatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccac

SEQ ID NO: 11425 - DNA, 222 bp, Homo sapiens
  misc_feature 1..222: note = chr12:113904807-113905029
  misc_feature 1..222: note = hyper
  source 1..222: mol_type = genomic DNA
gcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggt

SEQ ID NO: 11426 - DNA, 66 bp, Homo sapiens
  misc_feature 1..66: note = chr12:113905673-113905739
  misc_feature 1..66: note = hyper
  source 1..66: mol_type = genomic DNA
aagcaaggcggggggcggaattcagagaggtaaagtgacccgcccccaaatcgcaataccaggagg

SEQ ID NO: 11427 - DNA, 122 bp, Homo sapiens
  misc_feature 1..122: note = chr12:113906312-113906434
  misc_feature 1..122: note = hyper
  source 1..122: mol_type = genomic DNA
ggctacggccagccccgctggattccctcccaaacctgcgacagcccctcccccagggacccggtgcccgcccactctctccaggcggggctgggcctttggaggggcgctcttaagccctc

SEQ ID NO: 11428 - DNA, 190 bp, Homo sapiens
  misc_feature 1..190: note = chr12:113909902-113910092
  misc_feature 1..190: note = hyper
  source 1..190: mol_type = genomic DNA
ccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctcca

SEQ ID NO: 11429 - DNA, 157 bp, Homo sapiens
  misc_feature 1..157: note = chr12:113910529-113910686
  misc_feature 1..157: note = hyper
  source 1..157: mol_type = genomic DNA
ctgtggtgagtgggtcgtacggctgaggcgggggacaccagcgactatgagagcgctgtttgtattcacgccgtgcgggctgggtgtgcaagttcgtcccctcattgggcgcaggagaagcggcgcacgtatgttccgtgctcggcagggcgcccag

SEQ ID NO: 11430 - DNA, 30 bp, Homo sapiens
  misc_feature 1..30: note = chr12:113913002-113913032
  misc_feature 1..30: note = hyper
  source 1..30: mol_type = genomic DNA
atcccgacctaacagcgctaacagatggcg

SEQ ID NO: 11431 - DNA, 332 bp, Homo sapiens; identical to SEQ ID NO: 3952
  misc_feature 1..332: note = chr12:113913350-113913682
  misc_feature 1..332: note = hyper
  source 1..332: mol_type = genomic DNA

SEQ ID NO: 11432 - DNA, 204 bp, Homo sapiens
  misc_feature 1..204: note = chr12:113914020-113914224
  misc_feature 1..204: note = hyper
  source 1..204: mol_type = genomic DNA
ctggctttctccctccgacaaaagtgtaattattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccgg

SEQ ID NO: 11433 - DNA, 35 bp, Homo sapiens
  misc_feature 1..35: note = chr12:113914300-113914335
  misc_feature 1..35: note = hyper
  source 1..35: mol_type = genomic DNA
cgggccagagaggacgccggcggggtgcaatgggt

SEQ ID NO: 11434 - DNA, 328 bp, Homo sapiens
  misc_feature 1..328: note = chr12:113916261-113916589
  misc_feature 1..328: note = hyper
  source 1..328: mol_type = genomic DNA
ctttggcagccccagcgctgcgtgtgtgtgtgtgtgcctgcgtgtgtgtgtgcgcgtgtgtgtgtgtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccc

SEQ ID NO: 11435 - DNA, 84 bp, Homo sapiens
  misc_feature 1..84: note = chr12:113917379-113917463
  misc_feature 1..84: note = hyper
  source 1..84: mol_type = genomic DNA
gcagcttgttgaactcggagccagacgctttttctggcgaaacggagaaaaaacgccgcggaaacggtgcgcagggttggggag

SEQ ID NO: 11436 - DNA, 110 bp, Homo sapiens
  misc_feature 1..110: note = chr12:113917751-113917861
  misc_feature 1..110: note = hyper
  source 1..110: mol_type = genomic DNA
gcagtgacagtgaaacgaattccaaacccattctgaactcgccatggcgctctcctgccctccaacacccaccccaaacaccgtgtaggcagaagcgaggttccccgtga

SEQ ID NO: 11437 - DNA, 170 bp, Homo sapiens
  misc_feature 1..170: note = chr12:113952952-113953122
  misc_feature 1..170: note = hyper
  source 1..170: mol_type = genomic DNA
tggaggccaaggggccgccgcccgggctgcagctgaaacggcgctttcacaaacaagacgtaaattggatgcaaacatctaattaaccttctccctcagttccctccgcagagggggaggtgggcctcctagggctcccagcgcctgtcttccctcgggggatggatttg

SEQ ID NO: 11438 - DNA, 295 bp, Homo sapiens
  misc_feature 1..295: note = chr12:113957660-113957955
  misc_feature 1..295: note = hyper
  source 1..295: mol_type = genomic DNA
tcctcaggtgcatcccgaggctggacaatttgtctctgtgaaaaggacgctattatcagagaggctggatgcaggcggagggcgggcccgaggggcggcttgggagggggaggctcggaggagcgaaggggctcaggcaggggtgggggggcggaggccgagacaatggggggaaaaataataaatacatcggagcgtgccagccgcggggatcctggctggagaggcgcgaggggcaggggggctgcttggggctggaggagctcatgtgctcgggcctcggaagccaattcct

SEQ ID NO: 11439 - DNA, 66 bp, Homo sapiens
  misc_feature 1..66: note = chr12:114029765-114029831
  misc_feature 1..66: note = hyper
  source 1..66: mol_type = genomic DNA
tctccctcagcacctcggcacctcggaggagcttctgctaattcactaccccgacaccgtctcatc

SEQ ID NO: 11440 - DNA, 41 bp, Homo sapiens
  misc_feature 1..41: note = chr12:114075780-114075821
  misc_feature 1..41: note = hyper
  source 1..41: mol_type = genomic DNA
gctcgagttcaaggacgcagagaggacgggagggggttaaa

SEQ ID NO: 11441 - DNA, 46 bp, Homo sapiens
  misc_feature 1..46: note = chr12:114076041-114076087
  misc_feature 1..46: note = hyper
  source 1..46: mol_type = genomic DNA
ggccggccacaaaggcgccagaaaaccctgccgtgttcggaagggt

SEQ ID NO: 11442 - DNA, 117 bp, Homo sapiens
  misc_feature 1..117: note = chr12:114833985-114834102
  misc_feature 1..117: note = hyper
  source 1..117: mol_type = genomic DNA
ggccccgcggctgcccgaccccgggccgcgcgtctctaatctccggccgccgtggcccggccgcctccccggccgatagcgacgccgaccggggcggcgtggcgacagagagacgca

SEQ ID NO: 11443 - DNA, 358 bp, Homo sapiens; identical to SEQ ID NO: 3953
  misc_feature 1..358: note = chr12:114838380-114838738
  misc_feature 1..358: note = hyper
  source 1..358: mol_type = genomic DNA

SEQ ID NO: 11444 - DNA, 86 bp, Homo sapiens
  misc_feature 1..86: note = chr12:114841046-114841132
  misc_feature 1..86: note = hyper
  source 1..86: mol_type = genomic DNA
gcgcgcgggtctagtcggcggcgcggaggaggcaggaggaggcaggaggaggcgggaggaggcgaaggctacggaagatcagaaga

SEQ ID NO: 11445 - DNA, 72 bp, Homo sapiens
  misc_feature 1..72: note = chr12:114843007-114843079
  misc_feature 1..72: note = hyper
  source 1..72: mol_type = genomic DNA
gcaagcagctttcttcgcctcgttctcggggcttcagggaggcggcgactggagccccgctgcctactcaca

SEQ ID NO: 11446 - DNA, 375 bp, Homo sapiens
  misc_feature 1..375: note = chr12:114843285-114843660
  misc_feature 1..375: note = hyper
  source 1..375: mol_type = genomic DNA
cggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctcccta

SEQ ID NO: 11447 - DNA, 116 bp, Homo sapiens; identical to SEQ ID NO: 3954
  misc_feature 1..116: note = chr12:114844184-114844300
  misc_feature 1..116: note = hyper
  source 1..116: mol_type = genomic DNA

SEQ ID NO: 11448 - DNA, 30 bp, Homo sapiens
  misc_feature 1..30: note = chr12:114846013-114846043
  misc_feature 1..30: note = hyper
  source 1..30: mol_type = genomic DNA
gccacaggttccggacgtcttggccccggg

SEQ ID NO: 11449 - DNA, 476 bp, Homo sapiens; identical to SEQ ID NO: 3955
  misc_feature 1..476: note = chr12:114846471-114846947
  misc_feature 1..476: note = hyper
  source 1..476: mol_type = genomic DNA

SEQ ID NO: 11450 - DNA, 122 bp, Homo sapiens; identical to SEQ ID NO: 3956
  misc_feature 1..122: note = chr12:114847042-114847164
  misc_feature 1..122: note = hyper
  source 1..122: mol_type = genomic DNA

SEQ ID NO: 11451 - DNA, 272 bp, Homo sapiens; identical to SEQ ID NO: 3957
  misc_feature 1..272: note = chr12:114847165-114847437
  misc_feature 1..272: note = hyper
  source 1..272: mol_type = genomic DNA

SEQ ID NO: 11452 - DNA, 78 bp, Homo sapiens; identical to SEQ ID NO: 3958
  misc_feature 1..78: note = chr12:114847577-114847655
  misc_feature 1..78: note = hyper
  source 1..78: mol_type = genomic DNA

SEQ ID NO: 11453 - DNA, 30 bp, Homo sapiens
  misc_feature 1..30: note = chr12:114877303-114877333
  misc_feature 1..30: note = hyper
  source 1..30: mol_type = genomic DNA
gctggtgaggccacccgctttgggacagaa

SEQ ID NO: 11454 - DNA, 32 bp, Homo sapiens
  misc_feature 1..32: note = chr12:114878562-114878594
  misc_feature 1..32: note = hyper
  source 1..32: mol_type = genomic DNA
cagcgcgcgcatctgcggcactggctaaatcc

SEQ ID NO: 11455 - DNA, 204 bp, Homo sapiens
  misc_feature 1..204: note = chr12:114878808-114879012
  misc_feature 1..204: note = hyper
  source 1..204: mol_type = genomic DNA
cgggaattgccacagacgcccgatttcctcggtgccatgtgggctcctagctgccgccacagagcggccggatcctaccagggtttcccagtgcccgggtacctgcaagaatcttcccaggacgggagcagtgggcactgagcagcgctgccgggagaaagatgttgcgttttgccaagcgctcacccgcgcttcaaaacccca

SEQ ID NO: 11456 - DNA, 390 bp, Homo sapiens
  misc_feature 1..390: note = chr12:114881656-114882046
  misc_feature 1..390: note = hyper
  source 1..390: mol_type = genomic DNA
gtcgctgggcgcgcgcgcgcggagcaaatttgcccgcgcgcacccagaaacgatgacataagtggcgctgatgagcgctgcgcggctgaaacgcgactacataaagggtccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgac

SEQ ID NO: 11457 - DNA, 62 bp, Homo sapiens
  misc_feature 1..62: note = chr12:114883473-114883535
  misc_feature 1..62: note = hyper
  source 1..62: mol_type = genomic DNA
acataaatcctgcttcgagattaatctccctgctcgctcgcgctgggcgcagtgattttttt

SEQ ID NO: 11458 - DNA, 78 bp, Homo sapiens
  misc_feature 1..78: note = chr12:114918587-114918665
  misc_feature 1..78: note = hyper
  source 1..78: mol_type = genomic DNA
ggagaaggcaagatccggcaggcgacgctgattagctgggggtctccgatgcgaccccggactcggagcaggaaatcc

SEQ ID NO: 11459 - DNA, 38 bp, Homo sapiens
  misc_feature 1..38: note = chr12:115106464-115106502
  misc_feature 1..38: note = hyper
  source 1..38: mol_type = genomic DNA
cttttttccccaattcgggagagcgcaaccagccaact

SEQ ID NO: 11460 - DNA, 36 bp, Homo sapiens
  misc_feature 1..36: note = chr12:115121885-115121921
  misc_feature 1..36: note = hyper
  source 1..36: mol_type = genomic DNA
agagagagagagagacggagtcggagagggagggag

SEQ ID NO: 11461 - DNA, 20 bp, Homo sapiens
  misc_feature 1..20: note = chr12:116946180-116946200
  misc_feature 1..20: note = hyper
  source 1..20: mol_type = genomic DNA
ctggtccccaggctgcgcct

SEQ ID NO: 11462 - DNA, 261 bp, Homo sapiens
  misc_feature 1..261: note = chr12:117319805-117320066
  misc_feature 1..261: note = hyper
  source 1..261: mol_type = genomic DNA
ctaaagtgcccccagcgcccggtgggaggctggatgggcccacctgagctcgcgtggggcgcggacggaggcattctcgctgcccggcacccgcacccaaaagaccctcgcaaggggctttctaaagggaaacttcttgtctgctttctttgtgaacattattttcctgatggcgttacagttttctgcgatgaccccgatttaatgcgcagtggagaccctaaggggtcggcgagaggaggggcgcgggggactttaatt

SEQ ID NO: 11463 - DNA, 282 bp, Homo sapiens
  misc_feature 1..282: note = chr12:117798084-117798366
  misc_feature 1..282: note = hyper
  source 1..282: mol_type = genomic DNA
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagag

SEQ ID NO: 11464 - DNA, 131 bp, Homo sapiens; identical to SEQ ID NO: 3959
  misc_feature 1..131: note = chr12:117799330-117799461
  misc_feature 1..131: note = hyper
  source 1..131: mol_type = genomic DNA

SEQ ID NO: 11465 - DNA, 58 bp, Homo sapiens; identical to SEQ ID NO: 3960
  misc_feature 1..58: note = chr12:119212142-119212200
  misc_feature 1..58: note = hyper
  source 1..58: mol_type = genomic DNA

SEQ ID NO: 11466 - DNA, 63 bp, Homo sapiens; identical to SEQ ID NO: 3961
  misc_feature 1..63: note = chr12:119212318-119212381
  misc_feature 1..63: note = hyper
  source 1..63: mol_type = genomic DNA

SEQ ID NO: 11467 - DNA, 363 bp, Homo sapiens
  misc_feature 1..363: note = chr12:119418576-119418939
  misc_feature 1..363: note = hyper
  source 1..363: mol_type = genomic DNA
actctttcctctggacggggttggcggcggggacgctgggcaggccggctgtgagacacaaaagagatacccttgacagctccgcatgcacagatgtaacgctgcgccccttggcgggcgggggccctgctcggcagatggcgagaagccgaattggtgagggattgtctatcaaatggcactttctgggtggtggagacctcgctaacccccggcgcaaagaggaacgcagggcaccctctgtaccggcctaggccgtgtctcccaaaagtgagggtctgggggaggccggctggggtggatagattaagttttttacgagcccccccaaccccccccccccccccacgcagaagatcagct

SEQ ID NO: 11468 - DNA, 314 bp, Homo sapiens
  misc_feature 1..314: note = chr12:119419436-119419750
  misc_feature 1..314: note = hyper
  source 1..314: mol_type = genomic DNA
tcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaa

SEQ ID NO: 11469 - DNA, 364 bp, Homo sapiens; identical to SEQ ID NO: 3962
  misc_feature 1..364: note = chr12:120032837-120033201
  misc_feature 1..364: note = hyper
  source 1..364: mol_type = genomic DNA

SEQ ID NO: 11470 - DNA, 30 bp, Homo sapiens
  misc_feature 1..30: note = chr12:120807882-120807912
  misc_feature 1..30: note = hyper
  source 1..30: mol_type = genomic DNA
actcctgtcctgattcgggaaacccggttc

SEQ ID NO: 11471 - DNA, 30 bp, Homo sapiens
  misc_feature 1..30: note = chr12:121566850-121566880
  misc_feature 1..30: note = hyper
  source 1..30: mol_type = genomic DNA
gaggttggcccttgacgccctgtgtgatta

SEQ ID NO: 11472 - DNA, 372 bp, Homo sapiens
  misc_feature 1..372: note = chr12:122688669-122689041
  misc_feature 1..372: note = hyper
  source 1..372: mol_type = genomic DNA
gtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccg

SEQ ID NO: 11473 - DNA, 58 bp, Homo sapiens
  misc_feature 1..58: note = chr12:123920539-123920597
  misc_feature 1..58: note = hyper
  source 1..58: mol_type = genomic DNA
aaaagaaaaggaaggcgtctccctgccagtaggtgccctcctacgccccgcaggcgcc

SEQ ID NO: 11474 - DNA, 376 bp, Homo sapiens
  misc_feature 1..376: note = chr12:125534027-125534403
  misc_feature 1..376: note = hyper
  source 1..376: mol_type = genomic DNA
agtcaagctagaggtcgtgaccccctggagtctcggtggtttcgggttggggagcagagcgggtggggcaggaccgactcgccggtgccagtcaggatatcaaggtgacagcgcccggcactggccttggtcgaagggtgactccgccccattgctaagctccgattgggcacgcccttttctggttcttcttcaggattggctgggaggtgcggcctatgaaccggaacgcgtcgcgattggttggcgctcaggccgatcttccagacgcggaggcctgggccgatgtggcccaactctctgccagccaatcagcgctcgggctgagtgtggcgcgtgagtgtgtccgggatccctccgccgcccgggcgttggg

SEQ ID NO: 11475 - DNA, 144 bp, Homo sapiens
  misc_feature 1..144: note = chr12:125670117-125670261
  misc_feature 1..144: note = hyper
  source 1..144: mol_type = genomic DNA
cgaccacctagtacccggccctgcgcaacacctccgctccgtcactgcctgaccctgcgctgggaactcattcccgggaccgccagggaatctgcccttcccaggagaactcctggctgcctccgcgtgctcctagggcctgcg

SEQ ID NO: 11476 - DNA, 72 bp, Homo sapiens
  misc_feature 1..72: note = chr12:125670334-125670406
  misc_feature 1..72: note = hyper
  source 1..72: mol_type = genomic DNA
cgccttcgctgtgtttcaggtcaccgcacccagcctgcgcacccctagcccccatcccggtgccgtgcagag

SEQ ID NO: 11477 - DNA, 84 bp, Homo sapiens
  misc_feature 1..84: note = chr12:125671581-125671665
  misc_feature 1..84: note = hyper
  source 1..84: mol_type = genomic DNA
cgcctggggagagcccgcctgccttctcccccaaacccttagcttccttgcggatcctttcgggacgcacgggggccacagacc

SEQ ID NO: 11478 - DNA, 128 bp, Homo sapiens
  misc_feature 1..128: note = chr12:125672764-125672892
  misc_feature 1..128: note = hyper
  source 1..128: mol_type = genomic DNA
tggcattgggcttaacgtggatgaatcttgcctgcttggctaaggagcagctatgatagctgttttgctttcggcattcctctgcggtccacgagaggggctgctgctggggccgaggctgttttctc

SEQ ID NO: 11479 - DNA, 117 bp, Homo sapiens
  misc_feature 1..117: note = chr12:126168505-126168622
  misc_feature 1..117: note = hyper
  source 1..117: mol_type = genomic DNA
tggaggctgggccagcgttgcgagtcttgccagggacgcgcgctctagcgccggaggctgggaacgcaccgcggtgccaccgcgtcctgcaggggcggggcgcgcacctggggatgc

SEQ ID NO: 11480 - DNA, 30 bp, Homo sapiens
  misc_feature 1..30: note = chr12:126675806-126675836
  misc_feature 1..30: note = hyper
  source 1..30: mol_type = genomic DNA
cgggcgcactttccccgcctgcatctgagg

SEQ ID NO: 11481 - DNA, 30 bp, Homo sapiens
  misc_feature 1..30: note = chr12:127212512-127212542
  misc_feature 1..30: note = hyper
  source 1..30: mol_type = genomic DNA
acttaccgtaaggtgcggggtcttcttagg

SEQ ID NO: 11482 - DNA, 270 bp, Homo sapiens
  misc_feature 1..270: note = chr12:127765179-127765449
  misc_feature 1..270: note = hyper
  source 1..270: mol_type = genomic DNA
tgcgcgcttcttcctcgggagagcttccactgatttaattggatatggggatggagagaggaaacagaaacagggaaagaagtgaaaaagggaaggacggggcgcgcgcggcaggggggcaggcggcctggtgcaggtgcatccccaggtgcgcgccacgcccctgcgggacccggcggcaccgcggtgcgttcccagccgccggcgctagagggcgtgtctgcggaaagactcgctgcgctggcccaggctccacgaggggccgacagg

SEQ ID NO: 11483 - DNA, 127 bp, Homo sapiens
  misc_feature 1..127: note = chr12:127865735-127865862
  misc_feature 1..127: note = hyper
  source 1..127: mol_type = genomic DNA
ggctctgggagcctccgcggggaggggagggcgcgcggccggcgcggccacaacccggtctgcggcgccatctagcgggcgcgccgggaccgtcgcccactaggcccttttccggaggagaagctga

SEQ ID NO: 11484 - DNA, 103 bp, Homo sapiens
  misc_feature 1..103: note = chr12:128751340-128751443
  misc_feature 1..103: note = hyper
  source 1..103: mol_type = genomic DNA
cagctccgccttgagcgtcgggtccctgggcaggaccctccgggccacgggccgctgtccgttgggcacccgggcaggagtctgcgaacgctgagtttctctg

SEQ ID NO: 11485 - DNA, 153 bp, Homo sapiens; identical to SEQ ID NO: 3963
  misc_feature 1..153: note = chr12:128752114-128752267
  misc_feature 1..153: note = hyper
  source 1..153: mol_type = genomic DNA

SEQ ID NO: 11486 - DNA, 73 bp, Homo sapiens
  misc_feature 1..73: note = chr12:128752499-128752572
  misc_feature 1..73: note = hyper
  source 1..73: mol_type = genomic DNA
ccaggagggaaggcccggttctttgcatcccctttccgcaaccgctagggtctctgtgcgggccctagaggaa

SEQ ID NO: 11487 - DNA, 422 bp, Homo sapiens
  misc_feature 1..422: note = chr12:128752818-128753240
  misc_feature 1..422: note = hyper
  source 1..422: mol_type = genomic DNA
cgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 11488 - DNA, 53 bp, Homo sapiens; identical to SEQ ID NO: 1075
  misc_feature 1..53: note = chr12:129337857-129337910
  misc_feature 1..53: note = hyper
  source 1..53: mol_type = genomic DNA

SEQ ID NO: 11489 - DNA, 239 bp, Homo sapiens; identical to SEQ ID NO: 1076
  misc_feature 1..239: note = chr12:129338587-129338826
  misc_feature 1..239: note = hyper
  source 1..239: mol_type = genomic DNA

SEQ ID NO: 11490 - DNA, 55 bp, Homo sapiens; identical to SEQ ID NO: 1077
  misc_feature 1..55: note = chr12:129338851-129338906
  misc_feature 1..55: note = hyper
  source 1..55: mol_type = genomic DNA

SEQ ID NO: 11491 - DNA, 118 bp, Homo sapiens
  misc_feature 1..118: note = chr12:130387796-130387914
  misc_feature 1..118: note = hyper
  source 1..118: mol_type = genomic DNA
cgtcctcacctttggaaaacagggcggccaggctgatgagtaccggcgaccagtggtgccacagcgtccccatctcagacgggcacatcctggagacccggagcgcagatcctccgct

SEQ ID NO: 11492 - DNA, 156 bp, Homo sapiens; identical to SEQ ID NO: 3967
  misc_feature 1..156: note = chr12:130388279-130388435
  misc_feature 1..156: note = hyper
  source 1..156: mol_type = genomic DNA

SEQ ID NO: 11493 - DNA, 140 bp, Homo sapiens; identical to SEQ ID NO: 3968
  misc_feature 1..140: note = chr12:130389012-130389152
  misc_feature 1..140: note = hyper
  source 1..140: mol_type = genomic DNA

SEQ ID NO: 11494 - DNA, 42 bp, Homo sapiens
  misc_feature 1..42: note = chr12:130526846-130526888
  misc_feature 1..42: note = hyper
  source 1..42: mol_type = genomic DNA
caacaggctcctgcccggttcacctggggaagcgcagggctg

SEQ ID NO: 11495 - DNA, 121 bp, Homo sapiens
  misc_feature 1..121: note = chr12:130526931-130527052
  misc_feature 1..121: note = hyper
  source 1..121: mol_type = genomic DNA
cggcagcttgcagggcccgctgtctccactagggggcggcgtacgcgcgtctctcgaagccgggacccgcgcggggaggctgcactggctggaaacagcgcctgggcgctcccgcggctcc

SEQ ID NO: 11496 - DNA, 73 bp, Homo sapiens
  misc_feature 1..73: note = chr12:130589236-130589309
  misc_feature 1..73: note = hyper
  source 1..73: mol_type = genomic DNA
agcacgttgctatcccggatgaagggccatttcagccctaagctcaaagccggagctccgaccagcactctca

SEQ ID NO: 11497 - DNA, 333 bp, Homo sapiens
  misc_feature 1..333: note = chr12:130645294-130645627
  misc_feature 1..333: note = hyper
  source 1..333: mol_type = genomic DNA
gaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagaga

SEQ ID NO: 11498 - DNA, 30 bp, Homo sapiens
  misc_feature 1..30: note = chr12:130646183-130646213
  misc_feature 1..30: note = hyper
  source 1..30: mol_type = genomic DNA
caagcccgcacttcccgcggggtgggaggc

SEQ ID NO: 11499 - DNA, 21 bp, Homo sapiens
  misc_feature 1..21: note = chr12:130646633-130646654
  misc_feature 1..21: note = hyper
  source 1..21: mol_type = genomic DNA
cgccgggaaagggggcgccgg

SEQ ID NO: 11500 - DNA, 118 bp, Homo sapiens
  misc_feature 1..118: note = chr12:130646955-130647073
  misc_feature 1..118: note = hyper
  source 1..118: mol_type = genomic DNA
ggcggggcctgtcagcgctcggcttttctgcccccctttgcctttttgcgagtcttctcatcccgggacgcaaacctcgaaacagctgccggctggtcccggccgaggccggcgcagg

SEQ ID NO: 11501 - DNA, 120 bp, Homo sapiens; identical to SEQ ID NO: 1078
  misc_feature 1..120: note = chr12:130647950-130648070
  misc_feature 1..120: note = hyper
  source 1..120: mol_type = genomic DNA

SEQ ID NO: 11502 - DNA, 118 bp, Homo sapiens
  misc_feature 1..118: note = chr12:131200387-131200505
  misc_feature 1..118: note = hyper
  source 1..118: mol_type = genomic DNA
cggggccgtgtccatcgggtgccaaactttgcctggaggggcctttcttaaaagcctggggtgggggccatgacagagccacagcacccctgcagctgacacccggcacccaggaaga

SEQ ID NO: 11503 - DNA, 77 bp, Homo sapiens
  misc_feature 1..77: note = chr12:132312753-132312830
  misc_feature 1..77: note = hyper
  source 1..77: mol_type = genomic DNA
gcgtcctaagacacccggggaaacgccttccctgtgatgccgcggacccagtcccgtcgcggacacggcggggcggg

SEQ ID NO: 11504 - DNA, 33 bp, Homo sapiens
  misc_feature 1..33: note = chr12:132312856-132312889
  misc_feature 1..33: note = hyper
  source 1..33: mol_type = genomic DNA
cgggccctttaaggcggccggcctcgttagcat

SEQ ID NO: 11505 - DNA, 298 bp, Homo sapiens
  misc_feature 1..298: note = chr12:132313288-132313586
  misc_feature 1..298: note = hyper
  source 1..298: mol_type = genomic DNA
agtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttcc

SEQ ID NO: 11506 - DNA, 78 bp, Homo sapiens
  misc_feature 1..78: note = chr12:133194973-133195051
  misc_feature 1..78: note = hyper
  source 1..78: mol_type = genomic DNA
cgaagccccggcagccgcggcaggaaccggcctggacggggtggggggcgccgcggaggccggcgggacttcccatgt

SEQ ID NO: 11507 - DNA, 30 bp, Homo sapiens
  misc_feature 1..30: note = chr12:133195488-133195518
  misc_feature 1..30: note = hyper
  source 1..30: mol_type = genomic DNA
gacgcccaaggtgatcgtggtgaggaaccg

SEQ ID NO: 11508 - DNA, 33 bp, Homo sapiens
  misc_feature 1..33: note = chr12:133463690-133463723
  misc_feature 1..33: note = hyper
  source 1..33: mol_type = genomic DNA
gagcgcacactgcaccgccgcccgtgtggcctg

SEQ ID NO: 11509 - DNA, 61 bp, Homo sapiens
  misc_feature 1..61: note = chr12:133464480-133464541
  misc_feature 1..61: note = hyper
  source 1..61: mol_type = genomic DNA
cctaggagtagaagacggtccatcttagttgtcacgaggtagtgcacgtggggaccctttc

SEQ ID NO: 11510 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 11511 - DNA, 31 bp, Homo sapiens; identical to SEQ ID NO: 1080
  misc_feature 1..31: note = chr12:133481489-133481520
  misc_feature 1..31: note = hyper
  source 1..31: mol_type = genomic DNA

SEQ ID NO: 11512 - DNA, 134 bp, Homo sapiens; identical to SEQ ID NO: 1081
  misc_feature 1..134: note = chr12:133481521-133481655
  misc_feature 1..134: note = hyper
  source 1..134: mol_type = genomic DNA

SEQ ID NO: 11513 - DNA, 187 bp, Homo sapiens; identical to SEQ ID NO: 1082
  misc_feature 1..187: note = chr12:133485161-133485348
  misc_feature 1..187: note = hyper
  source 1..187: mol_type = genomic DNA

SEQ ID NO: 11514 - DNA, 251 bp, Homo sapiens; identical to SEQ ID NO: 1083
  misc_feature 1..251: note = chr12:133485439-133485690
  misc_feature 1..251: note = hyper
  source 1..251: mol_type = genomic DNA

SEQ ID NO: 11515 - DNA, 67 bp, Homo sapiens
  misc_feature 1..67: note = chr13:20735465-20735532
  misc_feature 1..67: note = hyper
  source 1..67: mol_type = genomic DNA
catgcccgcgcgggacgtgagaggagagccgagggctgttggggcgggcccgacccgcttgcggggc

SEQ ID NO: 11516 - DNA, 490 bp, Homo sapiens
  misc_feature 1..490: note = chr13:20735533-20736023
  misc_feature 1..490: note = hyper
  source 1..490: mol_type = genomic DNA
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgt

SEQ ID NO: 11517 - DNA, 30 bp, Homo sapiens
  misc_feature 1..30: note = chr13:20805970-20806000
  misc_feature 1..30: note = hyper
  source 1..30: mol_type = genomic DNA
agtcaaaggggaccacgctggggtaaaagt

SEQ ID NO: 11518 - DNA, 43 bp, Homo sapiens
  misc_feature 1..43: note = chr13:21520313-21520356
  misc_feature 1..43: note = hyper
  source 1..43: mol_type = genomic DNA
agggtgtgaagagatcgggagtcctctgcgaggctctggagca

SEQ ID NO: 11519 - DNA, 30 bp, Homo sapiens
  misc_feature 1..30: note = chr13:21634799-21634829
  misc_feature 1..30: note = hyper
  source 1..30: mol_type = genomic DNA
aggcggcgcagccaccgggggctgaggggc

SEQ ID NO: 11520 - DNA, 419 bp, Homo sapiens
  misc_feature 1..419: note = chr13:21649623-21650042
  misc_feature 1..419: note = hyper
  source 1..419: mol_type = genomic DNA
aaataatcacagaaacgaatatctgctgcgaagcagtaggaagtgccctgcggtctgtttcccctagcagagactggccttgtggcggaagacccccgcgcgtagggagggccggtgcggcgactccgggcggggcgcgctgttggtgtccagggcgcggagcctgcgccagcttcacaaaagcggtgtggacgcctgagccagtccgctcttgctggacggctccccatagtttagcccaaaaatccccctctgggtggctctggcaggagtgatttagggccacaattaggttggacgaggagtggggacttgccccgagctgcctttgcagacccggcggcggcgttctccccaaggctgcccgcttggctgcgcggctgaggcgagttgaggacccagcccgtccccaactctcc

SEQ ID NO: 11521 - DNA, 30 bp, Homo sapiens
  misc_feature 1..30: note = chr13:22243439-22243469
  misc_feature 1..30: note = hyper
  source 1..30: mol_type = genomic DNA
ctgctgtaaataccacggggcagggctctc

SEQ ID NO: 11522 - DNA, 243 bp, Homo sapiens
  misc_feature 1..243: note = chr13:23489728-23489971
  misc_feature 1..243: note = hyper
  source 1..243: mol_type = genomic DNA
aaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcg

SEQ ID NO: 11523 - DNA, 481 bp, Homo sapiens; identical to SEQ ID NO: 1084
  misc_feature 1..481: note = chr13:23733629-23734110
  misc_feature 1..481: note = hyper
  source 1..481: mol_type = genomic DNA

SEQ ID NO: 11524 - DNA, 59 bp, Homo sapiens
  misc_feature 1..59: note = chr13:24153660-24153719
  misc_feature 1..59: note = hyper
  source 1..59: mol_type = genomic DNA
ctgggaaggtaggtgcgtcgctgtccccggcgcgcggcgtcccgcgaggtcttcagccc

SEQ ID NO: 11525 - DNA, 218 bp, Homo sapiens
  misc_feature 1..218: note = chr13:24477613-24477831
  misc_feature 1..218: note = hyper
  source 1..218: mol_type = genomic DNA
aggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggg

SEQ ID NO: 11526 - DNA, 138 bp, Homo sapiens
  misc_feature 1..138: note = chr13:25255004-25255142
  misc_feature 1..138: note = hyper
  source 1..138: mol_type = genomic DNA
ggggcaaggggaggccgcctttcctctgagcgccccccggcctgggcaccgcttctctgactccccgccacggctccgtgcggccgccggggctggctggggaaagaagccagtccagaggagcgagaaggggccaag

SEQ ID NO: 11527 - DNA, 75 bp, Homo sapiens; identical to SEQ ID NO: 1085
  misc_feature 1..75: note = chr13:25319830-25319905
  misc_feature 1..75: note = hyper
  source 1..75: mol_type = genomic DNA

SEQ ID NO: 11528 - DNA, 70 bp, Homo sapiens; identical to SEQ ID NO: 3977
  misc_feature 1..70: note = chr13:25320387-25320457
  misc_feature 1..70: note = hyper
  source 1..70: mol_type = genomic DNA

SEQ ID NO: 11529 - DNA, 295 bp, Homo sapiens; identical to SEQ ID NO: 1086
  misc_feature 1..295: note = chr13:25320734-25321029
  misc_feature 1..295: note = hyper
  source 1..295: mol_type = genomic DNA

SEQ ID NO: 11530 - DNA, 1072 bp, Homo sapiens; identical to SEQ ID NO: 1087
  misc_feature 1..1072: note = chr13:25321112-25322184
  misc_feature 1..1072: note = hyper
  source 1..1072: mol_type = genomic DNA

SEQ ID NO: 11531 - DNA, 32 bp, Homo sapiens
  misc_feature 1..32: note = chr13:25620922-25620954
  misc_feature 1..32: note = hyper
  source 1..32: mol_type = genomic DNA
gtgaagcatcagacacgctggcgcatggggac

SEQ ID NO: 11532 - DNA, 13 bp, Homo sapiens
  misc_feature 1..13: note = chr13:25620955-25620968
  misc_feature 1..13: note = hyper
  source 1..13: mol_type = genomic DNA
aggagccctggag

SEQ ID NO: 11533 - DNA, 52 bp, Homo sapiens
  misc_feature 1..52: note = chr13:25621342-25621394
  misc_feature 1..52: note = hyper
  source 1..52: mol_type = genomic DNA
ggaaactgtcctgggcgcgcaccgcccccgtgccctgcgccctcctcatttg

SEQ ID NO: 11534 - DNA, 26 bp, Homo sapiens
  misc_feature 1..26: note = chr13:25744709-25744735
  misc_feature 1..26: note = hyper
  source 1..26: mol_type = genomic DNA
aggcagggtctggggcggcgggcgcc

SEQ ID NO: 11535 - DNA, 295 bp, Homo sapiens; identical to SEQ ID NO: 1089
  misc_feature 1..295: note = chr13:25745300-25745595
  misc_feature 1..295: note = hyper
  source 1..295: mol_type = genomic DNA

SEQ ID NO: 11536 - DNA, 221 bp, Homo sapiens; identical to SEQ ID NO: 1090
  misc_feature 1..221: note = chr13:25745726-25745947
  misc_feature 1..221: note = hyper
  source 1..221: mol_type = genomic DNA

SEQ ID NO: 11537 - DNA, 39 bp, Homo sapiens
  misc_feature 1..39: note = chr13:25945978-25946017
  misc_feature 1..39: note = hyper
  source 1..39: mol_type = genomic DNA
ccaagccctccccatcgccttccccgacacctaaaagcc

SEQ ID NO: 11538 - DNA, 76 bp, Homo sapiens
  misc_feature 1..76: note = chr13:25946300-25946376
  misc_feature 1..76: note = hyper
  source 1..76: mol_type = genomic DNA
cgtagcctccgtctctcgcccggggccgccgagcccccgacacgggcgagatgctgaacggcgcaggcctggacaa

SEQ ID NO: 11539 - DNA, 54 bp, Homo sapiens; identical to SEQ ID NO: 1091
  misc_feature 1..54: note = chr13:25946620-25946674
  misc_feature 1..54: note = hyper
  source 1..54: mol_type = genomic DNA

SEQ ID NO: 11540 - DNA, 18 bp, Homo sapiens
  misc_feature 1..18: note = chr13:25946801-25946819
  misc_feature 1..18: note = hyper
  source 1..18: mol_type = genomic DNA
cggcgcagagaagatgca

SEQ ID NO: 11541 - DNA, 403 bp, Homo sapiens; identical to SEQ ID NO: 3985
  misc_feature 1..403: note = chr13:26042768-26043171
  misc_feature 1..403: note = hyper
  source 1..403: mol_type = genomic DNA

SEQ ID NO: 11542 - DNA, 159 bp, Homo sapiens; identical to SEQ ID NO: 3986
  misc_feature 1..159: note = chr13:26043340-26043499
  misc_feature 1..159: note = hyper
  source 1..159: mol_type = genomic DNA

SEQ ID NO: 11543 - DNA, 30 bp, Homo sapiens
  misc_feature 1..30: note = chr13:26624792-26624822
  misc_feature 1..30: note = hyper
  source 1..30: mol_type = genomic DNA
ggggccgtctttgtccgcccggccaggctc

SEQ ID NO: 11544 - DNA, 139 bp, Homo sapiens
  misc_feature 1..139: note = chr13:26625380-26625519
  misc_feature 1..139: note = hyper
  source 1..139: mol_type = genomic DNA
cagtcagaaggcccccggggctgtcgtccggaagcctctggaggtttcactggcaaccggaccctccctgagcatccccgaagggatgctcactcgagccgaatgaccgctgggcgcgccgccgcggacctggagccag

SEQ ID NO: 11545 - DNA, 30 bp, Homo sapiens
  misc_feature 1..30: note = chr13:27050496-27050526
  misc_feature 1..30: note = hyper
  source 1..30: mol_type = genomic DNA
acctagggagggcagcgggcaggctgggct

SEQ ID NO: 11546 - DNA, 168 bp, Homo sapiens
  misc_feature 1..168: note = chr13:27131553-27131721
  misc_feature 1..168: note = hyper
  source 1..168: mol_type = genomic DNA
atccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtga

SEQ ID NO: 11547 - DNA, 308 bp, Homo sapiens
  misc_feature 1..308: note = chr13:27132002-27132310
  misc_feature 1..308: note = hyper
  source 1..308: mol_type = genomic DNA
tggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtgg

SEQ ID NO: 11548 - DNA, 107 bp, Homo sapiens
  misc_feature 1..107: note = chr13:27132629-27132736
  misc_feature 1..107: note = hyper
  source 1..107: mol_type = genomic DNA
cggggtatcatccccgggggtctttacccgcgcgcctgggctttagcgagggcagaagcttcctctcagtttgtggtgctgacgtgcaatggcgattgcttcttgat

SEQ ID NO: 11549 - DNA, 419 bp, Homo sapiens; identical to SEQ ID NO: 3987
  misc_feature 1..419: note = chr13:27334304-27334723
  misc_feature 1..419: note = hyper
  source 1..419: mol_type = genomic DNA

SEQ ID NO: 11550 - DNA, 238 bp, Homo sapiens; identical to SEQ ID NO: 3988
  misc_feature 1..238: note = chr13:27334724-27334962
  misc_feature 1..238: note = hyper
  source 1..238: mol_type = genomic DNA

SEQ ID NO: 11551 - DNA, 30 bp, Homo sapiens
  misc_feature 1..30: note = chr13:28363673-28363703
  misc_feature 1..30: note = hyper
  source 1..30: mol_type = genomic DNA
gaaagaaggaaagcccgggacaacagaaat

SEQ ID NO: 11552 - DNA, 91 bp, Homo sapiens; identical to SEQ ID NO: 3989
  misc_feature 1..91: note = chr13:28365659-28365750
  misc_feature 1..91: note = hyper
  source 1..91: mol_type = genomic DNA

SEQ ID NO: 11553 - DNA, 139 bp, Homo sapiens
  misc_feature 1..139: note = chr13:28365956-28366095
  misc_feature 1..139: note = hyper
  source 1..139: mol_type = genomic DNA
aaaaccgagggacagcgatgggtctagggctggataaggaataatgagcccttctcctccctccccacagacgcctccttcacgcgggaacccggtcctccttcttccgacgcagagagagaagcgattccacaggtgg

SEQ ID NO: 11554 - DNA, 95 bp, Homo sapiens; identical to SEQ ID NO: 1093
  misc_feature 1..95: note = chr13:28366482-28366577
  misc_feature 1..95: note = hyper
  source 1..95: mol_type = genomic DNA

SEQ ID NO: 11555 - DNA, 34 bp, Homo sapiens
  misc_feature 1..34: note = chr13:28367005-28367039
  misc_feature 1..34: note = hyper
  source 1..34: mol_type = genomic DNA
tctgcgtcaccgcctcgcagctgcatgggccccc

SEQ ID NO: 11556 - DNA, 152 bp, Homo sapiens; identical to SEQ ID NO: 1094
  misc_feature 1..152: note = chr13:28367794-28367946
  misc_feature 1..152: note = hyper
  source 1..152: mol_type = genomic DNA

SEQ ID NO: 11557 - DNA, 84 bp, Homo sapiens; identical to SEQ ID NO: 1095
  misc_feature 1..84: note = chr13:28368153-28368237
  misc_feature 1..84: note = hyper
  source 1..84: mol_type = genomic DNA

SEQ ID NO: 11558 - DNA, 77 bp, Homo sapiens; identical to SEQ ID NO: 1096
  misc_feature 1..77: note = chr13:28368994-28369071
  misc_feature 1..77: note = hyper
  source 1..77: mol_type = genomic DNA

SEQ ID NO: 11559 - DNA, 850 bp, Homo sapiens; identical to SEQ ID NO: 1097
  misc_feature 1..850: note = chr13:28369161-28370011
  misc_feature 1..850: note = hyper
  source 1..850: mol_type = genomic DNA

SEQ ID NO: 11560 - DNA, 382 bp, Homo sapiens; identical to SEQ ID NO: 3995
  misc_feature 1..382: note = chr13:28370980-28371362
  misc_feature 1..382: note = hyper
  source 1..382: mol_type = genomic DNA

SEQ ID NO: 11561 - DNA, 30 bp, Homo sapiens
  misc_feature 1..30: note = chr13:28394743-28394773
  misc_feature 1..30: note = hyper
  source 1..30: mol_type = genomic DNA
ccaggcagagagggccggaaaggcagccca

SEQ ID NO: 11562 - DNA, 402 bp, Homo sapiens; identical to SEQ ID NO: 3996
  misc_feature 1..402: note = chr13:28395255-28395657
  misc_feature 1..402: note = hyper
  source 1..402: mol_type = genomic DNA

SEQ ID NO: 11563 - DNA, 140 bp, Homo sapiens
  misc_feature 1..140: note = chr13:28396578-28396718
  misc_feature 1..140: note = hyper
  source 1..140: mol_type = genomic DNA
ttcttaattttgtggcgatcattcatggaagcaaaaaaggctacagtgtcctttttaagaaaagaaaagctaattcttgaagtgaccttggcagtctggtgcgtgccccatccgaacagagagggcggcttgtgtcaaca

SEQ ID NO: 11564 - DNA, 30 bp, Homo sapiens
  misc_feature 1..30: note = chr13:28397439-28397469
  misc_feature 1..30: note = hyper
  source 1..30: mol_type = genomic DNA
agcccttggccctggcggggaaacagaatt

SEQ ID NO: 11565 - DNA, 196 bp, Homo sapiens; identical to SEQ ID NO: 3997
  misc_feature 1..196: note = chr13:28491793-28491989
  misc_feature 1..196: note = hyper
  source 1..196: mol_type = genomic DNA

SEQ ID NO: 11566 - DNA, 181 bp, Homo sapiens; identical to SEQ ID NO: 3998
  misc_feature 1..181: note = chr13:28492244-28492425
  misc_feature 1..181: note = hyper
  source 1..181: mol_type = genomic DNA

SEQ ID NO: 11567 - DNA, 127 bp, Homo sapiens; identical to SEQ ID NO: 3999
  misc_feature 1..127: note = chr13:28492426-28492553
  misc_feature 1..127: note = hyper
  source 1..127: mol_type = genomic DNA

SEQ ID NO: 11568 - DNA, 36 bp, Homo sapiens
  misc_feature 1..36: note = chr13:28527866-28527902
  misc_feature 1..36: note = hyper
  source 1..36: mol_type = genomic DNA
ttttaagagccacagcgccaccgagagagtggaaag

SEQ ID NO: 11569 - DNA, 456 bp, Homo sapiens
  misc_feature 1..456: note = chr13:28528225-28528681
  misc_feature 1..456: note = hyper
  source 1..456: mol_type = genomic DNA
cggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggcggcggcggagaggcgctccccgggcttcctacccggcaggaggccgcggcgccgggacctcgcctgccctcaccgcgcgccacctctcgggagacgccgcgaatctctccagggaatcccgggcagcggcgcag

SEQ ID NO: 11570 - DNA, 117 bp, Homo sapiens
  misc_feature 1..117: note = chr13:28535406-28535523
  misc_feature 1..117: note = hyper
  source 1..117: mol_type = genomic DNA
cctcttgctgtttcccggctctgctcatcttccccaactgcccttaaggcgcctccgtgggcgcgctgattaggctctcggatgttggtgggaagatcgaaacgaagggctaagccc

SEQ ID NO: 11571 - DNA, 37 bp, Homo sapiens
  misc_feature 1..37: note = chr13:28541213-28541250
  misc_feature 1..37: note = hyper
  source 1..37: mol_type = genomic DNA
ccgcggccgctctcccgggacacgcaaaggtcttcct

SEQ ID NO: 11572 - DNA, 50 bp, Homo sapiens
  misc_feature 1..50: note = chr13:28542677-28542727
  misc_feature 1..50: note = hyper
  source 1..50: mol_type = genomic DNA
gctgctcggcggcagcggtggcggcgggcccaggagggccggggttgagc

SEQ ID NO: 11573 - DNA, 33 bp, Homo sapiens
  misc_feature 1..33: note = chr13:28542728-28542761
  misc_feature 1..33: note = hyper
  source 1..33: mol_type = genomic DNA
tttgcagcagcccagaagcgcaggaaggcgcgg

SEQ ID NO: 11574 - DNA, 137 bp, Homo sapiens
  misc_feature 1..137: note = chr13:28542969-28543106
  misc_feature 1..137: note = hyper
  source 1..137: mol_type = genomic DNA
cgcgctgtccaagttcgctgccgctgcagctgcggccgccacgtggtaaccgccgtagtccgggtactgcggggggctgacgaagttctgcggcgccaggttgaggccgccagagtggcgcacggagctagggtaca

SEQ ID NO: 11575 - DNA, 58 bp, Homo sapiens
  misc_feature 1..58: note = chr13:28543378-28543436
  misc_feature 1..58: note = hyper
  source 1..58: mol_type = genomic DNA
actaggctgcagaggcggggaagacccgccacaggctggcgtgcggagccccaggccg

SEQ ID NO: 11576 - DNA, 195 bp, Homo sapiens; identical to SEQ ID NO: 4000
  misc_feature 1..195: note = chr13:28544390-28544585
  misc_feature 1..195: note = hyper
  source 1..195: mol_type = genomic DNA

SEQ ID NO: 11577 - DNA, 217 bp, Homo sapiens; identical to SEQ ID NO: 4001
  misc_feature 1..217: note = chr13:28544665-28544882
  misc_feature 1..217: note = hyper
  source 1..217: mol_type = genomic DNA

SEQ ID NO: 11578 - DNA, 395 bp, Homo sapiens; identical to SEQ ID NO: 4002
  misc_feature 1..395: note = chr13:28549497-28549892
  misc_feature 1..395: note = hyper
  source 1..395: mol_type = genomic DNA

SEQ ID NO: 11579 - DNA, 20 bp, Homo sapiens
  misc_feature 1..20: note = chr13:28550239-28550259
  misc_feature 1..20: note = hyper
  source 1..20: mol_type = genomic DNA
cgccgcgcagccagctctct

SEQ ID NO: 11580 - DNA, 264 bp, Homo sapiens; identical to SEQ ID NO: 4003
  misc_feature 1..264: note = chr13:28551285-28551549
  misc_feature 1..264: note = hyper
  source 1..264: mol_type = genomic DNA

SEQ ID NO: 11581 - DNA, 37 bp, Homo sapiens; identical to SEQ ID NO: 4004
  misc_feature 1..37: note = chr13:28551658-28551695
  misc_feature 1..37: note = hyper
  source 1..37: mol_type = genomic DNA

SEQ ID NO: 11582 - DNA, 127 bp, Homo sapiens
  misc_feature 1..127: note = chr13:28552077-28552204
  misc_feature 1..127: note = hyper
  source 1..127: mol_type = genomic DNA
aaaggactcattactcgtatgattgcctcaattctccacttcctttgtgcacgtgtgtggacgctgttccaggcccgagtccgcctcccgcccaggacgcacagctccgggccgtggcccccgcgcg

SEQ ID NO: 11583 - DNA, 30 bp, Homo sapiens
  misc_feature 1..30: note = chr13:28553143-28553173
  misc_feature 1..30: note = hyper
  source 1..30: mol_type = genomic DNA
aacatccatggggctcggcaaataaatgcc

SEQ ID NO: 11584 - DNA, 171 bp, Homo sapiens; identical to SEQ ID NO: 1098
  misc_feature 1..171: note = chr13:28674056-28674227
  misc_feature 1..171: note = hyper
  source 1..171: mol_type = genomic DNA

SEQ ID NO: 11585 - DNA, 436 bp, Homo sapiens; identical to SEQ ID NO: 1099
  misc_feature 1..436: note = chr13:28674720-28675156
  misc_feature 1..436: note = hyper
  source 1..436: mol_type = genomic DNA

SEQ ID NO: 11586 - DNA, 1213 bp, Homo sapiens; identical to SEQ ID NO: 1100
  misc_feature 1..1213: note = chr13:29067773-29068986
  misc_feature 1..1213: note = hyper
  source 1..1213: mol_type = genomic DNA

SEQ ID NO: 11587 - DNA, 182 bp, Homo sapiens; identical to SEQ ID NO: 1101
  misc_feature 1..182: note = chr13:29068993-29069175
  misc_feature 1..182: note = hyper
  source 1..182: mol_type = genomic DNA

SEQ ID NO: 11588 - DNA, 32 bp, Homo sapiens
  misc_feature 1..32: note = chr13:29069551-29069583
  misc_feature 1..32: note = hyper
  source 1..32: mol_type = genomic DNA
cctcctcctgcccatcgcgctcaggaaatcct

SEQ ID NO: 11589 - DNA, 114 bp, Homo sapiens; identical to SEQ ID NO: 1102
  misc_feature 1..114: note = chr13:29106308-29106422
  misc_feature 1..114: note = hyper
  source 1..114: mol_type = genomic DNA

SEQ ID NO: 11590 - DNA, 392 bp, Homo sapiens; identical to SEQ ID NO: 1103
  misc_feature 1..392: note = chr13:29106423-29106815
  misc_feature 1..392: note = hyper
  source 1..392: mol_type = genomic DNA

SEQ ID NO: 11591 - DNA, 60 bp, Homo sapiens; identical to SEQ ID NO: 1104
  misc_feature 1..60: note = chr13:29106898-29106958
  misc_feature 1..60: note = hyper
  source 1..60: mol_type = genomic DNA

SEQ ID NO: 11592 - DNA, 44 bp, Homo sapiens
  misc_feature 1..44: note = chr13:29393656-29393700
  misc_feature 1..44: note = hyper
  source 1..44: mol_type = genomic DNA
caatgcctcctgctgcgcctaattcgaagcggctccctcttctg

SEQ ID NO: 11593 - DNA, 62 bp, Homo sapiens
  misc_feature 1..62: note = chr13:29394849-29394911
  misc_feature 1..62: note = hyper
  source 1..62: mol_type = genomic DNA
ccgggctcggggcagcgccgggctggttcggcttctcgtctccagagcgctgatgcttcctg

SEQ ID NO: 11594 - DNA, 212 bp, Homo sapiens; identical to SEQ ID NO: 4012
  misc_feature 1..212: note = chr13:33591219-33591431
  misc_feature 1..212: note = hyper
  source 1..212: mol_type = genomic DNA

SEQ ID NO: 11595 - skipped

SEQ ID NO: 11596 - DNA, 30 bp, Homo sapiens
  misc_feature 1..30: note = chr13:36729247-36729277
  misc_feature 1..30: note = hyper
  source 1..30: mol_type = genomic DNA
ggcggcgccttcccccggcgtccccaaata

SEQ ID NO: 11597 - DNA, 68 bp, Homo sapiens
  misc_feature 1..68: note = chr13:36919889-36919957
  misc_feature 1..68: note = hyper
  source 1..68: mol_type = genomic DNA
ataaccgcagttgttcgtgggccttcttgcagagaaaggctgcccaaccttgacggggccatgggcgc

SEQ ID NO: 11598 - DNA, 187 bp, Homo sapiens
  misc_feature 1..187: note = chr13:36920598-36920785
  misc_feature 1..187: note = hyper
  source 1..187: mol_type = genomic DNA
tcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaa

SEQ ID NO: 11599 - DNA, 108 bp, Homo sapiens; identical to SEQ ID NO: 4013
  misc_feature 1..108: note = chr13:37005473-37005581
  misc_feature 1..108: note = hyper
  source 1..108: mol_type = genomic DNA

SEQ ID NO: 11600 - DNA, 164 bp, Homo sapiens; identical to SEQ ID NO: 4014
  misc_feature 1..164: note = chr13:37005899-37006063
  misc_feature 1..164: note = hyper
  source 1..164: mol_type = genomic DNA

SEQ ID NO: 11601 - DNA, 192 bp, Homo sapiens; identical to SEQ ID NO: 4015
  misc_feature 1..192: note = chr13:37006433-37006625
  misc_feature 1..192: note = hyper
  source 1..192: mol_type = genomic DNA

SEQ ID NO: 11602 - DNA, 30 bp, Homo sapiens
  misc_feature 1..30: note = chr13:37248608-37248638
  misc_feature 1..30: note = hyper
  source 1..30: mol_type = genomic DNA
caatgtccttggccccgtgttgacctgcct

SEQ ID NO: 11603 - DNA, 15 bp, Homo sapiens
  misc_feature 1..15: note = chr13:37248979-37248994
  misc_feature 1..15: note = hyper
  source 1..15: mol_type = genomic DNA
gttttccctagctcc

SEQ ID NO: 11604 - DNA, 124 bp, Homo sapiens
  misc_feature 1..124: note = chr13:39261149-39261273
  misc_feature 1..124: note = hyper
  source 1..124: mol_type = genomic DNA
ctggagtaaggggtgcgagcggagggatttccctcaaagcccagggtccggggacctggaaagtagaagtggagggattcaattctccgcgcgattgaggcgctagcggcggagctggacggcc

SEQ ID NO: 11605 - DNA, 112 bp, Homo sapiens
  misc_feature 1..112: note = chr13:39262129-39262241
  misc_feature 1..112: note = hyper
  source 1..112: mol_type = genomic DNA
cgcgtgggcatcctgtccggcttgggcgcgctgcctcgctatggagaactcctccactacccgcaggtccctggaggagccagagagggaggcgccccggagactctcctga

SEQ ID NO: 11606 - DNA, 517 bp, Homo sapiens; identical to SEQ ID NO: 4016
  misc_feature 1..517: note = chr13:43566059-43566576
  misc_feature 1..517: note = hyper
  source 1..517: mol_type = genomic DNA

SEQ ID NO: 11607 - DNA, 62 bp, Homo sapiens
  misc_feature 1..62: note = chr13:44360732-44360794
  misc_feature 1..62: note = hyper
  source 1..62: mol_type = genomic DNA
ccccggctcggagcccggacgccccagggaggctgcgggccccggagctgcttacctggggc

SEQ ID NO: 11608 - DNA, 739 bp, Homo sapiens; identical to SEQ ID NO: 1105
  misc_feature 1..739: note = chr13:44947737-44948476
  misc_feature 1..739: note = hyper
  source 1..739: mol_type = genomic DNA

SEQ ID NO: 11609 - DNA, 67 bp, Homo sapiens
  misc_feature 1..67: note = chr13:46189867-46189934
  misc_feature 1..67: note = hyper
  source 1..67: mol_type = genomic DNA
gtttgtggcagctctcggttaccatgggaaccgcactccgcagcctccctgggccccatctaatctg

SEQ ID NO: 11610 - DNA, 102 bp, Homo sapiens
  misc_feature 1..102: note = chr13:46961491-46961593
  misc_feature 1..102: note = hyper
  source 1..102: mol_type = genomic DNA
gcaaagcgccgttcccgccgcaggcaccgagacgtcgcccagatggaagaaactctggagatgcgcgctcctacaccggtgccgcggcgcccgggcccagca

SEQ ID NO: 11611 - DNA, 780 bp, Homo sapiens; identical to SEQ ID NO: 1106
  misc_feature 1..780: note = chr13:49794146-49794926
  misc_feature 1..780: note = hyper
  source 1..780: mol_type = genomic DNA

SEQ ID NO: 11612 - DNA, 106 bp, Homo sapiens
  misc_feature 1..106: note = chr13:50070552-50070658
  misc_feature 1..106: note = hyper
  source 1..106: mol_type = genomic DNA
tgtcaactctcctagcgcccctccgctcaccggtaaaccaggacagtggaggggcgccctgatgcggtgaggcagggggcggccctgagggaagagctgggtctca

SEQ ID NO: 11613 - DNA, 30 bp, Homo sapiens
  misc_feature 1..30: note = chr13:52979780-52979810
  misc_feature 1..30: note = hyper
  source 1..30: mol_type = genomic DNA
ctccttaatgaggaccgtctttaatttaat

SEQ ID NO: 11614 - DNA, 43 bp, Homo sapiens
  misc_feature 1..43: note = chr13:52980066-52980109
  misc_feature 1..43: note = hyper
  source 1..43: mol_type = genomic DNA
tgaggtggcagagtccggaggcatttcccgaccccagaggagc

SEQ ID NO: 11615 - DNA, 336 bp, Homo sapiens; identical to SEQ ID NO: 1107
  misc_feature 1..336: note = chr13:53312978-53313314
  misc_feature 1..336: note = hyper
  source 1..336: mol_type = genomic DNA

SEQ ID NO: 11616 - DNA, 17 bp, Homo sapiens
  misc_feature 1..17: note = chr13:53313512-53313529
  misc_feature 1..17: note = hyper
  source 1..17: mol_type = genomic DNA
cgcagcacagggccttc

SEQ ID NO: 11617 - DNA, 83 bp, Homo sapiens; identical to SEQ ID NO: 1109
  misc_feature 1..83: note = chr13:53313530-53313613
  misc_feature 1..83: note = hyper
  source 1..83: mol_type = genomic DNA

SEQ ID NO: 11618 - DNA, 37 bp, Homo sapiens; identical to SEQ ID NO: 1110
  misc_feature 1..37: note = chr13:53313677-53313714
  misc_feature 1..37: note = hyper
  source 1..37: mol_type = genomic DNA

SEQ ID NO: 11619 - DNA, 41 bp, Homo sapiens
  misc_feature 1..41: note = chr13:53419734-53419775
  misc_feature 1..41: note = hyper
  source 1..41: mol_type = genomic DNA
ctcctttccaaaacccggggaggcaccgtagggctgcagca

SEQ ID NO: 11620 - DNA, 32 bp, Homo sapiens
  misc_feature 1..32: note = chr13:53422842-53422874
  misc_feature 1..32: note = hyper
  source 1..32: mol_type = genomic DNA
tggccgcctccccctcgcgtcgcccctccgcc

SEQ ID NO: 11621 - DNA, 30 bp, Homo sapiens
  misc_feature 1..30: note = chr13:53423168-53423198
  misc_feature 1..30: note = hyper
  source 1..30: mol_type = genomic DNA
attttgcacctctgacgcttccaaaccctt

SEQ ID NO: 11622 - DNA, 98 bp, Homo sapiens
  misc_feature 1..98: note = chr13:53423948-53424046
  misc_feature 1..98: note = hyper
  source 1..98: mol_type = genomic DNA
gaaacctggcaggaacgtggggggaacttaaccatctgcttaggaaagtgtggagcttcggcactgccaaaatctgggctgggcggatcctggggctg

SEQ ID NO: 11623 - DNA, 292 bp, Homo sapiens
  misc_feature 1..292: note = chr13:58203602-58203894
  misc_feature 1..292: note = hyper
  source 1..292: mol_type = genomic DNA
cagcgcgggcagaaacgggctcacgagcgccctcgaattcacacacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttattctgcaagcatactgcgattcccgattccgtgtatgtaggacc

SEQ ID NO: 11624 - DNA, 154 bp, Homo sapiens
  misc_feature 1..154: note = chr13:58204239-58204393
  misc_feature 1..154: note = hyper
  source 1..154: mol_type = genomic DNA
tcagtcagcaagagacgctggggagagagcagggatcgcgagcccggcggatgcggcagcggcggaaggcggctggggagacgctactccaactgttgaattgaattttcacctttcctttcatccgctgctttgcttgcggagatggatttat

SEQ ID NO: 11625 - DNA, 343 bp, Homo sapiens
  misc_feature 1..343: note = chr13:58205889-58206232
  misc_feature 1..343: note = hyper
  source 1..343: mol_type = genomic DNA
ctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctc

SEQ ID NO: 11626 - DNA, 210 bp, Homo sapiens
  misc_feature 1..210: note = chr13:58206452-58206662
  misc_feature 1..210: note = hyper
  source 1..210: mol_type = genomic DNA
cgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgccc

SEQ ID NO: 11627 - DNA, 247 bp, Homo sapiens
  misc_feature 1..247: note = chr13:58207567-58207814
  misc_feature 1..247: note = hyper
  source 1..247: mol_type = genomic DNA
cgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgac

SEQ ID NO: 11628 - DNA, 71 bp, Homo sapiens
  misc_feature 1..71: note = chr13:58207891-58207962
  misc_feature 1..71: note = hyper
  source 1..71: mol_type = genomic DNA
cgggcccgggggttccgtccccttcaagcttgaggagaactacgacaacttctacacggtggtgactgacc

SEQ ID NO: 11629 - DNA, 592 bp, Homo sapiens; identical to SEQ ID NO: 1111
  misc_feature 1..592: note = chr13:58208334-58208926
  misc_feature 1..592: note = hyper
  source 1..592: mol_type = genomic DNA

SEQ ID NO: 11630 - DNA, 69 bp, Homo sapiens
  misc_feature 1..69: note = chr13:67804675-67804744
  misc_feature 1..69: note = hyper
  source 1..69: mol_type = genomic DNA
tggccccaggagagccgggttccatgaggtgcactgagcatgctctgcagggtccggcgtgggagggac

SEQ ID NO: 11631 - DNA, 23 bp, Homo sapiens
  misc_feature 1..23: note = chr13:67804745-67804768
  misc_feature 1..23: note = hyper
  source 1..23: mol_type = genomic DNA
cgctggcgctccccaggcccggg

SEQ ID NO: 11632 - DNA, 236 bp, Homo sapiens
  misc_feature 1..236: note = chr13:67804863-67805099
  misc_feature 1..236: note = hyper
  source 1..236: mol_type = genomic DNA
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatag

SEQ ID NO: 11633 - DNA, 152 bp, Homo sapiens; identical to SEQ ID NO: 4024
  misc_feature 1..152: note = chr13:70681626-70681778
  misc_feature 1..152: note = hyper
  source 1..152: mol_type = genomic DNA

SEQ ID NO: 11634 - DNA, 205 bp, Homo sapiens; identical to SEQ ID NO: 4025
  misc_feature 1..205: note = chr13:70681866-70682071
  misc_feature 1..205: note = hyper
  source 1..205: mol_type = genomic DNA

SEQ ID NO: 11635 - DNA, 30 bp, Homo sapiens
  misc_feature 1..30: note = chr13:74707261-74707291
  misc_feature 1..30: note = hyper
  source 1..30: mol_type = genomic DNA
agttacacatcattacgaccagagacaata

SEQ ID NO: 11636 - DNA, 130 bp, Homo sapiens
  misc_feature 1..130: note = chr13:75149921-75150051
  misc_feature 1..130: note = hyper
  source 1..130: mol_type = genomic DNA
cggcccggagaggctcgcggatgcctggccgcgcgcctccgcgggacgtcagcgcccgcggcacgatctgctgctgtcactatcagtatccggcaggagcccgcccgccccggcccggccccaggccgtg

SEQ ID NO: 11637 - DNA, 86 bp, Homo sapiens; identical to SEQ ID NO: 4026
  misc_feature 1..86: note = chr13:78493110-78493196
  misc_feature 1..86: note = hyper
  source 1..86: mol_type = genomic DNA

SEQ ID NO: 11638 - DNA, 414 bp, Homo sapiens
  misc_feature 1..414: note = chr13:78493520-78493934
  misc_feature 1..414: note = hyper
  source 1..414: mol_type = genomic DNA
cgaatgtttacctctcggatctgacaaaccagatgcagagcgacgaatggagaccaccttcccgggaggcggaacccagctgggttccagcctgctctgggagaggagcacgcctcccttgagctgcaggcgggtccggctctgacgaaacgctgcgagaatgccagacagtgtagcctccaccgtttgctcggggtctctgctgccatcagacaagtacttttattcattcatcccttcccatcaatcaccgccagactcctcccgcgccttccgaccccgctgcaacctttccccttgggcgatgcctggacagcatcagtagtagttgcccgagggaggggggcagtcctcgtccggggacaggtcccaaaaggctgtttatttgttagagttctacgctcttcaaatgaa

SEQ ID NO: 11639 - DNA, 35 bp, Homo sapiens
  misc_feature 1..35: note = chr13:79161007-79161042
  misc_feature 1..35: note = hyper
  source 1..35: mol_type = genomic DNA
actcgggaccattgccgggacgagaagcccatcag

SEQ ID NO: 11640 - DNA, 37 bp, Homo sapiens; identical to SEQ ID NO: 1112
  misc_feature 1..37: note = chr13:79170347-79170384
  misc_feature 1..37: note = hyper
  source 1..37: mol_type = genomic DNA

SEQ ID NO: 11641 - DNA, 372 bp, Homo sapiens; identical to SEQ ID NO: 1113
  misc_feature 1..372: note = chr13:79170467-79170839
  misc_feature 1..372: note = hyper
  source 1..372: mol_type = genomic DNA

SEQ ID NO: 11642 - DNA, 242 bp, Homo sapiens; identical to SEQ ID NO: 1114
  misc_feature 1..242: note = chr13:79175702-79175944
  misc_feature 1..242: note = hyper
  source 1..242: mol_type = genomic DNA

SEQ ID NO: 11643 - DNA, 49 bp, Homo sapiens; identical to SEQ ID NO: 1115
  misc_feature 1..49: note = chr13:79176077-79176126
  misc_feature 1..49: note = hyper
  source 1..49: mol_type = genomic DNA

SEQ ID NO: 11644 - DNA, 145 bp, Homo sapiens; identical to SEQ ID NO: 1116
  misc_feature 1..145: note = chr13:79176276-79176421
  misc_feature 1..145: note = hyper
  source 1..145: mol_type = genomic DNA

SEQ ID NO: 11645 - DNA, 224 bp, Homo sapiens; identical to SEQ ID NO: 1117
  misc_feature 1..224: note = chr13:79176608-79176832
  misc_feature 1..224: note = hyper
  source 1..224: mol_type = genomic DNA

SEQ ID NO: 11646 - DNA, 104 bp, Homo sapiens; identical to SEQ ID NO: 1118
  misc_feature 1..104: note = chr13:79177081-79177185
  misc_feature 1..104: note = hyper
  source 1..104: mol_type = genomic DNA

SEQ ID NO: 11647 - DNA, 318 bp, Homo sapiens; identical to SEQ ID NO: 1119
  misc_feature 1..318: note = chr13:79177305-79177623
  misc_feature 1..318: note = hyper
  source 1..318: mol_type = genomic DNA

SEQ ID NO: 11648 - DNA, 175 bp, Homo sapiens; identical to SEQ ID NO: 1120
  misc_feature 1..175: note = chr13:79177885-79178060
  misc_feature 1..175: note = hyper
  source 1..175: mol_type = genomic DNA

SEQ ID NO: 11649 - DNA, 60 bp, Homo sapiens
  misc_feature 1..60: note = chr13:79182844-79182904
  misc_feature 1..60: note = hyper
  source 1..60: mol_type = genomic DNA
cataggaagttctgtcgccttcctgctccgcggatagccgcctgccgtctgctgccacca

SEQ ID NO: 11650 - DNA, 18 bp, Homo sapiens
  misc_feature 1..18: note = chr13:79183406-79183424
  misc_feature 1..18: note = hyper
  source 1..18: mol_type = genomic DNA
actctttgttggtttcgc

SEQ ID NO: 11651 - DNA, 108 bp, Homo sapiens
  misc_feature 1..108: note = chr13:84455572-84455680
  misc_feature 1..108: note = hyper
  source 1..108: mol_type = genomic DNA
aaacgtcccctgtaacgtttccagcggcaaaacaaagagacgtctccagcaacagaatccaaagcagcatttttaaagcgagcaattcatccccgatctcatcacaaa

SEQ ID NO: 11652 - DNA, 236 bp, Homo sapiens
  misc_feature 1..236: note = chr13:84456111-84456347
  misc_feature 1..236: note = hyper
  source 1..236: mol_type = genomic DNA
ctgtgcatggctgtgcgtcggactgaccttgcctctctgatacaaagcagggttttccgcggcttctgttgttgaggctgctggtggagttcttgctgtggttgcgggttgcccagaagtccccccgaggtgctgtccagttcccccggtgctgaaatcacgcccgaccgaaggactcacgctgcccagccaatggcgctggaaaatttccgcaatcgctgcgttttgtggttgtc

SEQ ID NO: 11653 - DNA, 346 bp, Homo sapiens; identical to SEQ ID NO: 4036
  misc_feature 1..346: note = chr13:88323468-88323814
  misc_feature 1..346: note = hyper
  source 1..346: mol_type = genomic DNA

SEQ ID NO: 11654 - DNA, 177 bp, Homo sapiens
  misc_feature 1..177: note = chr13:88324342-88324519
  misc_feature 1..177: note = hyper
  source 1..177: mol_type = genomic DNA
gggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgat

SEQ ID NO: 11655 - DNA, 30 bp, Homo sapiens
  misc_feature 1..30: note = chr13:88325619-88325649
  misc_feature 1..30: note = hyper
  source 1..30: mol_type = genomic DNA
tgagaggaagctcttcgacccttgctaact

SEQ ID NO: 11656 - DNA, 15 bp, Homo sapiens
  misc_feature 1..15: note = chr13:88326936-88326951
  misc_feature 1..15: note = hyper
  source 1..15: mol_type = genomic DNA
cgtggtagtgaagtc

SEQ ID NO: 11657 - DNA, 292 bp, Homo sapiens
  misc_feature 1..292: note = chr13:92051108-92051400
  misc_feature 1..292: note = hyper
  source 1..292: mol_type = genomic DNA
gcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttc

SEQ ID NO: 11658 - DNA, 113 bp, Homo sapiens
  misc_feature 1..113: note = chr13:92051401-92051514
  misc_feature 1..113: note = hyper
  source 1..113: mol_type = genomic DNA
gaaacttttccagtggcggctgctgggagctgtcagggggctgccggattcgccgcgggcaggtaaggggcaatgagggggtctctggactggcggcgtccgagcccggcctt

SEQ ID NO: 11659 - DNA, 20 bp, Homo sapiens
  misc_feature 1..20: note = chr13:93879283-93879303
  misc_feature 1..20: note = hyper
  source 1..20: mol_type = genomic DNA
tcccgggggagccggcgcgc

SEQ ID NO: 11660 - DNA, 157 bp, Homo sapiens
  misc_feature 1..157: note = chr13:93879304-93879461
  misc_feature 1..157: note = hyper
  source 1..157: mol_type = genomic DNA
ctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggg

SEQ ID NO: 11661 - DNA, 11 bp, Homo sapiens
  misc_feature 1..11: note = chr13:93880206-93880217
  misc_feature 1..11: note = hyper
  source 1..11: mol_type = genomic DNA
gagagccgagc

SEQ ID NO: 11662 - DNA, 15 bp, Homo sapiens
  misc_feature 1..15: note = chr13:93880533-93880548
  misc_feature 1..15: note = hyper
  source 1..15: mol_type = genomic DNA
cgttagggttcctca

SEQ ID NO: 11663 - DNA, 30 bp, Homo sapiens
  misc_feature 1..30: note = chr13:95354328-95354358
  misc_feature 1..30: note = hyper
  source 1..30: mol_type = genomic DNA
ggccatgggtgggggcgggtggtgaagctg

SEQ ID NO: 11664 - DNA, 30 bp, Homo sapiens
  misc_feature 1..30: note = chr13:95357311-95357341
  misc_feature 1..30: note = hyper
  source 1..30: mol_type = genomic DNA
tttgtctcctcaaagcgactcccaatggat

SEQ ID NO: 11665 - DNA, 201 bp, Homo sapiens
  misc_feature 1..201: note = chr13:95357574-95357775
  misc_feature 1..201: note = hyper
  source 1..201: mol_type = genomic DNA
gagcttcattccctccggccgtccaggacgtcgagagagcggctggccagagctcagccccggcgcattcgcagggacgtgtcagctgggcaggctataatttgcattattccattaagttaggagcagcgctgataacgactggaaagttcgacggctgggtgggcccgcgacccgcaggcctggcgagcaaccatcgaa

SEQ ID NO: 11666 - DNA, 105 bp, Homo sapiens
  misc_feature 1..105: note = chr13:95359719-95359824
  misc_feature 1..105: note = hyper
  source 1..105: mol_type = genomic DNA
cttgcctggaggacacggcggcccaggcggccgggagcgccggcgccgagccgcgctctgattggctggcgcgaccgtccctatctgctccggggagagtggaat

SEQ ID NO: 11667 - DNA, 173 bp, Homo sapiens
  misc_feature 1..173: note = chr13:95360231-95360404
  misc_feature 1..173: note = hyper
  source 1..173: mol_type = genomic DNA
aaacagggagagagacggagatagataaagagatggagatagagatcgcgagccagcagcagctctctgcccaatcacagcgctgcatttgtgggccactttcagacgcttacaccacccacccccgggcctttctctacgccctcttgccccggagccgctccccccgctcc

SEQ ID NO: 11668 - DNA, 322 bp, Homo sapiens
  misc_feature 1..322: note = chr13:95363009-95363331
  misc_feature 1..322: note = hyper
  source 1..322: mol_type = genomic DNA
gcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctg

SEQ ID NO: 11669 - DNA, 368 bp, Homo sapiens
  misc_feature 1..368: note = chr13:95363592-95363960
  misc_feature 1..368: note = hyper
  source 1..368: mol_type = genomic DNA
cgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagtaggggctgcccgcggcggcggcggcggcggcagcggcggcggcagcggccgactgcgggaagaagacgcgtgcggcggcagcggcggcggccgcggccgccttctcgggattggcgagcagcgactcaggcaccaggccgccgcccgcccccgcgtgcagcccgg

SEQ ID NO: 11670 - DNA, 132 bp, Homo sapiens
  misc_feature 1..132: note = chr13:95364064-95364196
  misc_feature 1..132: note = hyper
  source 1..132: mol_type = genomic DNA
cgcggccggtacttgtagtcggggtgctccttcatgtgcatggcgcgtagacgcttggcctcgtcgatgaacggccgcttctccgactctgtgagcagtttccactcggcgcccaagcgcttgctgatctcc

SEQ ID NO: 11671 - DNA, 211 bp, Homo sapiens
  misc_feature 1..211: note = chr13:95364731-95364942
  misc_feature 1..211: note = hyper
  source 1..211: mol_type = genomic DNA
ttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatat

SEQ ID NO: 11672 - DNA, 129 bp, Homo sapiens
  misc_feature 1..129: note = chr13:95365239-95365368
  misc_feature 1..129: note = hyper
  source 1..129: mol_type = genomic DNA
ttcaggcgcgcctgccgacttagggctcccggagctcgccggccgcggagggcagcgcagcctccacgcggcgccgcaggcctggcaccggccgcgtccccgcctcgctcttctcggcagccgcctggc

SEQ ID NO: 11673 - DNA, 503 bp, Homo sapiens
  misc_feature 1..503: note = chr13:95619803-95620306
  misc_feature 1..503: note = hyper
  source 1..503: mol_type = genomic DNA
agagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcgggcgcccggcagggctgcgcggccgagactcggggcgccggcgccggggcggccgggagctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacac

SEQ ID NO: 11674 - DNA, 475 bp, Homo sapiens
  misc_feature 1..475: note = chr13:95620307-95620782
  misc_feature 1..475: note = hyper
  source 1..475: mol_type = genomic DNA
ctcggctacctgcaggggttcgccactgcaagccgggccagtagaagtttgggggcgaaggcagagagcatttccttctcggcttttggcgcctccacgctgcacagaggcaggggcgactctgcaggccccgtttcccccatcctcccctccaccccagttccccgcaggacgtaggcgccgtccctagctcccccttctgtcctcgccctaacaccgcagggcctctcctggggatgtggggtcctgcgtgcttttgggggctacaaaaagtgggggccgtcgcagagcagagggaagctaggagcgggcaacgaattgaatcctggagacccgggaggagcgaggctgctgccgtccccggggaaagggcgacttcggcggggataccccgtgccaggccctgcaactcccgggccctcgggaatgggatgggggaggcgcggggtgcgcgcagctcccggtgatgttaagg

SEQ ID NO: 11675 - DNA, 87 bp, Homo sapiens
  misc_feature 1..87: note = chr13:95620853-95620940
  misc_feature 1..87: note = hyper
  source 1..87: mol_type = genomic DNA
cgctgcggccgctgtgtgcccgaggggcggctctgtaacccggctccaggcatttcttaggtttcccatccccgccctccaagctcc

SEQ ID NO: 11676 - DNA, 93 bp, Homo sapiens
  misc_feature 1..93: note = chr13:95655093-95655186
  misc_feature 1..93: note = hyper
  source 1..93: mol_type = genomic DNA
ctagctgtgtccacacggcccctccgaagcgccttggccccagctgcactctcctcgcccccttcctcccagtgggaacgagccagccagcga

SEQ ID NO: 11677 - DNA, 379 bp, Homo sapiens
  misc_feature 1..379: note = chr13:96204922-96205301
  misc_feature 1..379: note = hyper
  source 1..379: mol_type = genomic DNA
cgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgccccc

SEQ ID NO: 11678 - DNA, 173 bp, Homo sapiens; identical to SEQ ID NO: 4037
  misc_feature 1..173: note = chr13:96296383-96296556
  misc_feature 1..173: note = hyper
  source 1..173: mol_type = genomic DNA

SEQ ID NO: 11679 - DNA, 110 bp, Homo sapiens; identical to SEQ ID NO: 4038
  misc_feature 1..110: note = chr13:96296840-96296950
  misc_feature 1..110: note = hyper
  source 1..110: mol_type = genomic DNA

SEQ ID NO: 11680 - DNA, 229 bp, Homo sapiens; identical to SEQ ID NO: 4039
  misc_feature 1..229: note = chr13:96296991-96297220
  misc_feature 1..229: note = hyper
  source 1..229: mol_type = genomic DNA

SEQ ID NO: 11681 - DNA, 150 bp, Homo sapiens
  misc_feature 1..150: note = chr13:96743424-96743574
  misc_feature 1..150: note = hyper
  source 1..150: mol_type = genomic DNA
agaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacat

SEQ ID NO: 11682 - DNA, 107 bp, Homo sapiens
  misc_feature 1..107: note = chr13:96743788-96743895
  misc_feature 1..107: note = hyper
  source 1..107: mol_type = genomic DNA
aagaaggactgtccccgcaaccacagccacaccaggtactgtcgcccgctgggtctctgttcttcccccccaccccccatccctcttcctcagtcctgacccagagc

SEQ ID NO: 11683 - DNA, 151 bp, Homo sapiens
  misc_feature 1..151: note = chr13:96743896-96744047
  misc_feature 1..151: note = hyper
  source 1..151: mol_type = genomic DNA
accccgcgctccctgcccctgccgatggtttcctggcgtcttcagcggttggcgccgtggctttggggagggatgagaaacctccggatagtgcctaggtcctgaactcgttcttcccccagcccccaccgcttcccgccacccctctgcc

SEQ ID NO: 11684 - DNA, 344 bp, Homo sapiens; identical to SEQ ID NO: 4040
  misc_feature 1..344: note = chr13:100608461-100608805
  misc_feature 1..344: note = hyper
  source 1..344: mol_type = genomic DNA

SEQ ID NO: 11685 - DNA, 103 bp, Homo sapiens; identical to SEQ ID NO: 4041
  misc_feature 1..103: note = chr13:100608838-100608941
  misc_feature 1..103: note = hyper
  source 1..103: mol_type = genomic DNA

SEQ ID NO: 11686 - DNA, 30 bp, Homo sapiens
  misc_feature 1..30: note = chr13:100611911-100611941
  misc_feature 1..30: note = hyper
  source 1..30: mol_type = genomic DNA
gcacagggctggaggcgacccttcaaagcg

SEQ ID NO: 11687 - DNA, 51 bp, Homo sapiens
  misc_feature 1..51: note = chr13:100621941-100621992
  misc_feature 1..51: note = hyper
  source 1..51: mol_type = genomic DNA
aggcgcttgccggggcggcccggcctctctttccatcgccctcccagactt

SEQ ID NO: 11688 - DNA, 33 bp, Homo sapiens
  misc_feature 1..33: note = chr13:100622452-100622485
  misc_feature 1..33: note = hyper
  source 1..33: mol_type = genomic DNA
agggaaagggcttctcgccggtgtgcacgcgga

SEQ ID NO: 11689 - DNA, 34 bp, Homo sapiens
  misc_feature 1..34: note = chr13:100622959-100622993
  misc_feature 1..34: note = hyper
  source 1..34: mol_type = genomic DNA
gggcggccgccgctgcggccgcaaccgccccgta

SEQ ID NO: 11690 - DNA, 43 bp, Homo sapiens
  misc_feature 1..43: note = chr13:100624559-100624602
  misc_feature 1..43: note = hyper
  source 1..43: mol_type = genomic DNA
acccaacctgcctagcgctcacctagggcgcatagacagtaga

SEQ ID NO: 11691 - DNA, 150 bp, Homo sapiens; identical to SEQ ID NO: 4042
  misc_feature 1..150: note = chr13:100630730-100630880
  misc_feature 1..150: note = hyper
  source 1..150: mol_type = genomic DNA

SEQ ID NO: 11692 - DNA, 90 bp, Homo sapiens
  misc_feature 1..90: note = chr13:100635085-100635175
  misc_feature 1..90: note = hyper
  source 1..90: mol_type = genomic DNA
aatctgcaagtggatcgaccccgagcaactgagcaatcccaagaagagctgcaacaaaactttcagcaccatgcacgagctggtgacaca

SEQ ID NO: 11693 - DNA, 30 bp, Homo sapiens
  misc_feature 1..30: note = chr13:100636167-100636197
  misc_feature 1..30: note = hyper
  source 1..30: mol_type = genomic DNA
caaaatcgtgccagacgatttcctaaaaga

SEQ ID NO: 11694 - DNA, 34 bp, Homo sapiens
  misc_feature 1..34: note = chr13:100637006-100637040
  misc_feature 1..34: note = hyper
  source 1..34: mol_type = genomic DNA
aatgagcaggactgtcgggcgggaaggcggttaa

SEQ ID NO: 11695 - DNA, 101 bp, Homo sapiens
  misc_feature 1..101: note = chr13:100637423-100637524
  misc_feature 1..101: note = hyper
  source 1..101: mol_type = genomic DNA
ccggaccacctcagccggcctgggagggtccccaggggccagggcggcggggggaacatttctgggggtgctctcccccaggggcccggccccacagcagc

SEQ ID NO: 11696 - DNA, 156 bp, Homo sapiens
  misc_feature 1..156: note = chr13:100637800-100637956
  misc_feature 1..156: note = hyper
  source 1..156: mol_type = genomic DNA
ctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccc

SEQ ID NO: 11697 - DNA, 187 bp, Homo sapiens
  misc_feature 1..187: note = chr13:100640972-100641159
  misc_feature 1..187: note = hyper
  source 1..187: mol_type = genomic DNA
tgtccaaacaagtcacggacccgacaaggtggtccattctctctctttggcctttcttttctgcccttcgaatccgaaggactggatggaggggaggggatatggcaatagtgtagaagtgtcaagatgtgaaaattgctcaactgagaacgcacgcgggggctcgcggcccaacagcctgcaccac

SEQ ID NO: 11698 - DNA, 51 bp, Homo sapiens; identical to SEQ ID NO: 1121
  misc_feature 1..51: note = chr13:100642150-100642201
  misc_feature 1..51: note = hyper
  source 1..51: mol_type = genomic DNA

SEQ ID NO: 11699 - DNA, 145 bp, Homo sapiens
  misc_feature 1..145: note = chr13:100644025-100644170
  misc_feature 1..145: note = hyper
  source 1..145: mol_type = genomic DNA
cagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtg

SEQ ID NO: 11700 - DNA, 32 bp, Homo sapiens
  misc_feature 1..32: note = chr13:100647898-100647930
  misc_feature 1..32: note = hyper
  source 1..32: mol_type = genomic DNA
tgctaagcagatctccgcgttaaattagccta

SEQ ID NO: 11701 - DNA, 227 bp, Homo sapiens; identical to SEQ ID NO: 1122
  misc_feature 1..227: note = chr13:100649349-100649576
  misc_feature 1..227: note = hyper
  source 1..227: mol_type = genomic DNA

SEQ ID NO: 11702 - DNA, 86 bp, Homo sapiens; identical to SEQ ID NO: 1123
  misc_feature 1..86: note = chr13:100649799-100649885
  misc_feature 1..86: note = hyper
  source 1..86: mol_type = genomic DNA

SEQ ID NO: 11703 - DNA, 26 bp, Homo sapiens
  misc_feature 1..26: note = chr13:102069045-102069071
  misc_feature 1..26: note = hyper
  source 1..26: mol_type = genomic DNA
gcagttccttcttgccggctgccacc

SEQ ID NO: 11704 - DNA, 62 bp, Homo sapiens
  misc_feature 1..62: note = chr13:102568422-102568484
  misc_feature 1..62: note = hyper
  source 1..62: mol_type = genomic DNA
ctgcgagcggtggctcgaccccgggtgtggcaggaaggggtgccccgcgttccagagccagt

SEQ ID NO: 11705 - DNA, 230 bp, Homo sapiens; identical to SEQ ID NO: 1124
  misc_feature 1..230: note = chr13:102569312-102569542
  misc_feature 1..230: note = hyper
  source 1..230: mol_type = genomic DNA

SEQ ID NO: 11706 - DNA, 60 bp, Homo sapiens
  misc_feature 1..60: note = chr13:102569830-102569890
  misc_feature 1..60: note = hyper
  source 1..60: mol_type = genomic DNA
caactcgctggttcccgagccttccgcggcttggttggggcttctcggtcttaacgtggt

SEQ ID NO: 11707 - DNA, 388 bp, Homo sapiens
  misc_feature 1..388: note = chr13:103046665-103047053
  misc_feature 1..388: note = hyper
  source 1..388: mol_type = genomic DNA
cacatggggtgcccccgcgtcaacgccggaggagtgaccttgcaaacccgcgccccgcgggcggcagagccggccgctcactgcccggtccccggccaccacggaagagcgaagatctctgccagggcaggagccctagccccgacccgcgccccaagtctctcccgcgcggcggcttccggccgccatggtttccatagcaacaacagcacaagctgccgggtcccagagacgccctagggtcagaggtcatctccgtggcaacggaaacttcccgcgctacggcggctccaacgggccgcttccgccgcattgcgtagcgaagcccccggcgagccgaggctgggagcgcggtgatggccggtccccgtgagcagagggcagcggc

SEQ ID NO: 11708 - DNA, 247 bp, Homo sapiens
  misc_feature 1..247: note = chr13:103047054-103047301
  misc_feature 1..247: note = hyper
  source 1..247: mol_type = genomic DNA
gcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaa

SEQ ID NO: 11709 - DNA, 30 bp, Homo sapiens
  misc_feature 1..30: note = chr13:103052128-103052158
  misc_feature 1..30: note = hyper
  source 1..30: mol_type = genomic DNA
tggggtgaatagaaacggtgtaagaactag

SEQ ID NO: 11710 - DNA, 307 bp, Homo sapiens; identical to SEQ ID NO: 4047
  misc_feature 1..307: note = chr13:103052521-103052828
  misc_feature 1..307: note = hyper
  source 1..307: mol_type = genomic DNA

SEQ ID NO: 11711 - DNA, 380 bp, Homo sapiens; identical to SEQ ID NO: 4048
  misc_feature 1..380: note = chr13:103052829-103053209
  misc_feature 1..380: note = hyper
  source 1..380: mol_type = genomic DNA

SEQ ID NO: 11712 - DNA, 30 bp, Homo sapiens
  misc_feature 1..30: note = chr13:103054590-103054620
  misc_feature 1..30: note = hyper
  source 1..30: mol_type = genomic DNA
agttctcaatcaccacgaagaaaagatgca

SEQ ID NO: 11713 - DNA, 238 bp, Homo sapiens
  misc_feature 1..238: note = chr13:108518605-108518843
  misc_feature 1..238: note = hyper
  source 1..238: mol_type = genomic DNA
ggactcccccatgctcgccaggagcgcgggccaggagggctcctgctgccgccgctgctgctgctgctgctgccgctgcctctgctgctgctgctgctgctgctgctgccgctgctgctgctggtgctccttgtcccgggcccgggtcagcttggcctcggcgcagaaccacaagtgatcagagagcaggactgtgaaaaacaagagagatgccagagacagtcgccatttctgagcc

SEQ ID NO: 11714 - DNA, 72 bp, Homo sapiens
  misc_feature 1..72: note = chr13:108519674-108519746
  misc_feature 1..72: note = hyper
  source 1..72: mol_type = genomic DNA
ccgctgccgcagggccgcccgcgggcgccgccgccggggctccgactgctgacgccgcctcccgcggagctc

SEQ ID NO: 11715 - DNA, 80 bp, Homo sapiens; identical to SEQ ID NO: 4049
  misc_feature 1..80: note = chr13:109147783-109147863
  misc_feature 1..80: note = hyper
  source 1..80: mol_type = genomic DNA

SEQ ID NO: 11716 - DNA, 115 bp, Homo sapiens; identical to SEQ ID NO: 4050
  misc_feature 1..115: note = chr13:109148154-109148269
  misc_feature 1..115: note = hyper
  source 1..115: mol_type = genomic DNA

SEQ ID NO: 11717 - DNA, 80 bp, Homo sapiens
  misc_feature 1..80: note = chr13:109148480-109148560
  misc_feature 1..80: note = hyper
  source 1..80: mol_type = genomic DNA
ggagaggaggcttgtcggtcccttcctgggaaaggaatcgcggggacttcccaaccgctaggacgcgtaagccgaggctg

SEQ ID NO: 11718 - DNA, 36 bp, Homo sapiens
  misc_feature 1..36: note = chr13:109148973-109149009
  misc_feature 1..36: note = hyper
  source 1..36: mol_type = genomic DNA
aattggtccctagtacgcccccgaaaggaaatggag

SEQ ID NO: 11719 - DNA, 250 bp, Homo sapiens
  misc_feature 1..250: note = chr13:110958727-110958977
  misc_feature 1..250: note = hyper
  source 1..250: mol_type = genomic DNA
gccttaggcagcagtcgtgggaaagctcagatacagctgtttccaggcaaagggcccagagcttttcagcctcagccaccagggtctccagacaaggagaaatacgcccaaagctgctcccaggggctaggagctcggagctcccagtgtgggtctctgagcagcgcggggtgggcgctcccggccctccagcccccaactccctcgcgcacccgggacgggtgaaggcgcccagctgccgagcataccc

SEQ ID NO: 11720 - skipped

SEQ ID NO: 11721 - DNA, 132 bp, Homo sapiens; identical to SEQ ID NO: 4051
  misc_feature 1..132: note = chr13:110959517-110959649
  misc_feature 1..132: note = hyper
  source 1..132: mol_type = genomic DNA

SEQ ID NO: 11722 - DNA, 275 bp, Homo sapiens; identical to SEQ ID NO: 4052
  misc_feature 1..275: note = chr13:110959752-110960027
  misc_feature 1..275: note = hyper
  source 1..275: mol_type = genomic DNA

SEQ ID NO: 11723 - DNA, 158 bp, Homo sapiens
  misc_feature 1..158: note = chr13:110960445-110960603
  misc_feature 1..158: note = hyper
  source 1..158: mol_type = genomic DNA
gttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccac

SEQ ID NO: 11724 - DNA, 83 bp, Homo sapiens
  misc_feature 1..83: note = chr13:110960909-110960992
  misc_feature 1..83: note = hyper
  source 1..83: mol_type = genomic DNA
ctctgggtaaaggggcggggcgaggaggcgaacgagacaaccttagtattgtttgaattgaagcattgcgagggaacaatggc

SEQ ID NO: 11725 - DNA, 33 bp, Homo sapiens
  misc_feature 1..33: note = chr13:111767955-111767988
  misc_feature 1..33: note = hyper
  source 1..33: mol_type = genomic DNA
agggctttctgcaggcgtcgctgaaggatgggg

SEQ ID NO: 11726 - DNA, 176 bp, Homo sapiens; identical to SEQ ID NO: 4053
  misc_feature 1..176: note = chr13:112707743-112707919
  misc_feature 1..176: note = hyper
  source 1..176: mol_type = genomic DNA

SEQ ID NO: 11727 - DNA, 206 bp, Homo sapiens; identical to SEQ ID NO: 4054
  misc_feature 1..206: note = chr13:112708307-112708513
  misc_feature 1..206: note = hyper
  source 1..206: mol_type = genomic DNA

SEQ ID NO: 11728 - DNA, 117 bp, Homo sapiens
  misc_feature 1..117: note = chr13:112710359-112710476
  misc_feature 1..117: note = hyper
  source 1..117: mol_type = genomic DNA
cgcggggaccggcgcgggtgggagtgggggcgcggcgcggaaaaccccagggaaggaccgggtggacacgggacgggaggggggtgacatcctcccacccgggggttagaaaaggtc

SEQ ID NO: 11729 - DNA, 78 bp, Homo sapiens
  misc_feature 1..78: note = chr13:112710745-112710823
  misc_feature 1..78: note = hyper
  source 1..78: mol_type = genomic DNA
gaggggactggggagcggcgagaggaggacgggagacgcggctccacctcccagctcaaaacggcgtcccagctgctc

SEQ ID NO: 11730 - DNA, 113 bp, Homo sapiens
  misc_feature 1..113: note = chr13:112710824-112710937
  misc_feature 1..113: note = hyper
  source 1..113: mol_type = genomic DNA
caaaccaactgctcgattctattcactgtcgagtaggaacaaaaaagtggctatttattagaatacttgtttggtattgttccgcgccacacaaaaggcgtttcattatgtgg

SEQ ID NO: 11731 - DNA, 86 bp, Homo sapiens
  misc_feature 1..86: note = chr13:112711203-112711289
  misc_feature 1..86: note = hyper
  source 1..86: mol_type = genomic DNA
gcgtcgcgctgggcacgctggccacccggtccggaatgagtcggggctccgggaggtgcccgtgggcagagcgttaggggcgcggc

SEQ ID NO: 11732 - DNA, 125 bp, Homo sapiens; identical to SEQ ID NO: 4055
  misc_feature 1..125: note = chr13:112711624-112711749
  misc_feature 1..125: note = hyper
  source 1..125: mol_type = genomic DNA

SEQ ID NO: 11733 - DNA, 930 bp, Homo sapiens; identical to SEQ ID NO: 1125
  misc_feature 1..930: note = chr13:112712048-112712978
  misc_feature 1..930: note = hyper
  source 1..930: mol_type = genomic DNA

SEQ ID NO: 11734 - DNA, 260 bp, Homo sapiens; identical to SEQ ID NO: 1126
  misc_feature 1..260: note = chr13:112715354-112715614
  misc_feature 1..260: note = hyper
  source 1..260: mol_type = genomic DNA

SEQ ID NO: 11735 - DNA, 417 bp, Homo sapiens; identical to SEQ ID NO: 1127
  misc_feature 1..417: note = chr13:112715936-112716353
  misc_feature 1..417: note = hyper
  source 1..417: mol_type = genomic DNA

SEQ ID NO: 11736 - DNA, 34 bp, Homo sapiens
  misc_feature 1..34: note = chr13:112716636-112716670
  misc_feature 1..34: note = hyper
  source 1..34: mol_type = genomic DNA
acgcgcgcgtgcgcgcgcgcgcacacacacatac

SEQ ID NO: 11737 - DNA, 30 bp, Homo sapiens
  misc_feature 1..30: note = chr13:112717114-112717144
  misc_feature 1..30: note = hyper
  source 1..30: mol_type = genomic DNA
tggccatcacccgagcgccctggagcgcca

SEQ ID NO: 11738 - DNA, 443 bp, Homo sapiens
  misc_feature 1..443: note = chr13:112717506-112717949
  misc_feature 1..443: note = hyper
  source 1..443: mol_type = genomic DNA
tggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttg

SEQ ID NO: 11739 - DNA, 30 bp, Homo sapiens
  misc_feature 1..30: note = chr13:112720247-112720277
  misc_feature 1..30: note = hyper
  source 1..30: mol_type = genomic DNA
cttaggcaaccagctcgtgggaaattcact

SEQ ID NO: 11740 - DNA, 509 bp, Homo sapiens; identical to SEQ ID NO: 4059
  misc_feature 1..509: note = chr13:112720518-112721027
  misc_feature 1..509: note = hyper
  source 1..509: mol_type = genomic DNA

SEQ ID NO: 11741 - DNA, 93 bp, Homo sapiens; identical to SEQ ID NO: 4060
  misc_feature 1..93: note = chr13:112722128-112722221
  misc_feature 1..93: note = hyper
  source 1..93: mol_type = genomic DNA

SEQ ID NO: 11742 - DNA, 38 bp, Homo sapiens; identical to SEQ ID NO: 4061
  misc_feature 1..38: note = chr13:112722274-112722312
  misc_feature 1..38: note = hyper
  source 1..38: mol_type = genomic DNA

SEQ ID NO: 11743 - DNA, 65 bp, Homo sapiens
  misc_feature 1..65: note = chr13:112724425-112724490
  misc_feature 1..65: note = hyper
  source 1..65: mol_type = genomic DNA
tcaaggaaacacaatcgctgaaccaaaacgtactgcagccgagccccctccgtccatcctctgcc

SEQ ID NO: 11744 - DNA, 185 bp, Homo sapiens
  misc_feature 1..185: note = chr13:112726435-112726620
  misc_feature 1..185: note = hyper
  source 1..185: mol_type = genomic DNA
cgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacc

SEQ ID NO: 11745 - DNA, 157 bp, Homo sapiens
  misc_feature 1..157: note = chr13:112726982-112727139
  misc_feature 1..157: note = hyper
  source 1..157: mol_type = genomic DNA
ctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccggg

SEQ ID NO: 11746 - DNA, 361 bp, Homo sapiens; identical to SEQ ID NO: 1128
  misc_feature 1..361: note = chr13:112758012-112758373
  misc_feature 1..361: note = hyper
  source 1..361: mol_type = genomic DNA

SEQ ID NO: 11747 - DNA, 196 bp, Homo sapiens; identical to SEQ ID NO: 1129
  misc_feature 1..196: note = chr13:112758495-112758691
  misc_feature 1..196: note = hyper
  source 1..196: mol_type = genomic DNA

SEQ ID NO: 11748 - DNA, 205 bp, Homo sapiens; identical to SEQ ID NO: 4064
  misc_feature 1..205: note = chr13:112759202-112759407
  misc_feature 1..205: note = hyper
  source 1..205: mol_type = genomic DNA

SEQ ID NO: 11749 - DNA, 70 bp, Homo sapiens
  misc_feature 1..70: note = chr13:112759612-112759682
  misc_feature 1..70: note = hyper
  source 1..70: mol_type = genomic DNA
aattgtctattttctcgccaacagtctccatcacaatcacttatctggaaacctgcggttggattaatcg

SEQ ID NO: 11750 - DNA, 68 bp, Homo sapiens
  misc_feature 1..68: note = chr13:112760259-112760327
  misc_feature 1..68: note = hyper
  source 1..68: mol_type = genomic DNA
cccagttctgcaggccgctccagggctaggggtagagatggtggcaggtggtgcgtcaactctctagg

SEQ ID NO: 11751 - DNA, 348 bp, Homo sapiens; identical to SEQ ID NO: 1130
  misc_feature 1..348: note = chr13:112760850-112761198
  misc_feature 1..348: note = hyper
  source 1..348: mol_type = genomic DNA

SEQ ID NO: 11752 - DNA, 30 bp, Homo sapiens
  misc_feature 1..30: note = chr13:113547121-113547151
  misc_feature 1..30: note = hyper
  source 1..30: mol_type = genomic DNA
tggagccactccctgcgggtctgagtgggg

SEQ ID NO: 11753 - DNA, 51 bp, Homo sapiens
  misc_feature 1..51: note = chr13:114462901-114462952
  misc_feature 1..51: note = hyper
  source 1..51: mol_type = genomic DNA
acaggaaacctgttgcgtgttcaccagttcgcaagccgggctcgggggctc

SEQ ID NO: 11754 - DNA, 44 bp, Homo sapiens
  misc_feature 1..44: note = chr14:21093506-21093550
  misc_feature 1..44: note = hyper
  source 1..44: mol_type = genomic DNA
tgcaaactcctataacgtgtgtggtagtgtggccgagcggtcta

SEQ ID NO: 11755 - DNA, 103 bp, Homo sapiens
  misc_feature 1..103: note = chr14:21093610-21093713
  misc_feature 1..103: note = hyper
  source 1..103: mol_type = genomic DNA
gtggtacgttttagcacaacaaggatcctgaagtactaacactttctaactagtaaaataattaaatcttcctttcccaggattctcccggattacacagcat

SEQ ID NO: 11756 - DNA, 165 bp, Homo sapiens
  misc_feature 1..165: note = chr14:21100842-21101007
  misc_feature 1..165: note = hyper
  source 1..165: mol_type = genomic DNA
gtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 11757 - skipped

SEQ ID NO: 11758 - DNA, 19 bp, Homo sapiens
  misc_feature 1..19: note = chr14:21101037-21101056
  misc_feature 1..19: note = hyper
  source 1..19: mol_type = genomic DNA
cgcacgttgactttcctgg

SEQ ID NO: 11759 - DNA, 30 bp, Homo sapiens
  misc_feature 1..30: note = chr14:21121400-21121430
  misc_feature 1..30: note = hyper
  source 1..30: mol_type = genomic DNA
ccttgcaactctagtcgtccaataagcttt

SEQ ID NO: 11760 - DNA, 15 bp, Homo sapiens
  misc_feature 1..15: note = chr14:21121902-21121917
  misc_feature 1..15: note = hyper
  source 1..15: mol_type = genomic DNA
ctcatcccccacccc

SEQ ID NO: 11761 - DNA, 44 bp, Homo sapiens
  misc_feature 1..44: note = chr14:21769210-21769254
  misc_feature 1..44: note = hyper
  source 1..44: mol_type = genomic DNA
ggcgcgggcagaaggcgggatggcggcagcgcctctccatgcac

SEQ ID NO: 11762 - DNA, 30 bp, Homo sapiens
  misc_feature 1..30: note = chr14:23291877-23291907
  misc_feature 1..30: note = hyper
  source 1..30: mol_type = genomic DNA
agacaggagtctgggcgagcgccccaaccc

SEQ ID NO: 11763 - DNA, 112 bp, Homo sapiens
  misc_feature 1..112: note = chr14:23821464-23821576
  misc_feature 1..112: note = hyper
  source 1..112: mol_type = genomic DNA
gctgcagctgctggccgccgcccagcgcccccacctgggcgagcagcgcctcaaagctgagggggcctgggggcacggccagcgacaggctgctgcccagtccgtcgccgcc

SEQ ID NO: 11764 - DNA, 21 bp, Homo sapiens
  misc_feature 1..21: note = chr14:23821601-23821622
  misc_feature 1..21: note = hyper
  source 1..21: mol_type = genomic DNA
cgctcccgctcaccctgcagc

SEQ ID NO: 11765 - DNA, 323 bp, Homo sapiens; identical to SEQ ID NO: 1131
  misc_feature 1..323: note = chr14:24803594-24803917
  misc_feature 1..323: note = hyper
  source 1..323: mol_type = genomic DNA

SEQ ID NO: 11766 - DNA, 205 bp, Homo sapiens; identical to SEQ ID NO: 1132
  misc_feature 1..205: note = chr14:24803918-24804123
  misc_feature 1..205: note = hyper
  source 1..205: mol_type = genomic DNA

SEQ ID NO: 11767 - DNA, 23 bp, Homo sapiens
  misc_feature 1..23: note = chr14:24804424-24804447
  misc_feature 1..23: note = hyper
  source 1..23: mol_type = genomic DNA
cgcctccccgcttcagccccttc

SEQ ID NO: 11768 - DNA, 190 bp, Homo sapiens
  misc_feature 1..190: note = chr14:25518450-25518640
  misc_feature 1..190: note = hyper
  source 1..190: mol_type = genomic DNA
cgatgccggcgtgcacggcaagcgcgaattcggaacctggcgcccttgaccaagcctgagatcggaaagggggcatcgcccagggccagcgccctgggggcagggtgccgtgcccgccagaaaagctcgcctcagttttggcagtaatgattttcctagaagatgccagagttcgcgaagatcggagtga

SEQ ID NO: 11769 - DNA, 223 bp, Homo sapiens; identical to SEQ ID NO: 4069
  misc_feature 1..223: note = chr14:26674354-26674577
  misc_feature 1..223: note = hyper
  source 1..223: mol_type = genomic DNA

SEQ ID NO: 11770 - DNA, 30 bp, Homo sapiens
  misc_feature 1..30: note = chr14:27066218-27066248
  misc_feature 1..30: note = hyper
  source 1..30: mol_type = genomic DNA
ggtcaacctctggaccgattaaatggaaag

SEQ ID NO: 11771 - DNA, 30 bp, Homo sapiens
  misc_feature 1..30: note = chr14:27066651-27066681
  misc_feature 1..30: note = hyper
  source 1..30: mol_type = genomic DNA
tcctgccgctgctaccgggagaaggttctc

SEQ ID NO: 11772 - DNA, 60 bp, Homo sapiens
  misc_feature 1..60: note = chr14:27067097-27067157
  misc_feature 1..60: note = hyper
  source 1..60: mol_type = genomic DNA
gaaggaggtggatgccgagagaggagcgagcggcagaggagggcaggagccgggaaggag

SEQ ID NO: 11773 - DNA, 44 bp, Homo sapiens
  misc_feature 1..44: note = chr14:27067635-27067679
  misc_feature 1..44: note = hyper
  source 1..44: mol_type = genomic DNA
cacggctcaggcaaacgtaagcggcttgtcgcagaaaccaaggg

SEQ ID NO: 11774 - DNA, 30 bp, Homo sapiens
  misc_feature 1..30: note = chr14:29225698-29225728
  misc_feature 1..30: note = hyper
  source 1..30: mol_type = genomic DNA
ttgagaggatgagctcgagattgaagagtg

SEQ ID NO: 11775 - DNA, 82 bp, Homo sapiens; identical to SEQ ID NO: 4070
  misc_feature 1..82: note = chr14:29226033-29226115
  misc_feature 1..82: note = hyper
  source 1..82: mol_type = genomic DNA

SEQ ID NO: 11776 - DNA, 43 bp, Homo sapiens
  misc_feature 1..43: note = chr14:29226360-29226403
  misc_feature 1..43: note = hyper
  source 1..43: mol_type = genomic DNA
aagaaaatattgtgacgatgttgtagggcgaaaggggacgtga

SEQ ID NO: 11777 - DNA, 30 bp, Homo sapiens
  misc_feature 1..30: note = chr14:29227895-29227925
  misc_feature 1..30: note = hyper
  source 1..30: mol_type = genomic DNA
cttctgcagccctggcgtggatatgcacgt

SEQ ID NO: 11778 - DNA, 151 bp, Homo sapiens
  misc_feature 1..151: note = chr14:29228268-29228419
  misc_feature 1..151: note = hyper
  source 1..151: mol_type = genomic DNA
ccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggag

SEQ ID NO: 11779 - DNA, 356 bp, Homo sapiens; identical to SEQ ID NO: 4071
  misc_feature 1..356: note = chr14:29228628-29228984
  misc_feature 1..356: note = hyper
  source 1..356: mol_type = genomic DNA

SEQ ID NO: 11780 - DNA, 16 bp, Homo sapiens
  misc_feature 1..16: note = chr14:29229233-29229249
  misc_feature 1..16: note = hyper
  source 1..16: mol_type = genomic DNA
catctagagagatgac

SEQ ID NO: 11781 - DNA, 136 bp, Homo sapiens
  misc_feature 1..136: note = chr14:29229250-29229386
  misc_feature 1..136: note = hyper
  source 1..136: mol_type = genomic DNA
cctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaag

SEQ ID NO: 11782 - DNA, 30 bp, Homo sapiens
  misc_feature 1..30: note = chr14:29230911-29230941
  misc_feature 1..30: note = hyper
  source 1..30: mol_type = genomic DNA
tggaacacctggcagcgtcacagagacttg

SEQ ID NO: 11783 - DNA, 38 bp, Homo sapiens
  misc_feature 1..38: note = chr14:29231293-29231331
  misc_feature 1..38: note = hyper
  source 1..38: mol_type = genomic DNA
gacgttgagggtgcgcgtgcgcgcgctgagagcagcca

SEQ ID NO: 11784 - DNA, 439 bp, Homo sapiens; identical to SEQ ID NO: 1134
  misc_feature 1..439: note = chr14:29234853-29235292
  misc_feature 1..439: note = hyper
  source 1..439: mol_type = genomic DNA

SEQ ID NO: 11785 - DNA, 61 bp, Homo sapiens
  misc_feature 1..61: note = chr14:29236023-29236084
  misc_feature 1..61: note = hyper
  source 1..61: mol_type = genomic DNA
tccccagcctcgccgcggccgctccgggacgcgcccgcccgccgcccggctctccccccct

SEQ ID NO: 11786 - DNA, 89 bp, Homo sapiens
  misc_feature 1..89: note = chr14:29236672-29236761
  misc_feature 1..89: note = hyper
  source 1..89: mol_type = genomic DNA
cgcaaccgccgccgccgccgcagcagcagcagccgccgccgccgccgcccccggcaccgcagcccccccagacgcggggcgccccggcc

SEQ ID NO: 11787 - skipped

SEQ ID NO: 11788 - DNA, 63 bp, Homo sapiens
  misc_feature 1..63: note = chr14:29243208-29243271
  misc_feature 1..63: note = hyper
  source 1..63: mol_type = genomic DNA
ccggtcggatttagccgggctgctccgggtcgggtgaggcactgggtgcgtgtgggagtcttc

SEQ ID NO: 11789 - DNA, 30 bp, Homo sapiens
  misc_feature 1..30: note = chr14:29243530-29243560
  misc_feature 1..30: note = hyper
  source 1..30: mol_type = genomic DNA
gcgcctcagggactccggggtgaagatgga

SEQ ID NO: 11790 - DNA, 231 bp, Homo sapiens
  misc_feature 1..231: note = chr14:29243856-29244087
  misc_feature 1..231: note = hyper
  source 1..231: mol_type = genomic DNA
cagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccat

SEQ ID NO: 11791 - DNA, 163 bp, Homo sapiens
  misc_feature 1..163: note = chr14:29247187-29247350
  misc_feature 1..163: note = hyper
  source 1..163: mol_type = genomic DNA
cagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtagg

SEQ ID NO: 11792 - DNA, 15 bp, Homo sapiens
  misc_feature 1..15: note = chr14:29254425-29254440
  misc_feature 1..15: note = hyper
  source 1..15: mol_type = genomic DNA
ggcgcccgcagaagc

SEQ ID NO: 11793 - DNA, 32 bp, Homo sapiens; identical to SEQ ID NO: 4074
  misc_feature 1..32: note = chr14:29254611-29254643
  misc_feature 1..32: note = hyper
  source 1..32: mol_type = genomic DNA

SEQ ID NO: 11794 - DNA, 137 bp, Homo sapiens
  misc_feature 1..137: note = chr14:31343407-31343544
  misc_feature 1..137: note = hyper
  source 1..137: mol_type = genomic DNA
gggtggggcgggtagcggccgccgctgcctcagcagccctggtcccggcagagcagggctggcgaggccgctgctgccgccgtcggggccgccggccctccacactcgttgagacgccggcacggggaccttcgtgc

SEQ ID NO: 11795 - DNA, 234 bp, Homo sapiens
  misc_feature 1..234: note = chr14:31344315-31344549
  misc_feature 1..234: note = hyper
  source 1..234: mol_type = genomic DNA
gggggagctggggtgcgtccaggcggtcgcaggggctgagcaccagcgggtacaagcgggactcagatccagccccttgggcttcagccctaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagca

SEQ ID NO: 11796 - DNA, 90 bp, Homo sapiens
  misc_feature 1..90: note = chr14:33402367-33402457
  misc_feature 1..90: note = hyper
  source 1..90: mol_type = genomic DNA
cggcctgtgtcactcttggccttggcaacttctggccaatccgccctgcccctctgggtcccggcgggccggctgcgccctaggctcaaa

SEQ ID NO: 11797 - DNA, 92 bp, Homo sapiens
  misc_feature 1..92: note = chr14:33402751-33402843
  misc_feature 1..92: note = hyper
  source 1..92: mol_type = genomic DNA
actccactccaggctcgccagccggaagaaagaggaggaagtgggacaacgggggtcctgggcaggggtaggggaaacgatcaactcccact

SEQ ID NO: 11798 - DNA, 62 bp, Homo sapiens
  misc_feature 1..62: note = chr14:33403270-33403332
  misc_feature 1..62: note = hyper
  source 1..62: mol_type = genomic DNA
taagtatcaagttctcgaggagcccaacttgcgcttggcagccctcgcgctgcctgatgtgc

SEQ ID NO: 11799 - DNA, 30 bp, Homo sapiens
  misc_feature 1..30: note = chr14:33403549-33403579
  misc_feature 1..30: note = hyper
  source 1..30: mol_type = genomic DNA
gtgtgtagaggggggcgggaaagaaacgca

SEQ ID NO: 11800 - DNA, 55 bp, Homo sapiens
  misc_feature 1..55: note = chr14:33403846-33403901
  misc_feature 1..55: note = hyper
  source 1..55: mol_type = genomic DNA
ccccagcccgctgcgcgcacatcaaagctcctctccgccgcgcacagtggccgcg

SEQ ID NO: 11801 - DNA, 254 bp, Homo sapiens
  misc_feature 1..254: note = chr14:33404164-33404418
  misc_feature 1..254: note = hyper
  source 1..254: mol_type = genomic DNA
cggcaccccgcagaacgtccagggcatcacctcctaccagcagcggtgagtagtcccgcctgggctgggatagtgcccccgccccggggtgctggggtgggactcactttgcctcctgttttgtgtcttacaacacacatgcacattgccagggctcactttgcctgcccctcgttctacagatgaggaagaaaaacacacttcactttggtggattgaaaagcactccagtgcgctggcgaagtgaaatcatc

SEQ ID NO: 11802 - DNA, 655 bp, Homo sapiens; identical to SEQ ID NO: 4075
  misc_feature 1..655: note = chr14:36004080-36004735
  misc_feature 1..655: note = hyper
  source 1..655: mol_type = genomic DNA

SEQ ID NO: 11803 - DNA, 101 bp, Homo sapiens; identical to SEQ ID NO: 4076
  misc_feature 1..101: note = chr14:36004821-36004922
  misc_feature 1..101: note = hyper
  source 1..101: mol_type = genomic DNA

SEQ ID NO: 11804 - DNA, 83 bp, Homo sapiens
  misc_feature 1..83: note = chr14:36972706-36972789
  misc_feature 1..83: note = hyper
  source 1..83: mol_type = genomic DNA
ctgactttattcttacggaattaaacacaataatttttttaaaatatcttctttgaggcaagtgaccacgagagcacctgtta

SEQ ID NO: 11805 - DNA, 84 bp, Homo sapiens; identical to SEQ ID NO: 1135
  misc_feature 1..84: note = chr14:36973454-36973538
  misc_feature 1..84: note = hyper
  source 1..84: mol_type = genomic DNA

SEQ ID NO: 11806 - DNA, 230 bp, Homo sapiens; identical to SEQ ID NO: 4078
  misc_feature 1..230: note = chr14:36974533-36974763
  misc_feature 1..230: note = hyper
  source 1..230: mol_type = genomic DNA

SEQ ID NO: 11807 - DNA, 46 bp, Homo sapiens
  misc_feature 1..46: note = chr14:36975034-36975080
  misc_feature 1..46: note = hyper
  source 1..46: mol_type = genomic DNA
ataaaagggaggacccggattccaagcccctcgaagtccccaagca

SEQ ID NO: 11808 - DNA, 102 bp, Homo sapiens
  misc_feature 1..102: note = chr14:36975355-36975457
  misc_feature 1..102: note = hyper
  source 1..102: mol_type = genomic DNA
cccaggcagctggggcgccctccaagtgacgcctttgtccaggctgcgctcgcggagaataaagggggcgctgtccaacctcaggttcggggaaaaccaagg

SEQ ID NO: 11809 - DNA, 427 bp, Homo sapiens; identical to SEQ ID NO: 4079
  misc_feature 1..427: note = chr14:36977503-36977930
  misc_feature 1..427: note = hyper
  source 1..427: mol_type = genomic DNA

SEQ ID NO: 11810 - DNA, 30 bp, Homo sapiens
  misc_feature 1..30: note = chr14:36983330-36983360
  misc_feature 1..30: note = hyper
  source 1..30: mol_type = genomic DNA
ttccaagcacctcagcgccaggggcatcct

SEQ ID NO: 11811 - DNA, 438 bp, Homo sapiens; identical to SEQ ID NO: 4080
  misc_feature 1..438: note = chr14:36983708-36984146
  misc_feature 1..438: note = hyper
  source 1..438: mol_type = genomic DNA

SEQ ID NO: 11812 - DNA, 30 bp, Homo sapiens
  misc_feature 1..30: note = chr14:36985841-36985871
  misc_feature 1..30: note = hyper
  source 1..30: mol_type = genomic DNA
tccaacttttgacagcgttttacagctaca

SEQ ID NO: 11813 - DNA, 171 bp, Homo sapiens; identical to SEQ ID NO: 1136
  misc_feature 1..171: note = chr14:36986301-36986472
  misc_feature 1..171: note = hyper
  source 1..171: mol_type = genomic DNA

SEQ ID NO: 11814 - DNA, 249 bp, Homo sapiens; identical to SEQ ID NO: 1137
  misc_feature 1..249: note = chr14:36987301-36987550
  misc_feature 1..249: note = hyper
  source 1..249: mol_type = genomic DNA

SEQ ID NO: 11815 - DNA, 172 bp, Homo sapiens; identical to SEQ ID NO: 4083
  misc_feature 1..172: note = chr14:36987960-36988132
  misc_feature 1..172: note = hyper
  source 1..172: mol_type = genomic DNA

SEQ ID NO: 11816 - DNA, 437 bp, Homo sapiens
  misc_feature 1..437: note = chr14:36989763-36990200
  misc_feature 1..437: note = hyper
  source 1..437: mol_type = genomic DNA
ggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgac

SEQ ID NO: 11817 - DNA, 41 bp, Homo sapiens
  misc_feature 1..41: note = chr14:36990493-36990534
  misc_feature 1..41: note = hyper
  source 1..41: mol_type = genomic DNA
ttttagtctcctctgcgcgccaggggctgggagggcggagc

SEQ ID NO: 11818 - DNA, 30 bp, Homo sapiens
  misc_feature 1..30: note = chr14:36990535-36990565
  misc_feature 1..30: note = hyper
  source 1..30: mol_type = genomic DNA
ctccccggccggccccggcaggtgcctcca

SEQ ID NO: 11819 - DNA, 175 bp, Homo sapiens; identical to SEQ ID NO: 1138
  misc_feature 1..175: note = chr14:36990858-36991033
  misc_feature 1..175: note = hyper
  source 1..175: mol_type = genomic DNA

SEQ ID NO: 11820 - DNA, 92 bp, Homo sapiens; identical to SEQ ID NO: 1139
  misc_feature 1..92: note = chr14:36991094-36991186
  misc_feature 1..92: note = hyper
  source 1..92: mol_type = genomic DNA

SEQ ID NO: 11821 - DNA, 178 bp, Homo sapiens; identical to SEQ ID NO: 1140
  misc_feature 1..178: note = chr14:36991600-36991778
  misc_feature 1..178: note = hyper
  source 1..178: mol_type = genomic DNA

SEQ ID NO: 11822 - DNA, 37 bp, Homo sapiens; identical to SEQ ID NO: 1141
  misc_feature 1..37: note = chr14:36991988-36992025
  misc_feature 1..37: note = hyper
  source 1..37: mol_type = genomic DNA

SEQ ID NO: 11823 - DNA, 170 bp, Homo sapiens
  misc_feature 1..170: note = chr14:36992232-36992402
  misc_feature 1..170: note = hyper
  source 1..170: mol_type = genomic DNA
cgtattcctttatcccgcaactagcttgctcccgggtggagtgggcacagtggggagcggtcagggcagggcagggcccaacgctggcccctcgcggagctttccctggcgcgacctcacacggtcgctgcctctattccgaccacgctctgcttcgctggctgcggctc

SEQ ID NO: 11824 - DNA, 50 bp, Homo sapiens
  misc_feature 1..50: note = chr14:36993438-36993488
  misc_feature 1..50: note = hyper
  source 1..50: mol_type = genomic DNA
cccctcagttgctcccgcagtctcccacagctaggcacaggcttctaagc

SEQ ID NO: 11825 - DNA, 141 bp, Homo sapiens; identical to SEQ ID NO: 4088
  misc_feature 1..141: note = chr14:36993815-36993956
  misc_feature 1..141: note = hyper
  source 1..141: mol_type = genomic DNA

SEQ ID NO: 11826 - DNA, 643 bp, Homo sapiens; identical to SEQ ID NO: 4089
  misc_feature 1..643: note = chr14:36994366-36995009
  misc_feature 1..643: note = hyper
  source 1..643: mol_type = genomic DNA

SEQ ID NO: 11827 - DNA, 40 bp, Homo sapiens; identical to SEQ ID NO: 4090
  misc_feature 1..40: note = chr14:36995010-36995050
  misc_feature 1..40: note = hyper
  source 1..40: mol_type = genomic DNA

SEQ ID NO: 11828 - DNA, 190 bp, Homo sapiens; identical to SEQ ID NO: 4091
  misc_feature 1..190: note = chr14:37116105-37116295
  misc_feature 1..190: note = hyper
  source 1..190: mol_type = genomic DNA

SEQ ID NO: 11829 - DNA, 387 bp, Homo sapiens
  misc_feature 1..387: note = chr14:37116983-37117370
  misc_feature 1..387: note = hyper
  source 1..387: mol_type = genomic DNA
gtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggc

SEQ ID NO: 11830 - DNA, 453 bp, Homo sapiens; identical to SEQ ID NO: 1142
  misc_feature 1..453: note = chr14:37123566-37124019
  misc_feature 1..453: note = hyper
  source 1..453: mol_type = genomic DNA

SEQ ID NO: 11831 - DNA, 91 bp, Homo sapiens; identical to SEQ ID NO: 1143
  misc_feature 1..91: note = chr14:37124481-37124572
  misc_feature 1..91: note = hyper
  source 1..91: mol_type = genomic DNA

SEQ ID NO: 11832 - DNA, 30 bp, Homo sapiens; identical to SEQ ID NO: 4094
  misc_feature 1..30: note = chr14:37124992-37125022
  misc_feature 1..30: note = hyper
  source 1..30: mol_type = genomic DNA

SEQ ID NO: 11833 - DNA, 420 bp, Homo sapiens; identical to SEQ ID NO: 4095
  misc_feature 1..420: note = chr14:37125232-37125652
  misc_feature 1..420: note = hyper
  source 1..420: mol_type = genomic DNA

SEQ ID NO: 11834 - DNA, 173 bp, Homo sapiens; identical to SEQ ID NO: 4096
  misc_feature 1..173: note = chr14:37126156-37126329
  misc_feature 1..173: note = hyper
  source 1..173: mol_type = genomic DNA

SEQ ID NO: 11835 - DNA, 63 bp, Homo sapiens
  misc_feature 1..63: note = chr14:37126548-37126611
  misc_feature 1..63: note = hyper
  source 1..63: mol_type = genomic DNA
gaaaacttccaaatgcgcgaataccagcaatcccgctcgccttcaacgcgtggggtaaggggg

SEQ ID NO: 11836 - DNA, 169 bp, Homo sapiens
  misc_feature 1..169: note = chr14:37126964-37127133
  misc_feature 1..169: note = hyper
  source 1..169: mol_type = genomic DNA
cgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcc

SEQ ID NO: 11837 - DNA, 243 bp, Homo sapiens
  misc_feature 1..243: note = chr14:37127537-37127780
  misc_feature 1..243: note = hyper
  source 1..243: mol_type = genomic DNA
cgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggt

SEQ ID NO: 11838 - DNA, 183 bp, Homo sapiens
  misc_feature 1..183: note = chr14:37130077-37130260
  misc_feature 1..183: note = hyper
  source 1..183: mol_type = genomic DNA
cagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcc

SEQ ID NO: 11839 - DNA, 30 bp, Homo sapiens
  misc_feature 1..30: note = chr14:37130494-37130524
  misc_feature 1..30: note = hyper
  source 1..30: mol_type = genomic DNA
cccccacctgtggctcgggctccccgcaac

SEQ ID NO: 11840 - DNA, 264 bp, Homo sapiens; identical to SEQ ID NO: 1144
  misc_feature 1..264: note = chr14:37132290-37132554
  misc_feature 1..264: note = hyper
  source 1..264: mol_type = genomic DNA

SEQ ID NO: 11841 - DNA, 33 bp, Homo sapiens; identical to SEQ ID NO: 1145
  misc_feature 1..33: note = chr14:37132602-37132635
  misc_feature 1..33: note = hyper
  source 1..33: mol_type = genomic DNA

SEQ ID NO: 11842 - DNA, 273 bp, Homo sapiens
  misc_feature 1..273: note = chr14:37132838-37133111
  misc_feature 1..273: note = hyper
  source 1..273: mol_type = genomic DNA
tttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttgggg

SEQ ID NO: 11843 - DNA, 67 bp, Homo sapiens; identical to SEQ ID NO: 4099
  misc_feature 1..67: note = chr14:37136294-37136361
  misc_feature 1..67: note = hyper
  source 1..67: mol_type = genomic DNA

SEQ ID NO: 11844 - DNA, 30 bp, Homo sapiens
  misc_feature 1..30: note = chr14:37136588-37136618
  misc_feature 1..30: note = hyper
  source 1..30: mol_type = genomic DNA
gtctaaattcatcaccgtcctggagtcaag

SEQ ID NO: 11845 - DNA, 30 bp, Homo sapiens
  misc_feature 1..30: note = chr14:38052911-38052941
  misc_feature 1..30: note = hyper
  source 1..30: mol_type = genomic DNA
atgctgagagccctgcgtgctcagccaggg

SEQ ID NO: 11846 - DNA, 30 bp, Homo sapiens
  misc_feature 1..30: note = chr14:38057303-38057333
  misc_feature 1..30: note = hyper
  source 1..30: mol_type = genomic DNA
gtctccgcactccctcggaaccacagatgt

SEQ ID NO: 11847 - DNA, 45 bp, Homo sapiens
  misc_feature 1..45: note = chr14:38060677-38060722
  misc_feature 1..45: note = hyper
  source 1..45: mol_type = genomic DNA
caggctggcgggcaacgtagagccgtaaggcgagtattgcagtgc

SEQ ID NO: 11848 - DNA, 34 bp, Homo sapiens
  misc_feature 1..34: note = chr14:38724294-38724328
  misc_feature 1..34: note = hyper
  source 1..34: mol_type = genomic DNA
ggttgcagtggccggcgggcgcctggtgggcacc

SEQ ID NO: 11849 - DNA, 382 bp, Homo sapiens; identical to SEQ ID NO: 1146
  misc_feature 1..382: note = chr14:38724978-38725360
  misc_feature 1..382: note = hyper
  source 1..382: mol_type = genomic DNA

SEQ ID NO: 11850 - DNA, 183 bp, Homo sapiens
  misc_feature 1..183: note = chr14:42075097-42075280
  misc_feature 1..183: note = hyper
  source 1..183: mol_type = genomic DNA
ggtgctctcagtgtccgaagaccacgtgctggtgaacccacaatgagaagcgaaagggtttcaggactctagcagaaaggaagagcaagatttcactcagggtttcttagaagaaagagttaactttgctcactggcttttccaggatggagggagtggggatagggtcggggagagaagcat

SEQ ID NO: 11851 - DNA, 236 bp, Homo sapiens; identical to SEQ ID NO: 4101
  misc_feature 1..236: note = chr14:42075538-42075774
  misc_feature 1..236: note = hyper
  source 1..236: mol_type = genomic DNA

SEQ ID NO: 11852 - DNA, 164 bp, Homo sapiens; identical to SEQ ID NO: 4102
  misc_feature 1..164: note = chr14:42076803-42076967
  misc_feature 1..164: note = hyper
  source 1..164: mol_type = genomic DNA

SEQ ID NO: 11853 - DNA, 30 bp, Homo sapiens
  misc_feature 1..30: note = chr14:42077230-42077260
  misc_feature 1..30: note = hyper
  source 1..30: mol_type = genomic DNA
ccagctcttgaattacgtggattcgggttg

SEQ ID NO: 11854 - DNA, 366 bp, Homo sapiens
  misc_feature 1..366: note = chr14:42079062-42079428
  misc_feature 1..366: note = hyper
  source 1..366: mol_type = genomic DNA
tgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacggctttgacactttctccgggcagggcggaagagctcagcggaccccctggcagacagcaagcgcatcgtggccgaggcggccgcctggatgcgagaggagggagatgcccagagccacagaggagcgtggagggcggtgg

SEQ ID NO: 11855 - DNA, 102 bp, Homo sapiens
  misc_feature 1..102: note = chr14:48143617-48143719
  misc_feature 1..102: note = hyper
  source 1..102: mol_type = genomic DNA
cgccgggaggggccccggaacggcgcgagtcgtgcattttcgctcaccagcctatcttgcctaagaatcacaaggtcacgatagcgtcgcgattccactcac

SEQ ID NO: 11856 - DNA, 37 bp, Homo sapiens; identical to SEQ ID NO: 4103
  misc_feature 1..37: note = chr14:48144727-48144764
  misc_feature 1..37: note = hyper
  source 1..37: mol_type = genomic DNA

SEQ ID NO: 11857 - DNA, 126 bp, Homo sapiens; identical to SEQ ID NO: 4104
  misc_feature 1..126: note = chr14:48145236-48145362
  misc_feature 1..126: note = hyper
  source 1..126: mol_type = genomic DNA

SEQ ID NO: 11858 - DNA, 197 bp, Homo sapiens; identical to SEQ ID NO: 4105
  misc_feature 1..197: note = chr14:48145469-48145666
  misc_feature 1..197: note = hyper
  source 1..197: mol_type = genomic DNA

SEQ ID NO: 11859 - DNA, 51 bp, Homo sapiens
  misc_feature 1..51: note = chr14:51410612-51410663
  misc_feature 1..51: note = hyper
  source 1..51: mol_type = genomic DNA
ggcggtttccaggggcggacggcacagtggtttgggcgggacactggcggg

SEQ ID NO: 11860 - DNA, 385 bp, Homo sapiens; identical to SEQ ID NO: 1147
  misc_feature 1..385: note = chr14:51560329-51560714
  misc_feature 1..385: note = hyper
  source 1..385: mol_type = genomic DNA

SEQ ID NO: 11861 - DNA, 523 bp, Homo sapiens; identical to SEQ ID NO: 1148
  misc_feature 1..523: note = chr14:51560770-51561293
  misc_feature 1..523: note = hyper
  source 1..523: mol_type = genomic DNA

SEQ ID NO: 11862 - DNA, 226 bp, Homo sapiens; identical to SEQ ID NO: 1149
  misc_feature 1..226: note = chr14:51561294-51561520
  misc_feature 1..226: note = hyper
  source 1..226: mol_type = genomic DNA

SEQ ID NO: 11863 - DNA, 74 bp, Homo sapiens
  misc_feature 1..74: note = chr14:51562419-51562493
  misc_feature 1..74: note = hyper
  source 1..74: mol_type = genomic DNA
ccgggagtctgacggcgctggcgcaagccctggcgacactcttggcttctttcatcctgcgtccctcgtttcct

SEQ ID NO: 11864 - DNA, 379 bp, Homo sapiens; identical to SEQ ID NO: 1150
  misc_feature 1..379: note = chr14:52534648-52535027
  misc_feature 1..379: note = hyper
  source 1..379: mol_type = genomic DNA

SEQ ID NO: 11865 - DNA, 209 bp, Homo sapiens; identical to SEQ ID NO: 1151
  misc_feature 1..209: note = chr14:52535055-52535264
  misc_feature 1..209: note = hyper
  source 1..209: mol_type = genomic DNA

SEQ ID NO: 11866 - DNA, 91 bp, Homo sapiens; identical to SEQ ID NO: 1152
  misc_feature 1..91: note = chr14:52535334-52535425
  misc_feature 1..91: note = hyper
  source 1..91: mol_type = genomic DNA

SEQ ID NO: 11867 - DNA, 332 bp, Homo sapiens; identical to SEQ ID NO: 1153
  misc_feature 1..332: note = chr14:52535426-52535758
  misc_feature 1..332: note = hyper
  source 1..332: mol_type = genomic DNA

SEQ ID NO: 11868 - DNA, 214 bp, Homo sapiens; identical to SEQ ID NO: 1154
  misc_feature 1..214: note = chr14:52535759-52535973
  misc_feature 1..214: note = hyper
  source 1..214: mol_type = genomic DNA

SEQ ID NO: 11869 - DNA, 92 bp, Homo sapiens; identical to SEQ ID NO: 1155
  misc_feature 1..92: note = chr14:52535974-52536066
  misc_feature 1..92: note = hyper
  source 1..92: mol_type = genomic DNA

SEQ ID NO: 11870 - DNA, 38 bp, Homo sapiens; identical to SEQ ID NO: 1156
  misc_feature 1..38: note = chr14:52536067-52536105
  misc_feature 1..38: note = hyper
  source 1..38: mol_type = genomic DNA

SEQ ID NO: 11871 - DNA, 50 bp, Homo sapiens; identical to SEQ ID NO: 1157
  misc_feature 1..50: note = chr14:52536342-52536392
  misc_feature 1..50: note = hyper
  source 1..50: mol_type = genomic DNA

SEQ ID NO: 11872 - DNA, 332 bp, Homo sapiens; identical to SEQ ID NO: 4117
  misc_feature 1..332: note = chr14:52781525-52781857
  misc_feature 1..332: note = hyper
  source 1..332: mol_type = genomic DNA

SEQ ID NO: 11873 - DNA, 494 bp, Homo sapiens
  misc_feature 1..494: note = chr14:54422431-54422925
  misc_feature 1..494: note = hyper
  source 1..494: mol_type = genomic DNA
aagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccggagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtcc

SEQ ID NO: 11874 - DNA, 34 bp, Homo sapiens
  misc_feature 1..34: note = chr14:54422926-54422960
  misc_feature 1..34: note = hyper
  source 1..34: mol_type = genomic DNA
gggatcgcaacctccagcccgtgggcaacgcgtt

SEQ ID NO: 11875 - DNA, 260 bp, Homo sapiens
  misc_feature 1..260: note = chr14:54430156-54430416
  misc_feature 1..260: note = hyper
  source 1..260: mol_type = genomic DNA
atgtccgctaactaacgtaaagaaacgtccgcgtgctccgctgataccccagggccaccggaggagagcagtggggtgtgagaactaggctgtgtccagtggctggtggtggggggagcggctactgcgccttccccttgggcactcctctcgggtccctgaggcgacgccctagtaagcctccacgcacgtcagcgaagggtgggtggagggtcaccctgaccgcgccccacagctggctcccgcgctctgcccaccgc

SEQ ID NO: 11876 - DNA, 220 bp, Homo sapiens; identical to SEQ ID NO: 1158
  misc_feature 1..220: note = chr14:57260875-57261095
  misc_feature 1..220: note = hyper
  source 1..220: mol_type = genomic DNA

SEQ ID NO: 11877 - DNA, 234 bp, Homo sapiens; identical to SEQ ID NO: 1159
  misc_feature 1..234: note = chr14:57261174-57261408
  misc_feature 1..234: note = hyper
  source 1..234: mol_type = genomic DNA

SEQ ID NO: 11878 - DNA, 382 bp, Homo sapiens; identical to SEQ ID NO: 1160
  misc_feature 1..382: note = chr14:57261465-57261847
  misc_feature 1..382: note = hyper
  source 1..382: mol_type = genomic DNA

SEQ ID NO: 11879 - DNA, 64 bp, Homo sapiens
  misc_feature 1..64: note = chr14:57262072-57262136
  misc_feature 1..64: note = hyper
  source 1..64: mol_type = genomic DNA
agggtcattggccagcgacccgccctccttacgtccggaggtcaccccacgcctacaggcaggt

SEQ ID NO: 11880 - DNA, 30 bp, Homo sapiens
  misc_feature 1..30: note = chr14:57263831-57263861
  misc_feature 1..30: note = hyper
  source 1..30: mol_type = genomic DNA
tatcagagcaccctgcgctgacaggctcgg

SEQ ID NO: 11881 - DNA, 567 bp, Homo sapiens; identical to SEQ ID NO: 1161
  misc_feature 1..567: note = chr14:57264079-57264646
  misc_feature 1..567: note = hyper
  source 1..567: mol_type = genomic DNA

SEQ ID NO: 11882 - DNA, 43 bp, Homo sapiens; identical to SEQ ID NO: 1162
  misc_feature 1..43: note = chr14:57264764-57264807
  misc_feature 1..43: note = hyper
  source 1..43: mol_type = genomic DNA

SEQ ID NO: 11883 - DNA, 93 bp, Homo sapiens; identical to SEQ ID NO: 1163
  misc_feature 1..93: note = chr14:57265147-57265240
  misc_feature 1..93: note = hyper
  source 1..93: mol_type = genomic DNA

SEQ ID NO: 11884 - DNA, 57 bp, Homo sapiens
  misc_feature 1..57: note = chr14:57265517-57265574
  misc_feature 1..57: note = hyper
  source 1..57: mol_type = genomic DNA
gccccagcctcccagcgtcttgcgcctgtggcggcggcagtacgggcctggggggtc

SEQ ID NO: 11885 - DNA, 15 bp, Homo sapiens
  misc_feature 1..15: note = chr14:57270957-57270972
  misc_feature 1..15: note = hyper
  source 1..15: mol_type = genomic DNA
aagatgtctgggtac

SEQ ID NO: 11886 - DNA, 28 bp, Homo sapiens
  misc_feature 1..28: note = chr14:57271153-57271181
  misc_feature 1..28: note = hyper
  source 1..28: mol_type = genomic DNA
cgcagcagtcccccgttcctcacagccc

SEQ ID NO: 11887 - DNA, 58 bp, Homo sapiens; identical to SEQ ID NO: 4126
  misc_feature 1..58: note = chr14:57272009-57272067
  misc_feature 1..58: note = hyper
  source 1..58: mol_type = genomic DNA

SEQ ID NO: 11888 - DNA, 30 bp, Homo sapiens
  misc_feature 1..30: note = chr14:57273051-57273081
  misc_feature 1..30: note = hyper
  source 1..30: mol_type = genomic DNA
tatgtgtctaaggaacgaaagctaaacaaa

SEQ ID NO: 11889 - DNA, 322 bp, Homo sapiens; identical to SEQ ID NO: 1166
  misc_feature 1..322: note = chr14:57274417-57274739
  misc_feature 1..322: note = hyper
  source 1..322: mol_type = genomic DNA

SEQ ID NO: 11890 - DNA, 310 bp, Homo sapiens; identical to SEQ ID NO: 1167
  misc_feature 1..310: note = chr14:57274740-57275050
  misc_feature 1..310: note = hyper
  source 1..310: mol_type = genomic DNA

SEQ ID NO: 11891 - DNA, 17 bp, Homo sapiens
  misc_feature 1..17: note = chr14:57275210-57275227
  misc_feature 1..17: note = hyper
  source 1..17: mol_type = genomic DNA
cgcgagggagggaggaa

SEQ ID NO: 11892 - DNA, 201 bp, Homo sapiens; identical to SEQ ID NO: 4130
  misc_feature 1..201: note = chr14:57275485-57275686
  misc_feature 1..201: note = hyper
  source 1..201: mol_type = genomic DNA

SEQ ID NO: 11893 - DNA, 593 bp, Homo sapiens; identical to SEQ ID NO: 4131
  misc_feature 1..593: note = chr14:57276073-57276666
  misc_feature 1..593: note = hyper
  source 1..593: mol_type = genomic DNA

SEQ ID NO: 11894 - DNA, 417 bp, Homo sapiens; identical to SEQ ID NO: 1169
  misc_feature 1..417: note = chr14:57277979-57278396
  misc_feature 1..417: note = hyper
  source 1..417: mol_type = genomic DNA

SEQ ID NO: 11895 - DNA, 69 bp, Homo sapiens; identical to SEQ ID NO: 1170
  misc_feature 1..69: note = chr14:57278694-57278763
  misc_feature 1..69: note = hyper
  source 1..69: mol_type = genomic DNA

SEQ ID NO: 11896 - DNA, 728 bp, Homo sapiens; identical to SEQ ID NO: 1171
  misc_feature 1..728: note = chr14:57278837-57279565
  misc_feature 1..728: note = hyper
  source 1..728: mol_type = genomic DNA

SEQ ID NO: 11897 - DNA, 30 bp, Homo sapiens
  misc_feature 1..30: note = chr14:57281138-57281168
  misc_feature 1..30: note = hyper
  source 1..30: mol_type = genomic DNA
tcactccctgcattgcggttgcctcaaaaa

SEQ ID NO: 11898 - DNA, 110 bp, Homo sapiens; identical to SEQ ID NO: 1172
  misc_feature 1..110: note = chr14:57283299-57283409
  misc_feature 1..110: note = hyper
  source 1..110: mol_type = genomic DNA

SEQ ID NO: 11899 - DNA, 592 bp, Homo sapiens; identical to SEQ ID NO: 1173
  misc_feature 1..592: note = chr14:57283445-57284037
  misc_feature 1..592: note = hyper
  source 1..592: mol_type = genomic DNA

SEQ ID NO: 11900 - DNA, 541 bp, Homo sapiens; identical to SEQ ID NO: 1174
  misc_feature 1..541: note = chr14:57284070-57284611
  misc_feature 1..541: note = hyper
  source 1..541: mol_type = genomic DNA

SEQ ID NO: 11901 - DNA, 128 bp, Homo sapiens
  misc_feature 1..128: note = chr14:58332254-58332382
  misc_feature 1..128: note = hyper
  source 1..128: mol_type = genomic DNA
cagcaccgaggacagcggacatacttttctccccggggggtccccgccgccaggaaggcggtgttgacagcgtccgcagggctgcaggtgtccgtaccgcgcgcccgcccgtccgcatccccgcggca

SEQ ID NO: 11902 - DNA, 68 bp, Homo sapiens
  misc_feature 1..68: note = chr14:58332640-58332708
  misc_feature 1..68: note = hyper
  source 1..68: mol_type = genomic DNA
tgcagctcctgctcccgcgcccgggctctgactccaccgcccggcgcagcaccggctccgcatcacag

SEQ ID NO: 11903 - DNA, 30 bp, Homo sapiens
  misc_feature 1..30: note = chr14:60043273-60043303
  misc_feature 1..30: note = hyper
  source 1..30: mol_type = genomic DNA
tgagtgcctcctaagcgccacctctgagga

SEQ ID NO: 11904 - DNA, 54 bp, Homo sapiens
  misc_feature 1..54: note = chr14:60097193-60097247
  misc_feature 1..54: note = hyper
  source 1..54: mol_type = genomic DNA
ccatcttggtggaatcggcagtggcctgcatcgtgcgggctttgggggctcgcc

SEQ ID NO: 11905 - DNA, 204 bp, Homo sapiens
  misc_feature 1..204: note = chr14:60097406-60097610
  misc_feature 1..204: note = hyper
  source 1..204: mol_type = genomic DNA
ggcagcgaatcagcgcggcgcggccccggagccgcctgcgcgcatggggatgcgggcgccgctccacgcgacagcgttggctgggctgcccaagggtgctaccctggagacgggtaaagcggttctggccgcgaaggcgctgacgcggacagtgggtgggaggtttgggaggaggggaaaaagggctgacggtgggggtgagag

SEQ ID NO: 11906 - DNA, 42 bp, Homo sapiens
  misc_feature 1..42: note = chr14:60336952-60336994
  misc_feature 1..42: note = hyper
  source 1..42: mol_type = genomic DNA
gcgaatattcccagtcgcccgtggcgacgcgggggtggggtc

SEQ ID NO: 11907 - DNA, 48 bp, Homo sapiens
  misc_feature 1..48: note = chr14:60386671-60386719
  misc_feature 1..48: note = hyper
  source 1..48: mol_type = genomic DNA
ccaggtggggtcttccggttggacccctgcttccgctgattggttgga

SEQ ID NO: 11908 - DNA, 330 bp, Homo sapiens; identical to SEQ ID NO: 4138
  misc_feature 1..330: note = chr14:60794473-60794803
  misc_feature 1..330: note = hyper
  source 1..330: mol_type = genomic DNA

SEQ ID NO: 11909 - DNA, 225 bp, Homo sapiens; identical to SEQ ID NO: 1175
  misc_feature 1..225: note = chr14:60952195-60952420
  misc_feature 1..225: note = hyper
  source 1..225: mol_type = genomic DNA

SEQ ID NO: 11910 - DNA, 117 bp, Homo sapiens; identical to SEQ ID NO: 1176
  misc_feature 1..117: note = chr14:60952516-60952633
  misc_feature 1..117: note = hyper
  source 1..117: mol_type = genomic DNA

SEQ ID NO: 11911 - DNA, 218 bp, Homo sapiens; identical to SEQ ID NO: 1177
  misc_feature 1..218: note = chr14:60952729-60952947
  misc_feature 1..218: note = hyper
  source 1..218: mol_type = genomic DNA

SEQ ID NO: 11912 - DNA, 311 bp, Homo sapiens; identical to SEQ ID NO: 1178
  misc_feature 1..311: note = chr14:60973697-60974008
  misc_feature 1..311: note = hyper
  source 1..311: mol_type = genomic DNA

SEQ ID NO: 11913 - DNA, 35 bp, Homo sapiens
  misc_feature 1..35: note = chr14:60974368-60974403
  misc_feature 1..35: note = hyper
  source 1..35: mol_type = genomic DNA
tgccctgcactcaggcgtggcgtgatctgacccga

SEQ ID NO: 11914 - DNA, 441 bp, Homo sapiens; identical to SEQ ID NO: 1179
  misc_feature 1..441: note = chr14:60975448-60975889
  misc_feature 1..441: note = hyper
  source 1..441: mol_type = genomic DNA

SEQ ID NO: 11915 - DNA, 440 bp, Homo sapiens; identical to SEQ ID NO: 1180
  misc_feature 1..440: note = chr14:60976074-60976514
  misc_feature 1..440: note = hyper
  source 1..440: mol_type = genomic DNA

SEQ ID NO: 11916 - DNA, 279 bp, Homo sapiens; identical to SEQ ID NO: 4145
  misc_feature 1..279: note = chr14:60977434-60977713
  misc_feature 1..279: note = hyper
  source 1..279: mol_type = genomic DNA

SEQ ID NO: 11917 - DNA, 285 bp, Homo sapiens; identical to SEQ ID NO: 4146
  misc_feature 1..285: note = chr14:60977879-60978164
  misc_feature 1..285: note = hyper
  source 1..285: mol_type = genomic DNA

SEQ ID NO: 11918 - DNA, 567 bp, Homo sapiens; identical to SEQ ID NO: 4147
  misc_feature 1..567: note = chr14:60981226-60981793
  misc_feature 1..567: note = hyper
  source 1..567: mol_type = genomic DNA

SEQ ID NO: 11919 - DNA, 258 bp, Homo sapiens; identical to SEQ ID NO: 1181
  misc_feature 1..258: note = chr14:60982110-60982368
  misc_feature 1..258: note = hyper
  source 1..258: mol_type = genomic DNA

SEQ ID NO: 11920 - DNA, 42 bp, Homo sapiens
  misc_feature 1..42: note = chr14:60982909-60982951
  misc_feature 1..42: note = hyper
  source 1..42: mol_type = genomic DNA
gaacaagcagtttcacgcctccctgcccgctcatgctgtttc

SEQ ID NO: 11921 - DNA, 316 bp, Homo sapiens; identical to SEQ ID NO: 1182
  misc_feature 1..316: note = chr14:61104241-61104557
  misc_feature 1..316: note = hyper
  source 1..316: mol_type = genomic DNA

SEQ ID NO: 11922 - DNA, 241 bp, Homo sapiens; identical to SEQ ID NO: 1183
  misc_feature 1..241: note = chr14:61104623-61104864
  misc_feature 1..241: note = hyper
  source 1..241: mol_type = genomic DNA

SEQ ID NO: 11923 - DNA, 32 bp, Homo sapiens
  misc_feature 1..32: note = chr14:61109438-61109470
  misc_feature 1..32: note = hyper
  source 1..32: mol_type = genomic DNA
ggcgcccgagcttcccgcgcctctccagggcc

SEQ ID NO: 11924 - DNA, 515 bp, Homo sapiens
  misc_feature 1..515: note = chr14:61109728-61110243
  misc_feature 1..515: note = hyper
  source 1..515: mol_type = genomic DNA
ctgtgccaggtgtcccgttggccctcagcggacaagggagagccgctaataagggtcgctgctcagcaaactcagagctcatccataagtgccaacgccactgcttctttctggaagcttccactccggcccggggtccggccccagccacgctgtcctagcccagagaacaggttcaagaacggtggtgcccagccccagcggtgcccttctccgtccctgtagctcgctgggctcttgagcccctacccactaagccaaaaattcgggaaccgggagccaaaccccttggcctctgagaatttaggaagcttcgttttcagccaagaggtcaaggcgagcagagagtggggactcgaacaatcgcgtgtttaggtttaaaacgttaaaaaataaacatcactcgagtgttttttttttttttcatttcacttggcacaatgctgtatggtttcgtcctacaaactatttataagccgttgttcattacttttggctaccgttatgacatctgt

SEQ ID NO: 11925 - DNA, 289 bp, Homo sapiens
  misc_feature 1..289: note = chr14:61114424-61114713
  misc_feature 1..289: note = hyper
  source 1..289: mol_type = genomic DNA
caaactctttggcttcgcggagcgctctccccgccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgagga

SEQ ID NO: 11926 - DNA, 358 bp, Homo sapiens
  misc_feature 1..358: note = chr14:61114997-61115355
  misc_feature 1..358: note = hyper
  source 1..358: mol_type = genomic DNA
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcctagggtcgcccgagtcgcgggaagcacgccgcgtacctttcctt

SEQ ID NO: 11927 - DNA, 122 bp, Homo sapiens
  misc_feature 1..122: note = chr14:61115927-61116049
  misc_feature 1..122: note = hyper
  source 1..122: mol_type = genomic DNA
cacggcccaggcgcacgcggcagggagcagagccgagaggcagggggcggcggccgcagggaggggggcgcggctgttcctaacctcctccttaggctttgcaaaggcgaaaaccggagtcg

SEQ ID NO: 11928 - DNA, 30 bp, Homo sapiens
  misc_feature 1..30: note = chr14:61116998-61117028
  misc_feature 1..30: note = hyper
  source 1..30: mol_type = genomic DNA
tatcttaatgttctgcgattgaaaccagca

SEQ ID NO: 11929 - DNA, 30 bp, Homo sapiens
  misc_feature 1..30: note = chr14:61655802-61655832
  misc_feature 1..30: note = hyper
  source 1..30: mol_type = genomic DNA
gacgatctgctccttcggaagaaaacacag

SEQ ID NO: 11930 - DNA, 73 bp, Homo sapiens
  misc_feature 1..73: note = chr14:61788757-61788830
  misc_feature 1..73: note = hyper
  source 1..73: mol_type = genomic DNA
gactcccggttctcccgctgcgaagcagcgcggccccccggggccggggcagcggcgccggcatgtcgtctgg

SEQ ID NO: 11931 - DNA, 154 bp, Homo sapiens; identical to SEQ ID NO: 4151
  misc_feature 1..154: note = chr14:62279322-62279476
  misc_feature 1..154: note = hyper
  source 1..154: mol_type = genomic DNA

SEQ ID NO: 11932 - DNA, 104 bp, Homo sapiens; identical to SEQ ID NO: 4152
  misc_feature 1..104: note = chr14:62279519-62279623
  misc_feature 1..104: note = hyper
  source 1..104: mol_type = genomic DNA

SEQ ID NO: 11933 - DNA, 229 bp, Homo sapiens; identical to SEQ ID NO: 4153
  misc_feature 1..229: note = chr14:62279624-62279853
  misc_feature 1..229: note = hyper
  source 1..229: mol_type = genomic DNA

SEQ ID NO: 11934 - DNA, 15 bp, Homo sapiens
  misc_feature 1..15: note = chr14:62279898-62279913
  misc_feature 1..15: note = hyper
  source 1..15: mol_type = genomic DNA
cgagttctgggtcgg

SEQ ID NO: 11935 - DNA, 120 bp, Homo sapiens
  misc_feature 1..120: note = chr14:62583750-62583870
  misc_feature 1..120: note = hyper
  source 1..120: mol_type = genomic DNA
agccaaggcctgcagcgagtgacctgcccggggaggcgcgggaccgaggctcacctacccgggcccgcgagtctcgcccagccccagcctcccaacccactctgccggccccaacttagg

SEQ ID NO: 11936 - DNA, 348 bp, Homo sapiens
  misc_feature 1..348: note = chr14:62583918-62584266
  misc_feature 1..348: note = hyper
  source 1..348: mol_type = genomic DNA
cggcgttccagctctcaaccttgctcccagcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaaca

SEQ ID NO: 11937 - DNA, 124 bp, Homo sapiens; identical to SEQ ID NO: 4155
  misc_feature 1..124: note = chr14:63511883-63512007
  misc_feature 1..124: note = hyper
  source 1..124: mol_type = genomic DNA

SEQ ID NO: 11938 - DNA, 646 bp, Homo sapiens; identical to SEQ ID NO: 4156
  misc_feature 1..646: note = chr14:63512063-63512709
  misc_feature 1..646: note = hyper
  source 1..646: mol_type = genomic DNA

SEQ ID NO: 11939 - DNA, 81 bp, Homo sapiens; identical to SEQ ID NO: 4157
  misc_feature 1..81: note = chr14:63512740-63512821
  misc_feature 1..81: note = hyper
  source 1..81: mol_type = genomic DNA

SEQ ID NO: 11940 - DNA, 73 bp, Homo sapiens; identical to SEQ ID NO: 4158
  misc_feature 1..73: note = chr14:63513035-63513108
  misc_feature 1..73: note = hyper
  source 1..73: mol_type = genomic DNA

SEQ ID NO: 11941 - DNA, 66 bp, Homo sapiens
  misc_feature 1..66: note = chr14:64761073-64761139
  misc_feature 1..66: note = hyper
  source 1..66: mol_type = genomic DNA
tgaaaagatcacaagcgacttaacgataagccccttcttccttttaaagaccgagaggagggtaga

SEQ ID NO: 11942 - DNA, 15 bp, Homo sapiens
  misc_feature 1..15: note = chr14:65007522-65007537
  misc_feature 1..15: note = hyper
  source 1..15: mol_type = genomic DNA
tctccctggttttcc

SEQ ID NO: 11943 - DNA, 15 bp, Homo sapiens
  misc_feature 1..15: note = chr14:65007552-65007567
  misc_feature 1..15: note = hyper
  source 1..15: mol_type = genomic DNA
cgcctttcagtcagg

SEQ ID NO: 11944 - DNA, 203 bp, Homo sapiens
  misc_feature 1..203: note = chr14:65008997-65009200
  misc_feature 1..203: note = hyper
  source 1..203: mol_type = genomic DNA
cgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccc

SEQ ID NO: 11945 - DNA, 282 bp, Homo sapiens
  misc_feature 1..282: note = chr14:69726381-69726663
  misc_feature 1..282: note = hyper
  source 1..282: mol_type = genomic DNA
ccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaa

SEQ ID NO: 11946 - DNA, 34 bp, Homo sapiens
  misc_feature 1..34: note = chr14:69727831-69727865
  misc_feature 1..34: note = hyper
  source 1..34: mol_type = genomic DNA
ggtgggcagtgtcagcgcccgaacttggcgatac

SEQ ID NO: 11947 - DNA, 246 bp, Homo sapiens; identical to SEQ ID NO: 4159
  misc_feature 1..246: note = chr14:70014699-70014945
  misc_feature 1..246: note = hyper
  source 1..246: mol_type = genomic DNA

SEQ ID NO: 11948 - DNA, 510 bp, Homo sapiens
  misc_feature 1..510: note = chr14:70346020-70346530
  misc_feature 1..510: note = hyper
  source 1..510: mol_type = genomic DNA
cacctgccagagggtcggcttcaacaggcctcttggcccgtcaatcaggcccgccgtgctccgccccgcccctcccgggggtttataacgggaattcccatggcccgggctcaggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccagggtaagtgcgcccccagctttgcgcccacctgcggag

SEQ ID NO: 11949 - DNA, 66 bp, Homo sapiens
  misc_feature 1..66: note = chr14:70653713-70653779
  misc_feature 1..66: note = hyper
  source 1..66: mol_type = genomic DNA
cgggtcgccaggggccgaggaggcttcccttttggtgccccaccggaaggccggatgtgttcctat

SEQ ID NO: 11950 - DNA, 220 bp, Homo sapiens; identical to SEQ ID NO: 1184
  misc_feature 1..220: note = chr14:70654070-70654290
  misc_feature 1..220: note = hyper
  source 1..220: mol_type = genomic DNA

SEQ ID NO: 11951 - DNA, 306 bp, Homo sapiens; identical to SEQ ID NO: 1185
  misc_feature 1..306: note = chr14:70654291-70654597
  misc_feature 1..306: note = hyper
  source 1..306: mol_type = genomic DNA

SEQ ID NO: 11952 - DNA, 41 bp, Homo sapiens; identical to SEQ ID NO: 1186
  misc_feature 1..41: note = chr14:70654598-70654639
  misc_feature 1..41: note = hyper
  source 1..41: mol_type = genomic DNA

SEQ ID NO: 11953 - DNA, 147 bp, Homo sapiens; identical to SEQ ID NO: 1187
  misc_feature 1..147: note = chr14:70654640-70654787
  misc_feature 1..147: note = hyper
  source 1..147: mol_type = genomic DNA

SEQ ID NO: 11954 - DNA, 858 bp, Homo sapiens; identical to SEQ ID NO: 4164
  misc_feature 1..858: note = chr14:70655032-70655890
  misc_feature 1..858: note = hyper
  source 1..858: mol_type = genomic DNA

SEQ ID NO: 11955 - DNA, 171 bp, Homo sapiens; identical to SEQ ID NO: 4165
  misc_feature 1..171: note = chr14:70655919-70656090
  misc_feature 1..171: note = hyper
  source 1..171: mol_type = genomic DNA

SEQ ID NO: 11956 - DNA, 547 bp, Homo sapiens; identical to SEQ ID NO: 4166
  misc_feature 1..547: note = chr14:72398686-72399233
  misc_feature 1..547: note = hyper
  source 1..547: mol_type = genomic DNA

SEQ ID NO: 11957 - skipped

SEQ ID NO: 11958 - DNA, 88 bp, Homo sapiens; identical to SEQ ID NO: 4168
  misc_feature 1..88: note = chr14:72399929-72400017
  misc_feature 1..88: note = hyper
  source 1..88: mol_type = genomic DNA

SEQ ID NO: 11959 - DNA, 61 bp, Homo sapiens
  misc_feature 1..61: note = chr14:74208236-74208297
  misc_feature 1..61: note = hyper
  source 1..61: mol_type = genomic DNA
accagccagcagcagcggagggcagggctgggcgggcacagggtcccgactatacccagtt

SEQ ID NO: 11960 - DNA, 351 bp, Homo sapiens; identical to SEQ ID NO: 1188
  misc_feature 1..351: note = chr14:74706046-74706397
  misc_feature 1..351: note = hyper
  source 1..351: mol_type = genomic DNA

SEQ ID NO: 11961 - DNA, 605 bp, Homo sapiens; identical to SEQ ID NO: 1189
  misc_feature 1..605: note = chr14:74706940-74707545
  misc_feature 1..605: note = hyper
  source 1..605: mol_type = genomic DNA

SEQ ID NO: 11962 - DNA, 176 bp, Homo sapiens; identical to SEQ ID NO: 1190
  misc_feature 1..176: note = chr14:74707572-74707748
  misc_feature 1..176: note = hyper
  source 1..176: mol_type = genomic DNA

SEQ ID NO: 11963 - DNA, 120 bp, Homo sapiens; identical to SEQ ID NO: 1191
  misc_feature 1..120: note = chr14:74707791-74707911
  misc_feature 1..120: note = hyper
  source 1..120: mol_type = genomic DNA

SEQ ID NO: 11964 - DNA, 418 bp, Homo sapiens; identical to SEQ ID NO: 1192
  misc_feature 1..418: note = chr14:74707912-74708330
  misc_feature 1..418: note = hyper
  source 1..418: mol_type = genomic DNA

SEQ ID NO: 11965 - DNA, 174 bp, Homo sapiens; identical to SEQ ID NO: 4174
  misc_feature 1..174: note = chr14:74708862-74709036
  misc_feature 1..174: note = hyper
  source 1..174: mol_type = genomic DNA

SEQ ID NO: 11966 - DNA, 32 bp, Homo sapiens
  misc_feature 1..32: note = chr14:74893081-74893113
  misc_feature 1..32: note = hyper
  source 1..32: mol_type = genomic DNA
cggcgaagcgaggggcgcgcagctggaacccg

SEQ ID NO: 11967 - DNA, 30 bp, Homo sapiens
  misc_feature 1..30: note = chr14:75077906-75077936
  misc_feature 1..30: note = hyper
  source 1..30: mol_type = genomic DNA
ttaacgtcggggctccgggagagttggtaa

SEQ ID NO: 11968 - DNA, 185 bp, Homo sapiens
  misc_feature 1..185: note = chr14:75078651-75078836
  misc_feature 1..185: note = hyper
  source 1..185: mol_type = genomic DNA
cggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcga

SEQ ID NO: 11969 - DNA, 208 bp, Homo sapiens
  misc_feature 1..208: note = chr14:76604597-76604805
  misc_feature 1..208: note = hyper
  source 1..208: mol_type = genomic DNA
tcagggttggcttcacggaggagggggtatctgagctgagctttgatgaatacgtcagatttgggggaaaggttgctgctggatagcggggcaggaagaacgagcgtatctagttgtaatgccaacaggtcagggggggaaagttggggaatggggtgggaggaggaagaattagactggccccttccatcatcgccatccttctgtg

SEQ ID NO: 11970 - DNA, 307 bp, Homo sapiens
  misc_feature 1..307: note = chr14:76605040-76605347
  misc_feature 1..307: note = hyper
  source 1..307: mol_type = genomic DNA
caagaaaaaagggagcgcagcgccgttcccacttgttagattgaaggcgcctctccagaggggggaaggctccaaattgctaattagcgcctgtgaaaaggcctagctctgatatgcgcgccgctgaaaggccgacgttaatgaagccgcggcgcgcccgcttccctttgactggccttcatccctcctccgcgccccgggccggcccgaacaatgcggcggggagcgcaggctcccccaggcctcgccgggacggcccgggcagcgcgcgcggggggcggcgcggcgccggcgaaatgtggagggg

SEQ ID NO: 11971 - DNA, 92 bp, Homo sapiens
  misc_feature 1..92: note = chr14:76819300-76819392
  misc_feature 1..92: note = hyper
  source 1..92: mol_type = genomic DNA
cacacggccccgaatcgccgcgctcctgcgggccgcgcgcagggtcgccgggtaggcacaggcacgtcccgtggccacggacctttgccctc

SEQ ID NO: 11972 - DNA, 262 bp, Homo sapiens
  misc_feature 1..262: note = chr14:76843732-76843994
  misc_feature 1..262: note = hyper
  source 1..262: mol_type = genomic DNA
cgctccacctgctcgggtacctgcccgggtctccccttgggcgctgcgcaccccacggcgcccccggcgggtgtcccggaggcaggttgtgtgcgcgtgcaaagtggtccctcggaaggcttaataataataatacataaaactctaggttcttacggacagctttcctgcttaactttgtgctcgtcttcctcttttttttctgacgcaaactaaattctccaagtcagcgtttctccagttccaccgtgctttcatttgt

SEQ ID NO: 11973 - DNA, 102 bp, Homo sapiens
  misc_feature 1..102: note = chr14:77227622-77227724
  misc_feature 1..102: note = hyper
  source 1..102: mol_type = genomic DNA
ctggcacgttgaaaacgtcctccgcagcttcgcaccggcttcgcggcgccctgacagctgggtgaggagggagcgaatgcccaccggcgtccttggggtaac

SEQ ID NO: 11974 - DNA, 60 bp, Homo sapiens
  misc_feature 1..60: note = chr14:77228674-77228734
  misc_feature 1..60: note = hyper
  source 1..60: mol_type = genomic DNA
gcagatgtgagcgtgcgagagttgtgtaggggattttgttccctccgaaactgagaccca

SEQ ID NO: 11975 - DNA, 46 bp, Homo sapiens
  misc_feature 1..46: note = chr14:77591352-77591398
  misc_feature 1..46: note = hyper
  source 1..46: mol_type = genomic DNA
gacccaggttggctgcggcccgcggtccccgcgcagccaacactgg

SEQ ID NO: 11976 - DNA, 43 bp, Homo sapiens
  misc_feature 1..43: note = chr14:77606813-77606856
  misc_feature 1..43: note = hyper
  source 1..43: mol_type = genomic DNA
atcaattgaaacaatcgatacactcacactcgctctcgggcac

SEQ ID NO: 11977 - DNA, 63 bp, Homo sapiens
  misc_feature 1..63: note = chr14:77606921-77606984
  misc_feature 1..63: note = hyper
  source 1..63: mol_type = genomic DNA
cgctggctgcccgggctatttctttgcgaagagcgttttcatttgaggcgaaattaaaatccc

SEQ ID NO: 11978 - DNA, 89 bp, Homo sapiens
  misc_feature 1..89: note = chr14:77607253-77607342
  misc_feature 1..89: note = hyper
  source 1..89: mol_type = genomic DNA
tcggccagccggaggcgcgagaaaagttctgggaaggcggttgcacctaggatgggtggatgccacggggcctccgtccaggctgtccc

SEQ ID NO: 11979 - DNA, 177 bp, Homo sapiens
  misc_feature 1..177: note = chr14:77607930-77608107
  misc_feature 1..177: note = hyper
  source 1..177: mol_type = genomic DNA
aggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggc

SEQ ID NO: 11980 - DNA, 75 bp, Homo sapiens
  misc_feature 1..75: note = chr14:77737071-77737146
  misc_feature 1..75: note = hyper
  source 1..75: mol_type = genomic DNA
ggcgccccagcgccccggcagcggccagttttccctccttcggggccggtcctgccgcgtgacccctttcccgcc

SEQ ID NO: 11981 - DNA, 333 bp, Homo sapiens
  misc_feature 1..333: note = chr14:77737147-77737480
  misc_feature 1..333: note = hyper
  source 1..333: mol_type = genomic DNA
aggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacac

SEQ ID NO: 11982 - DNA, 148 bp, Homo sapiens
  misc_feature 1..148: note = chr14:77964498-77964646
  misc_feature 1..148: note = hyper
  source 1..148: mol_type = genomic DNA
gctggccacccctgccggcggctggagagccccactgtgcctccgcttgtctcatggaaggggctcacctgaccgtttgaacctcagcggccctggcccgccactccgcaaagcgccagattcctcgcaccggcgggactcctctccg

SEQ ID NO: 11983 - DNA, 30 bp, Homo sapiens
  misc_feature 1..30: note = chr14:78624601-78624631
  misc_feature 1..30: note = hyper
  source 1..30: mol_type = genomic DNA
ctgctgggagctctccgtggtgctggaagc

SEQ ID NO: 11984 - DNA, 32 bp, Homo sapiens
  misc_feature 1..32: note = chr14:85996505-85996537
  misc_feature 1..32: note = hyper
  source 1..32: mol_type = genomic DNA
tgtcgccgtcacttgcgcgtttggcattatcc

SEQ ID NO: 11985 - DNA, 55 bp, Homo sapiens
  misc_feature 1..55: note = chr14:85997871-85997926
  misc_feature 1..55: note = hyper
  source 1..55: mol_type = genomic DNA
agaggataactgggacgggctggacccatacttgatacccgggaaactcctagag

SEQ ID NO: 11986 - DNA, 15 bp, Homo sapiens
  misc_feature 1..15: note = chr14:85998629-85998644
  misc_feature 1..15: note = hyper
  source 1..15: mol_type = genomic DNA
cgggctcgttctccc

SEQ ID NO: 11987 - DNA, 10 bp, Homo sapiens
  misc_feature 1..10: note = chr14:85999522-85999532
  misc_feature 1..10: note = hyper
  source 1..10: mol_type = genomic DNA
gctccaggag

SEQ ID NO: 11988 - DNA, 74 bp, Homo sapiens
  misc_feature 1..74: note = chr14:85999596-85999670
  misc_feature 1..74: note = hyper
  source 1..74: mol_type = genomic DNA
cgcgaattcattactgtaaacatatccgggggtgtcaggaggggtaggggtgggggccgcggcgcctacattag

SEQ ID NO: 11989 - DNA, 74 bp, Homo sapiens
  misc_feature 1..74: note = chr14:86000400-86000474
  misc_feature 1..74: note = hyper
  source 1..74: mol_type = genomic DNA
gcccttcctggccctcgcgggtctggcagaaagtaagagggaggcgaagttcaagatcccggggatgagcaccg

SEQ ID NO: 11990 - DNA, 120 bp, Homo sapiens
  misc_feature 1..120: note = chr14:88789455-88789575
  misc_feature 1..120: note = hyper
  source 1..120: mol_type = genomic DNA
gctgcttcccaaaagcggtgccggcaggttaggggctgcgcagcctgaaggctggggctacggagaagcccactgcagtgtcactccagcccccgaaggcgtgtgcgcacacactcccgc

SEQ ID NO: 11991 - DNA, 90 bp, Homo sapiens
  misc_feature 1..90: note = chr14:88790076-88790166
  misc_feature 1..90: note = hyper
  source 1..90: mol_type = genomic DNA
aggcgctgcaggaggcggaggaagggccgctgcggctccgccgcagacctcggcctccgggtcacctcttctcaccgctctcaccctgag

SEQ ID NO: 11992 - DNA, 67 bp, Homo sapiens
  misc_feature 1..67: note = chr14:88790467-88790534
  misc_feature 1..67: note = hyper
  source 1..67: mol_type = genomic DNA
ggcagctcccggaagcggcggccccgggatcctgggaccagcagggcagatgcgaagggacccagac

SEQ ID NO: 11993 - DNA, 80 bp, Homo sapiens
  misc_feature 1..80: note = chr14:88793005-88793085
  misc_feature 1..80: note = hyper
  source 1..80: mol_type = genomic DNA
cactcggtggcaaagcgctgctaccgggcacgggtctctgcagctcaaaacctgcccggctggagcgcaccaatagttgc

SEQ ID NO: 11994 - DNA, 70 bp, Homo sapiens; identical to SEQ ID NO: 1193
  misc_feature 1..70: note = chr14:89817946-89818016
  misc_feature 1..70: note = hyper
  source 1..70: mol_type = genomic DNA

SEQ ID NO: 11995 - DNA, 487 bp, Homo sapiens; identical to SEQ ID NO: 4176
  misc_feature 1..487: note = chr14:90084100-90084587
  misc_feature 1..487: note = hyper
  source 1..487: mol_type = genomic DNA

SEQ ID NO: 11996 - DNA, 266 bp, Homo sapiens
  misc_feature 1..266: note = chr14:90526555-90526821
  misc_feature 1..266: note = hyper
  source 1..266: mol_type = genomic DNA
agtgagtaacagagccgagaggactgctaacagcaccagggtttctgatgaaaatgcactcgccagagctgtgtttctttattcgaaatcacacggttttactcaacagggctcctagcccttctgtctctgctcctggtgcgtaagggcggtgtgtggggctctgcgcctgaaaccgctctctcggaaggtgggaagatgcccacgtatccattcctctccgcgtacagattcgctcccacacgcccgggcgggtgattccggag

SEQ ID NO: 11997 - DNA, 217 bp, Homo sapiens
  misc_feature 1..217: note = chr14:90527714-90527931
  misc_feature 1..217: note = hyper
  source 1..217: mol_type = genomic DNA
ccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 11998 - DNA, 118 bp, Homo sapiens
  misc_feature 1..118: note = chr14:90528584-90528702
  misc_feature 1..118: note = hyper
  source 1..118: mol_type = genomic DNA
cctgaacgaggacaacgcgcgctttctgctgctggccgcgctcatcgtgctctacctgctgggcggcgccgccgtcttctccgcgctggagctggcgcacgagcgccaggccaagcag

SEQ ID NO: 11999 - DNA, 53 bp, Homo sapiens
  misc_feature 1..53: note = chr14:90850275-90850328
  misc_feature 1..53: note = hyper
  source 1..53: mol_type = genomic DNA
gagctgcagaggctgcggagtgaacgcggccaggagcccgcctgggagcgcgc

SEQ ID NO: 12000 - DNA, 53 bp, Homo sapiens
  misc_feature 1..53: note = chr14:91580352-91580405
  misc_feature 1..53: note = hyper
  source 1..53: mol_type = genomic DNA
ctttaagaactggggcgggctagctgccgaggagaccacgctgctgcatgggc

SEQ ID NO: 12001 - DNA, 38 bp, Homo sapiens
  misc_feature 1..38: note = chr14:92040828-92040866
  misc_feature 1..38: note = hyper
  source 1..38: mol_type = genomic DNA
actcgtgggagtgcccgctccagcgtggtttctccttc

SEQ ID NO: 12002 - DNA, 40 bp, Homo sapiens
  misc_feature 1..40: note = chr14:92789502-92789542
  misc_feature 1..40: note = hyper
  source 1..40: mol_type = genomic DNA
cctctcagacgctggcgcccgcagccgagaagccagagag

SEQ ID NO: 12003 - DNA, 20 bp, Homo sapiens
  misc_feature 1..20: note = chr14:92789802-92789822
  misc_feature 1..20: note = hyper
  source 1..20: mol_type = genomic DNA
agggctgtggccgggcgagc

SEQ ID NO: 12004 - DNA, 140 bp, Homo sapiens
  misc_feature 1..140: note = chr14:92789959-92790099
  misc_feature 1..140: note = hyper
  source 1..140: mol_type = genomic DNA
gcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgc

SEQ ID NO: 12005 - DNA, 231 bp, Homo sapiens
  misc_feature 1..231: note = chr14:92790436-92790667
  misc_feature 1..231: note = hyper
  source 1..231: mol_type = genomic DNA
gccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcc

SEQ ID NO: 12006 - DNA, 53 bp, Homo sapiens
  misc_feature 1..53: note = chr14:92979781-92979834
  misc_feature 1..53: note = hyper
  source 1..53: mol_type = genomic DNA
cggcgccggcacaggcggagggcgtcttccttcccctgcggccccaagccaag

SEQ ID NO: 12007 - DNA, 232 bp, Homo sapiens
  misc_feature 1..232: note = chr14:92980429-92980661
  misc_feature 1..232: note = hyper
  source 1..232: mol_type = genomic DNA
gttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctgg

SEQ ID NO: 12008 - DNA, 44 bp, Homo sapiens
  misc_feature 1..44: note = chr14:93389650-93389694
  misc_feature 1..44: note = hyper
  source 1..44: mol_type = genomic DNA
cggtgcctaggtgcccggccccacaccgccagctgctcggcgcc

SEQ ID NO: 12009 - DNA, 64 bp, Homo sapiens
  misc_feature 1..64: note = chr14:93389712-93389776
  misc_feature 1..64: note = hyper
  source 1..64: mol_type = genomic DNA
cgccgctgtcctggctcttctgctctgcgccgggcaaggtgagcgagcgcggggagctcgcggg

SEQ ID NO: 12010 - DNA, 242 bp, Homo sapiens
  misc_feature 1..242: note = chr14:93897200-93897442
  misc_feature 1..242: note = hyper
  source 1..242: mol_type = genomic DNA
ctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtgtaagtagcagccggcccggcattccggcccggcctcggctggga

SEQ ID NO: 12011 - DNA, 124 bp, Homo sapiens
  misc_feature 1..124: note = chr14:94254335-94254459
  misc_feature 1..124: note = hyper
  source 1..124: mol_type = genomic DNA
agctccagaatactgcgtgcataccttggccccatggacacctccagaaacagccaagcacacttactgcgccccattaacccccatacaactcactctcactgtgagcacacttcaaacccgg

SEQ ID NO: 12012 - DNA, 139 bp, Homo sapiens
  misc_feature 1..139: note = chr14:94254498-94254637
  misc_feature 1..139: note = hyper
  source 1..139: mol_type = genomic DNA
cgtgcacacacactgatccccgtgcacacccaccgactcctgcctgcaccctcgctgaccctgcatgcacggccccaagaaatctcacgctgcctgcacccacactgcccagccggcctcattgcgcacactgcaacat

SEQ ID NO: 12013 - skipped

SEQ ID NO: 12014 - DNA, 42 bp, Homo sapiens
  misc_feature 1..42: note = chr14:94255304-94255346
  misc_feature 1..42: note = hyper
  source 1..42: mol_type = genomic DNA
cggcgggaggcgccggcagggagctcccgctggggcagcaaa

SEQ ID NO: 12015 - DNA, 23 bp, Homo sapiens
  misc_feature 1..23: note = chr14:94255584-94255607
  misc_feature 1..23: note = hyper
  source 1..23: mol_type = genomic DNA
cccccaagcctctcccgaggctg

SEQ ID NO: 12016 - DNA, 46 bp, Homo sapiens
  misc_feature 1..46: note = chr14:94255669-94255715
  misc_feature 1..46: note = hyper
  source 1..46: mol_type = genomic DNA
cgccgcactccccgcaggctctcccgggcgccggggctgaaaggtg

SEQ ID NO: 12017 - DNA, 287 bp, Homo sapiens
  misc_feature 1..287: note = chr14:94405701-94405988
  misc_feature 1..287: note = hyper
  source 1..287: mol_type = genomic DNA
ttgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcgg

SEQ ID NO: 12018 - DNA, 358 bp, Homo sapiens; identical to SEQ ID NO: 4177
  misc_feature 1..358: note = chr14:95235025-95235383
  misc_feature 1..358: note = hyper
  source 1..358: mol_type = genomic DNA

SEQ ID NO: 12019 - DNA, 30 bp, Homo sapiens
  misc_feature 1..30: note = chr14:95235665-95235695
  misc_feature 1..30: note = hyper
  source 1..30: mol_type = genomic DNA
agaattgggggtgcacgggaatcaggggtg

SEQ ID NO: 12020 - DNA, 88 bp, Homo sapiens
  misc_feature 1..88: note = chr14:95236102-95236190
  misc_feature 1..88: note = hyper
  source 1..88: mol_type = genomic DNA
agtagttgttgtagccgaggcgggagccgctgaccgcggccgggaggcccgcgccgccgggggccacggggcgcgggtagaaggcgcc

SEQ ID NO: 12021 - DNA, 30 bp, Homo sapiens
  misc_feature 1..30: note = chr14:95237011-95237041
  misc_feature 1..30: note = hyper
  source 1..30: mol_type = genomic DNA
cttttttccccctttcggaattggttttgt

SEQ ID NO: 12022 - DNA, 212 bp, Homo sapiens; identical to SEQ ID NO: 1194
  misc_feature 1..212: note = chr14:95239421-95239633
  misc_feature 1..212: note = hyper
  source 1..212: mol_type = genomic DNA

SEQ ID NO: 12023 - DNA, 30 bp, Homo sapiens
  misc_feature 1..30: note = chr14:95240484-95240514
  misc_feature 1..30: note = hyper
  source 1..30: mol_type = genomic DNA
gagtagagccagaggcgcaaatgcctcctg

SEQ ID NO: 12024 - DNA, 24 bp, Homo sapiens
  misc_feature 1..24: note = chr14:96342286-96342310
  misc_feature 1..24: note = hyper
  source 1..24: mol_type = genomic DNA
aagccacattcgccacgctcccgc

SEQ ID NO: 12025 - DNA, 26 bp, Homo sapiens
  misc_feature 1..26: note = chr14:96342605-96342631
  misc_feature 1..26: note = hyper
  source 1..26: mol_type = genomic DNA
cgcagcgcgcgtcagcgggggctccc

SEQ ID NO: 12026 - DNA, 132 bp, Homo sapiens; identical to SEQ ID NO: 4179
  misc_feature 1..132: note = chr14:96342892-96343024
  misc_feature 1..132: note = hyper
  source 1..132: mol_type = genomic DNA

SEQ ID NO: 12027 - DNA, 22 bp, Homo sapiens
  misc_feature 1..22: note = chr14:96343413-96343435
  misc_feature 1..22: note = hyper
  source 1..22: mol_type = genomic DNA
ctcctcgccttcctgcggctcc

SEQ ID NO: 12028 - DNA, 118 bp, Homo sapiens
  misc_feature 1..118: note = chr14:96343667-96343785
  misc_feature 1..118: note = hyper
  source 1..118: mol_type = genomic DNA
gcctggaggctgaactgcccgggcagacctggtgctttcttctgccttctggagaaagatgtgggtttgacatgcaggcgggagacctgtctggtctagataacggcatgtgtatgca

SEQ ID NO: 12029 - DNA, 140 bp, Homo sapiens
  misc_feature 1..140: note = chr14:97058943-97059083
  misc_feature 1..140: note = hyper
  source 1..140: mol_type = genomic DNA
cgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcg

SEQ ID NO: 12030 - DNA, 211 bp, Homo sapiens
  misc_feature 1..211: note = chr14:97499277-97499488
  misc_feature 1..211: note = hyper
  source 1..211: mol_type = genomic DNA
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccc

SEQ ID NO: 12031 - DNA, 317 bp, Homo sapiens
  misc_feature 1..317: note = chr14:97684971-97685288
  misc_feature 1..317: note = hyper
  source 1..317: mol_type = genomic DNA
agtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgc

SEQ ID NO: 12032 - DNA, 131 bp, Homo sapiens; identical to SEQ ID NO: 4180
  misc_feature 1..131: note = chr14:97685497-97685628
  misc_feature 1..131: note = hyper
  source 1..131: mol_type = genomic DNA

SEQ ID NO: 12033 - DNA, 61 bp, Homo sapiens; identical to SEQ ID NO: 4181
  misc_feature 1..61: note = chr14:97685882-97685943
  misc_feature 1..61: note = hyper
  source 1..61: mol_type = genomic DNA

SEQ ID NO: 12034 - DNA, 38 bp, Homo sapiens
  misc_feature 1..38: note = chr14:99736151-99736189
  misc_feature 1..38: note = hyper
  source 1..38: mol_type = genomic DNA
agcatataacctgcccgcggtctcgatggcacccagag

SEQ ID NO: 12035 - DNA, 32 bp, Homo sapiens
  misc_feature 1..32: note = chr14:99740538-99740570
  misc_feature 1..32: note = hyper
  source 1..32: mol_type = genomic DNA
ccctaggacacacagcgcgtcagggacaggtc

SEQ ID NO: 12036 - DNA, 84 bp, Homo sapiens
  misc_feature 1..84: note = chr14:100111793-100111877
  misc_feature 1..84: note = hyper
  source 1..84: mol_type = genomic DNA
tgccaggtgagcgggcgcgcggccaccgggcggggcggggcgcgggaggccgagtcctggagcagagatcggaaccccgcgggg

SEQ ID NO: 12037 - DNA, 333 bp, Homo sapiens
  misc_feature 1..333: note = chr14:100125656-100125989
  misc_feature 1..333: note = hyper
  source 1..333: mol_type = genomic DNA
ctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaa

SEQ ID NO: 12038 - DNA, 390 bp, Homo sapiens
  misc_feature 1..390: note = chr14:100437560-100437950
  misc_feature 1..390: note = hyper
  source 1..390: mol_type = genomic DNA
ggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcc

SEQ ID NO: 12039 - DNA, 160 bp, Homo sapiens
  misc_feature 1..160: note = chr14:100438017-100438177
  misc_feature 1..160: note = hyper
  source 1..160: mol_type = genomic DNA
cgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtc

SEQ ID NO: 12040 - DNA, 30 bp, Homo sapiens
  misc_feature 1..30: note = chr14:100438385-100438415
  misc_feature 1..30: note = hyper
  source 1..30: mol_type = genomic DNA
gacaatgaggtgagtcggggccggcgcctc

SEQ ID NO: 12041 - DNA, 300 bp, Homo sapiens
  misc_feature 1..300: note = chr14:100438631-100438931
  misc_feature 1..300: note = hyper
  source 1..300: mol_type = genomic DNA
tctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctc

SEQ ID NO: 12042 - DNA, 45 bp, Homo sapiens
  misc_feature 1..45: note = chr14:101033483-101033528
  misc_feature 1..45: note = hyper
  source 1..45: mol_type = genomic DNA
cgcctcggctcaggctccggaaggaaaacacgggaggggtgttcc

SEQ ID NO: 12043 - DNA, 50 bp, Homo sapiens
  misc_feature 1..50: note = chr14:101034056-101034106
  misc_feature 1..50: note = hyper
  source 1..50: mol_type = genomic DNA
cgcgaggctccccagcgcctcgcggcgcgcacacacgcaccacacacacg

SEQ ID NO: 12044 - DNA, 328 bp, Homo sapiens
  misc_feature 1..328: note = chr14:101035152-101035480
  misc_feature 1..328: note = hyper
  source 1..328: mol_type = genomic DNA
ccccggggctttgcccgtctttctgtgccgtgactggcactcaagggggacaggggtccgagctcagggaccacgcgacagacctgggaagactgatgactgcccatcccggcccctcgcgccgggcgccgccgccgcgtccgccgggagcgcgctccgctcgggtccgggccccacgccgcctcccccaccgccccgccgggcgagggcgcagcccggccgcagcgccaagctagaaggcccggccccggggcctcggccaggctcggccaccaacttcccgggtgctcgggccggccttccggcgctctcccggcctcagtttcct

SEQ ID NO: 12045 - DNA, 171 bp, Homo sapiens; identical to SEQ ID NO: 4182
  misc_feature 1..171: note = chr14:101543828-101543999
  misc_feature 1..171: note = hyper
  source 1..171: mol_type = genomic DNA

SEQ ID NO: 12046 - DNA, 55 bp, Homo sapiens
  misc_feature 1..55: note = chr14:101923114-101923169
  misc_feature 1..55: note = hyper
  source 1..55: mol_type = genomic DNA
ttcaagttttcatagcgctcgtcaaacagagacctcggaacgctctgcagacatt

SEQ ID NO: 12047 - DNA, 127 bp, Homo sapiens
  misc_feature 1..127: note = chr14:101923560-101923687
  misc_feature 1..127: note = hyper
  source 1..127: mol_type = genomic DNA
aaaagaggttctcagcggagcgtgtgtgaggcggggggttacgggggaggggagacggggcgggtgtgaagtctgtgccgggaaaagaaaaatatgagtgttctcttttgtgtgcgcacaaacagcc

SEQ ID NO: 12048 - DNA, 27 bp, Homo sapiens
  misc_feature 1..27: note = chr14:101924030-101924057
  misc_feature 1..27: note = hyper
  source 1..27: mol_type = genomic DNA
gacgccctggcccggtgtccccgacgc

SEQ ID NO: 12049-12050 - skipped (2 entries)

SEQ ID NO: 12051 - DNA, 214 bp, Homo sapiens
  misc_feature 1..214: note = chr14:101924858-101925072
  misc_feature 1..214: note = hyper
  source 1..214: mol_type = genomic DNA
ggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgccccccgcggcctcggcgacagcc

SEQ ID NO: 12052 - skipped

SEQ ID NO: 12053 - DNA, 276 bp, Homo sapiens
  misc_feature 1..276: note = chr14:101925706-101925982
  misc_feature 1..276: note = hyper
  source 1..276: mol_type = genomic DNA
gcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggac

SEQ ID NO: 12054 - DNA, 194 bp, Homo sapiens
  misc_feature 1..194: note = chr14:102026214-102026408
  misc_feature 1..194: note = hyper
  source 1..194: mol_type = genomic DNA
cgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccc

SEQ ID NO: 12055 - DNA, 274 bp, Homo sapiens
  misc_feature 1..274: note = chr14:102029904-102030178
  misc_feature 1..274: note = hyper
  source 1..274: mol_type = genomic DNA
ctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggg

SEQ ID NO: 12056 - DNA, 48 bp, Homo sapiens
  misc_feature 1..48: note = chr14:102030756-102030804
  misc_feature 1..48: note = hyper
  source 1..48: mol_type = genomic DNA
ggacacagtgaaagccgctgaggcgggagtgtacggatccaggtgagg

SEQ ID NO: 12057 - DNA, 284 bp, Homo sapiens
  misc_feature 1..284: note = chr14:102247792-102248076
  misc_feature 1..284: note = hyper
  source 1..284: mol_type = genomic DNA
acccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcgga

SEQ ID NO: 12058 - DNA, 746 bp, Homo sapiens; identical to SEQ ID NO: 4184
  misc_feature 1..746: note = chr14:103021342-103022088
  misc_feature 1..746: note = hyper
  source 1..746: mol_type = genomic DNA

SEQ ID NO: 12059 - DNA, 90 bp, Homo sapiens
  misc_feature 1..90: note = chr14:103389798-103389888
  misc_feature 1..90: note = hyper
  source 1..90: mol_type = genomic DNA
aggcgtcctgcagggcgcgtttgagcgggctctgcaggtatcagtagaagtccgttggagagcgcccgggcagggcgcccacagtctggc

SEQ ID NO: 12060 - DNA, 101 bp, Homo sapiens
  misc_feature 1..101: note = chr14:103394683-103394784
  misc_feature 1..101: note = hyper
  source 1..101: mol_type = genomic DNA
ccaggggactgggggcggggtgggcgcggagcaggcccggacccccgcgtggcgccgcctcagcccgtgtctcttgcagctcctgccgctggatggggaac

SEQ ID NO: 12061 - DNA, 178 bp, Homo sapiens
  misc_feature 1..178: note = chr14:103395035-103395213
  misc_feature 1..178: note = hyper
  source 1..178: mol_type = genomic DNA
cgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgc

SEQ ID NO: 12062 - DNA, 92 bp, Homo sapiens
  misc_feature 1..92: note = chr14:103550468-103550560
  misc_feature 1..92: note = hyper
  source 1..92: mol_type = genomic DNA
cagccccgcggtgggcgtgagtgcgagggaggccgggagagcgcgtgtgggcggggagcgcgagaaggagagcgagccgggagagcgcggag

SEQ ID NO: 12063 - DNA, 314 bp, Homo sapiens
  misc_feature 1..314: note = chr14:103655254-103655568
  misc_feature 1..314: note = hyper
  source 1..314: mol_type = genomic DNA
gcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgc

SEQ ID NO: 12064 - DNA, 77 bp, Homo sapiens
  misc_feature 1..77: note = chr14:103655569-103655646
  misc_feature 1..77: note = hyper
  source 1..77: mol_type = genomic DNA
ccgcggggctgcggggtcgaggggaggggactagtgtgcaggggccaccctctccccagccccgccccccgagtcca

SEQ ID NO: 12065 - DNA, 44 bp, Homo sapiens
  misc_feature 1..44: note = chr14:103687345-103687389
  misc_feature 1..44: note = hyper
  source 1..44: mol_type = genomic DNA
gcgcagccgcgttggcgcgagttttaaatcggtgccttcccagc

SEQ ID NO: 12066 - DNA, 201 bp, Homo sapiens; identical to SEQ ID NO: 4185
  misc_feature 1..201: note = chr14:103739949-103740150
  misc_feature 1..201: note = hyper
  source 1..201: mol_type = genomic DNA

SEQ ID NO: 12067 - DNA, 79 bp, Homo sapiens
  misc_feature 1..79: note = chr14:103740358-103740437
  misc_feature 1..79: note = hyper
  source 1..79: mol_type = genomic DNA
agccctgggtccaaacgggcaggagaggtcgctggtgcctccgcggtccccgccgcgcgcagaactcggccgagtgcac

SEQ ID NO: 12068 - DNA, 51 bp, Homo sapiens
  misc_feature 1..51: note = chr14:103745699-103745750
  misc_feature 1..51: note = hyper
  source 1..51: mol_type = genomic DNA
aggtcgtggacgcggcgggcgccgagcacctggtcacgctccaggacctgg

SEQ ID NO: 12069 - DNA, 102 bp, Homo sapiens
  misc_feature 1..102: note = chr14:103989352-103989454
  misc_feature 1..102: note = hyper
  source 1..102: mol_type = genomic DNA
gcctgcccagtcccccgcccaagacctcgaggccgaaacctcaggtccttggatatctggatcccctcgcacgcccttgcctctgggcgggaaactgaggcg

SEQ ID NO: 12070 - DNA, 35 bp, Homo sapiens
  misc_feature 1..35: note = chr14:104602310-104602345
  misc_feature 1..35: note = hyper
  source 1..35: mol_type = genomic DNA
gggccaggaccccaacgcgccgtgtcctcaggaca

SEQ ID NO: 12071 - DNA, 65 bp, Homo sapiens
  misc_feature 1..65: note = chr14:104602711-104602776
  misc_feature 1..65: note = hyper
  source 1..65: mol_type = genomic DNA
cggcggcggcgggcgcgcggccagtgaacgcgcgggcggggcggcggtggcgggaggcactaggg

SEQ ID NO: 12072 - DNA, 36 bp, Homo sapiens
  misc_feature 1..36: note = chr14:104604637-104604673
  misc_feature 1..36: note = hyper
  source 1..36: mol_type = genomic DNA
ggcgggaggcgcatgcgcgcgcgcaactagatcctc

SEQ ID NO: 12073 - DNA, 368 bp, Homo sapiens
  misc_feature 1..368: note = chr14:104604902-104605270
  misc_feature 1..368: note = hyper
  source 1..368: mol_type = genomic DNA
agccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcc

SEQ ID NO: 12074 - DNA, 91 bp, Homo sapiens
  misc_feature 1..91: note = chr14:105070996-105071087
  misc_feature 1..91: note = hyper
  source 1..91: mol_type = genomic DNA
gcgggaccaccaccacgaagctgaacaggaaggccaagaagtagcaggcgcactgagcgaaaaggaaattgttgagcgccatggccggccc

SEQ ID NO: 12075 - DNA, 47 bp, Homo sapiens
  misc_feature 1..47: note = chr14:105310190-105310237
  misc_feature 1..47: note = hyper
  source 1..47: mol_type = genomic DNA
caaagctcccctggccgcctttcaaaaccgaccgcctcccaactctc

SEQ ID NO: 12076 - DNA, 77 bp, Homo sapiens
  misc_feature 1..77: note = chr14:105310576-105310653
  misc_feature 1..77: note = hyper
  source 1..77: mol_type = genomic DNA
taagattctgcaactcgacttttataggggaaaccaggcacgcatttcaaaatcttctcatccgtccccacctcctt

SEQ ID NO: 12077 - DNA, 164 bp, Homo sapiens
  misc_feature 1..164: note = chr14:105714232-105714396
  misc_feature 1..164: note = hyper
  source 1..164: mol_type = genomic DNA
ggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgacctt

SEQ ID NO: 12078 - DNA, 190 bp, Homo sapiens; identical to SEQ ID NO: 4186
  misc_feature 1..190: note = chr15:23158337-23158527
  misc_feature 1..190: note = hyper
  source 1..190: mol_type = genomic DNA

SEQ ID NO: 12079 - DNA, 104 bp, Homo sapiens; identical to SEQ ID NO: 4187
  misc_feature 1..104: note = chr15:26107640-26107744
  misc_feature 1..104: note = hyper
  source 1..104: mol_type = genomic DNA

SEQ ID NO: 12080 - DNA, 482 bp, Homo sapiens; identical to SEQ ID NO: 4188
  misc_feature 1..482: note = chr15:26107845-26108327
  misc_feature 1..482: note = hyper
  source 1..482: mol_type = genomic DNA

SEQ ID NO: 12081 - DNA, 17 bp, Homo sapiens
  misc_feature 1..17: note = chr15:26327547-26327564
  misc_feature 1..17: note = hyper
  source 1..17: mol_type = genomic DNA
ctgcgcctgcgcctgcg

SEQ ID NO: 12082 - DNA, 213 bp, Homo sapiens
  misc_feature 1..213: note = chr15:26327610-26327823
  misc_feature 1..213: note = hyper
  source 1..213: mol_type = genomic DNA
cgaaaggcggaggcagggctgggcgctgtggctgctggcactacccagttcttcagcagcgctgtgcctggaggcccccagcccctcgccccccggctcgcgggaggcggcaccagacctcctcaggccctggtccctaggaaactgcagcccggcctcagtttccagaaagctcctccgtgcgatttgggaagagcacggtttgaatggttg

SEQ ID NO: 12083 - DNA, 30 bp, Homo sapiens
  misc_feature 1..30: note = chr15:27016662-27016692
  misc_feature 1..30: note = hyper
  source 1..30: mol_type = genomic DNA
tccagagtgtccctccgcagaaaactaaac

SEQ ID NO: 12084 - DNA, 30 bp, Homo sapiens
  misc_feature 1..30: note = chr15:27017778-27017808
  misc_feature 1..30: note = hyper
  source 1..30: mol_type = genomic DNA
cgccgccgtgggtcgcgcttcccgcaacgg

SEQ ID NO: 12085 - DNA, 28 bp, Homo sapiens
  misc_feature 1..28: note = chr15:27018301-27018329
  misc_feature 1..28: note = hyper
  source 1..28: mol_type = genomic DNA
cgcgcgggcgcggggcgggggaggaggc

SEQ ID NO: 12086 - DNA, 17 bp, Homo sapiens
  misc_feature 1..17: note = chr15:27113012-27113029
  misc_feature 1..17: note = hyper
  source 1..17: mol_type = genomic DNA
cgcgctcccagcccagg

SEQ ID NO: 12087 - DNA, 285 bp, Homo sapiens
  misc_feature 1..285: note = chr15:27212887-27213172
  misc_feature 1..285: note = hyper
  source 1..285: mol_type = genomic DNA
aacctggggcaaccacggagcagcggatgcgcgctgaagggcgcgtgggcagcggggtggttccgcggcctgcggggcgcagcgcgccaccgcgggatctgaaaggcgcttcctggcaacgctgctagggtcccgccgcccccgccgaggtgaagtccaacccgcagctgcgcgggcagcccaggtcttccccagaacctccggagccgaggacccagcgccaagccaggagcaaagcagcgcgccaggctggagctgttccgtcattaccgccacgtctgcgct

SEQ ID NO: 12088 - DNA, 139 bp, Homo sapiens
  misc_feature 1..139: note = chr15:28340433-28340572
  misc_feature 1..139: note = hyper
  source 1..139: mol_type = genomic DNA
ccgcccgggtgcgcccgggggaccgcggccctcccaccccgcccctgtgaaacgacagccggcagcaggcgccgcacgccgacttcacagtggcggcgatcaacagcgtgtggaaaacagcttcttcgtaaatcttaag

SEQ ID NO: 12089 - DNA, 261 bp, Homo sapiens; identical to SEQ ID NO: 1195
  misc_feature 1..261: note = chr15:28341719-28341980
  misc_feature 1..261: note = hyper
  source 1..261: mol_type = genomic DNA

SEQ ID NO: 12090 - DNA, 39 bp, Homo sapiens; identical to SEQ ID NO: 1196
  misc_feature 1..39: note = chr15:28341981-28342020
  misc_feature 1..39: note = hyper
  source 1..39: mol_type = genomic DNA

SEQ ID NO: 12091 - DNA, 15 bp, Homo sapiens
  misc_feature 1..15: note = chr15:28342521-28342536
  misc_feature 1..15: note = hyper
  source 1..15: mol_type = genomic DNA
cggccccaaggagct

SEQ ID NO: 12092 - DNA, 30 bp, Homo sapiens
  misc_feature 1..30: note = chr15:28344134-28344164
  misc_feature 1..30: note = hyper
  source 1..30: mol_type = genomic DNA
cgcctggcagagagccggagggggtgctca

SEQ ID NO: 12093 - DNA, 61 bp, Homo sapiens
  misc_feature 1..61: note = chr15:28351758-28351819
  misc_feature 1..61: note = hyper
  source 1..61: mol_type = genomic DNA
gcagggtgggggcaccgggcgcacgcggggaatttccccacgaccacggccacgccaaatg

SEQ ID NO: 12094 - DNA, 77 bp, Homo sapiens; identical to SEQ ID NO: 4192
  misc_feature 1..77: note = chr15:28352021-28352098
  misc_feature 1..77: note = hyper
  source 1..77: mol_type = genomic DNA

SEQ ID NO: 12095 - DNA, 22 bp, Homo sapiens
  misc_feature 1..22: note = chr15:28352099-28352121
  misc_feature 1..22: note = hyper
  source 1..22: mol_type = genomic DNA
ggctctggccccacggtgagcc

SEQ ID NO: 12096 - DNA, 270 bp, Homo sapiens; identical to SEQ ID NO: 4194
  misc_feature 1..270: note = chr15:28352152-28352422
  misc_feature 1..270: note = hyper
  source 1..270: mol_type = genomic DNA

SEQ ID NO: 12097 - DNA, 148 bp, Homo sapiens; identical to SEQ ID NO: 4195
  misc_feature 1..148: note = chr15:29077246-29077394
  misc_feature 1..148: note = hyper
  source 1..148: mol_type = genomic DNA

SEQ ID NO: 12098 - DNA, 170 bp, Homo sapiens; identical to SEQ ID NO: 4196
  misc_feature 1..170: note = chr15:29077428-29077598
  misc_feature 1..170: note = hyper
  source 1..170: mol_type = genomic DNA

SEQ ID NO: 12099 - DNA, 291 bp, Homo sapiens; identical to SEQ ID NO: 4197
  misc_feature 1..291: note = chr15:29130757-29131048
  misc_feature 1..291: note = hyper
  source 1..291: mol_type = genomic DNA

SEQ ID NO: 12100 - DNA, 99 bp, Homo sapiens; identical to SEQ ID NO: 4198
  misc_feature 1..99: note = chr15:29131532-29131631
  misc_feature 1..99: note = hyper
  source 1..99: mol_type = genomic DNA

SEQ ID NO: 12101 - DNA, 152 bp, Homo sapiens; identical to SEQ ID NO: 4199
  misc_feature 1..152: note = chr15:29131755-29131907
  misc_feature 1..152: note = hyper
  source 1..152: mol_type = genomic DNA

SEQ ID NO: 12102 - DNA, 30 bp, Homo sapiens
  misc_feature 1..30: note = chr15:29407444-29407474
  misc_feature 1..30: note = hyper
  source 1..30: mol_type = genomic DNA
cagcctgtgggtgggcgggtgggtggaggg

SEQ ID NO: 12103 - DNA, 97 bp, Homo sapiens
  misc_feature 1..97: note = chr15:29862098-29862195
  misc_feature 1..97: note = hyper
  source 1..97: mol_type = genomic DNA
gtcgcccacaaaccacgccgttctgggcggacgcgggaaaccagaagtccccgaagccaagtcagcgagcgaccacaggggccgcccggccgatccc

SEQ ID NO: 12104 - DNA, 47 bp, Homo sapiens
  misc_feature 1..47: note = chr15:29863563-29863610
  misc_feature 1..47: note = hyper
  source 1..47: mol_type = genomic DNA
gatgggcgcgcggggcgctgaggacggggagacgggctgggagcaga

SEQ ID NO: 12105 - DNA, 90 bp, Homo sapiens
  misc_feature 1..90: note = chr15:30260547-30260637
  misc_feature 1..90: note = hyper
  source 1..90: mol_type = genomic DNA
aaggacagacagaggcgggaggccgacgcccgggtgcgggtgccaggcgtcccggccgctccccgtcgccctacgcgccgcgggcacagc

SEQ ID NO: 12106 - DNA, 95 bp, Homo sapiens
  misc_feature 1..95: note = chr15:30261046-30261141
  misc_feature 1..95: note = hyper
  source 1..95: mol_type = genomic DNA
cagctctgggccatccgccgccaccacagctcccaccgctcccgcgcccgccgcacccgcagctgcggccgtgcgtggcccgggctcccgctccc

SEQ ID NO: 12107 - skipped

SEQ ID NO: 12108 - DNA, 155 bp, Homo sapiens; identical to SEQ ID NO: 4201
  misc_feature 1..155: note = chr15:31775483-31775638
  misc_feature 1..155: note = hyper
  source 1..155: mol_type = genomic DNA

SEQ ID NO: 12109 - DNA, 105 bp, Homo sapiens; identical to SEQ ID NO: 4202
  misc_feature 1..105: note = chr15:31775678-31775783
  misc_feature 1..105: note = hyper
  source 1..105: mol_type = genomic DNA

SEQ ID NO: 12110 - DNA, 305 bp, Homo sapiens
  misc_feature 1..305: note = chr15:33009821-33010126
  misc_feature 1..305: note = hyper
  source 1..305: mol_type = genomic DNA
cgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgc

SEQ ID NO: 12111 - DNA, 32 bp, Homo sapiens
  misc_feature 1..32: note = chr15:33010471-33010503
  misc_feature 1..32: note = hyper
  source 1..32: mol_type = genomic DNA
ctcgggtgcgttgttcgcgggggtgaattgtg

SEQ ID NO: 12112 - DNA, 316 bp, Homo sapiens; identical to SEQ ID NO: 4203
  misc_feature 1..316: note = chr15:33010850-33011166
  misc_feature 1..316: note = hyper
  source 1..316: mol_type = genomic DNA

SEQ ID NO: 12113 - DNA, 181 bp, Homo sapiens; identical to SEQ ID NO: 4204
  misc_feature 1..181: note = chr15:33011167-33011348
  misc_feature 1..181: note = hyper
  source 1..181: mol_type = genomic DNA

SEQ ID NO: 12114 - DNA, 85 bp, Homo sapiens
  misc_feature 1..85: note = chr15:33602801-33602886
  misc_feature 1..85: note = hyper
  source 1..85: mol_type = genomic DNA
ttaggggacatcctccggtcgccgcggggcgcgcgcctccgctgagtgtgcggtgcggtacccagcggtgcgggggaggctccac

SEQ ID NO: 12115 - DNA, 491 bp, Homo sapiens; identical to SEQ ID NO: 4205
  misc_feature 1..491: note = chr15:33603118-33603609
  misc_feature 1..491: note = hyper
  source 1..491: mol_type = genomic DNA

SEQ ID NO: 12116 - DNA, 114 bp, Homo sapiens; identical to SEQ ID NO: 4206
  misc_feature 1..114: note = chr15:33603647-33603761
  misc_feature 1..114: note = hyper
  source 1..114: mol_type = genomic DNA

SEQ ID NO: 12117 - DNA, 711 bp, Homo sapiens
  misc_feature 1..711: note = chr15:34728884-34729595
  misc_feature 1..711: note = hyper
  source 1..711: mol_type = genomic DNA
gccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagct

SEQ ID NO: 12118 - DNA, 334 bp, Homo sapiens; identical to SEQ ID NO: 1198
  misc_feature 1..334: note = chr15:34786610-34786944
  misc_feature 1..334: note = hyper
  source 1..334: mol_type = genomic DNA

SEQ ID NO: 12119 - DNA, 103 bp, Homo sapiens; identical to SEQ ID NO: 1199
  misc_feature 1..103: note = chr15:34787232-34787335
  misc_feature 1..103: note = hyper
  source 1..103: mol_type = genomic DNA

SEQ ID NO: 12120 - DNA, 34 bp, Homo sapiens
  misc_feature 1..34: note = chr15:34806507-34806541
  misc_feature 1..34: note = hyper
  source 1..34: mol_type = genomic DNA
cgccggagccgccctgcaccgccctgtcgcggtc

SEQ ID NO: 12121 - DNA, 69 bp, Homo sapiens
  misc_feature 1..69: note = chr15:34806978-34807047
  misc_feature 1..69: note = hyper
  source 1..69: mol_type = genomic DNA
ctacggcgggaggggcgcggaaggggagcctgtccggagccgctgtcacggccgcgactacccagcggg

SEQ ID NO: 12122 - DNA, 30 bp, Homo sapiens
  misc_feature 1..30: note = chr15:35047119-35047149
  misc_feature 1..30: note = hyper
  source 1..30: mol_type = genomic DNA
gggcacctggcgctccggcgcggcagcctg

SEQ ID NO: 12123 - DNA, 13 bp, Homo sapiens
  misc_feature 1..13: note = chr15:35047293-35047306
  misc_feature 1..13: note = hyper
  source 1..13: mol_type = genomic DNA
cgtcggagcccga

SEQ ID NO: 12124 - DNA, 291 bp, Homo sapiens; identical to SEQ ID NO: 1200
  misc_feature 1..291: note = chr15:37180507-37180798
  misc_feature 1..291: note = hyper
  source 1..291: mol_type = genomic DNA

SEQ ID NO: 12125 - DNA, 60 bp, Homo sapiens
  misc_feature 1..60: note = chr15:37403027-37403087
  misc_feature 1..60: note = hyper
  source 1..60: mol_type = genomic DNA
gggggtgagctggctcgggccgggacagaggtctctctgcgtacgccccgctccgcccgg

SEQ ID NO: 12126 - DNA, 454 bp, Homo sapiens; identical to SEQ ID NO: 4210
  misc_feature 1..454: note = chr15:40211790-40212244
  misc_feature 1..454: note = hyper
  source 1..454: mol_type = genomic DNA

SEQ ID NO: 12127 - DNA, 129 bp, Homo sapiens
  misc_feature 1..129: note = chr15:40575589-40575718
  misc_feature 1..129: note = hyper
  source 1..129: mol_type = genomic DNA
ccacatgcacccaaccgggccaatcccaaagtcgcagtcttctctccccgccctccgcccccaaccgagtcggtgccctcggctccttagaaactggcgggacctcggcctcgtcggggaagactgaaa

SEQ ID NO: 12128 - DNA, 137 bp, Homo sapiens
  misc_feature 1..137: note = chr15:41787125-41787262
  misc_feature 1..137: note = hyper
  source 1..137: mol_type = genomic DNA
cgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcg

SEQ ID NO: 12129 - DNA, 79 bp, Homo sapiens
  misc_feature 1..79: note = chr15:41804733-41804812
  misc_feature 1..79: note = hyper
  source 1..79: mol_type = genomic DNA
gggtaagggctaactcggtggcgactactgccaccttgaagggcactcaaggtggacctccccgcggaatagtccaaga

SEQ ID NO: 12130 - DNA, 544 bp, Homo sapiens; identical to SEQ ID NO: 4211
  misc_feature 1..544: note = chr15:41805028-41805572
  misc_feature 1..544: note = hyper
  source 1..544: mol_type = genomic DNA

SEQ ID NO: 12131 - DNA, 35 bp, Homo sapiens
  misc_feature 1..35: note = chr15:41877632-41877667
  misc_feature 1..35: note = hyper
  source 1..35: mol_type = genomic DNA
accagcgcctttgtccgcggcgcagaagggcccca

SEQ ID NO: 12132 - DNA, 138 bp, Homo sapiens
  misc_feature 1..138: note = chr15:41913733-41913871
  misc_feature 1..138: note = hyper
  source 1..138: mol_type = genomic DNA
tccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagt

SEQ ID NO: 12133 - DNA, 204 bp, Homo sapiens
  misc_feature 1..204: note = chr15:41952542-41952746
  misc_feature 1..204: note = hyper
  source 1..204: mol_type = genomic DNA
ccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggag

SEQ ID NO: 12134 - DNA, 76 bp, Homo sapiens; identical to SEQ ID NO: 1201
  misc_feature 1..76: note = chr15:45403605-45403681
  misc_feature 1..76: note = hyper
  source 1..76: mol_type = genomic DNA

SEQ ID NO: 12135 - DNA, 202 bp, Homo sapiens; identical to SEQ ID NO: 1202
  misc_feature 1..202: note = chr15:45403798-45404000
  misc_feature 1..202: note = hyper
  source 1..202: mol_type = genomic DNA

SEQ ID NO: 12136 - DNA, 128 bp, Homo sapiens
  misc_feature 1..128: note = chr15:45405031-45405159
  misc_feature 1..128: note = hyper
  source 1..128: mol_type = genomic DNA
agggtctcttggccccgggagcgcataagattgcgctgtgtaggcagcggagctgctgggcgcgtgttccccgcagattccccgctcagggcctttcgcgccccggcccttcgcgagccacggcccca

SEQ ID NO: 12137 - DNA, 124 bp, Homo sapiens
  misc_feature 1..124: note = chr15:45406627-45406751
  misc_feature 1..124: note = hyper
  source 1..124: mol_type = genomic DNA
agcagcccacctccacgcttccttaacggagaggtgcaggactcagacttcaccagcccactcggtcccagccttgtacgcaaagagacgccaaggacgcgctctcccgcgtccaggcagcccc

SEQ ID NO: 12138 - DNA, 192 bp, Homo sapiens
  misc_feature 1..192: note = chr15:45421473-45421665
  misc_feature 1..192: note = hyper
  source 1..192: mol_type = genomic DNA
ttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgac

SEQ ID NO: 12139 - DNA, 51 bp, Homo sapiens
  misc_feature 1..51: note = chr15:45427669-45427720
  misc_feature 1..51: note = hyper
  source 1..51: mol_type = genomic DNA
aggccaaccaggtgacgggctggctggacggcagcgccatctatggttcct

SEQ ID NO: 12140 - DNA, 71 bp, Homo sapiens; identical to SEQ ID NO: 1203
  misc_feature 1..71: note = chr15:45479446-45479517
  misc_feature 1..71: note = hyper
  source 1..71: mol_type = genomic DNA

SEQ ID NO: 12141 - skipped

SEQ ID NO: 12142 - DNA, 63 bp, Homo sapiens
  misc_feature 1..63: note = chr15:48009607-48009670
  misc_feature 1..63: note = hyper
  source 1..63: mol_type = genomic DNA
gagggagccaggctccggctcgcctgatggattgacttggagatggatcgaattacaccattt

SEQ ID NO: 12143 - DNA, 449 bp, Homo sapiens
  misc_feature 1..449: note = chr15:48010067-48010516
  misc_feature 1..449: note = hyper
  source 1..449: mol_type = genomic DNA
tgtgtgtgttgccactggacagttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgc

SEQ ID NO: 12144 - DNA, 62 bp, Homo sapiens
  misc_feature 1..62: note = chr15:48010760-48010822
  misc_feature 1..62: note = hyper
  source 1..62: mol_type = genomic DNA
caccggccaccccaccgcccacccggctcccggtgtctcctcccggccgctctacccagcaa

SEQ ID NO: 12145 - DNA, 63 bp, Homo sapiens
  misc_feature 1..63: note = chr15:48470388-48470451
  misc_feature 1..63: note = hyper
  source 1..63: mol_type = genomic DNA
cgccaccagtggccccgggcacctcggccttgttggcgtccgccatcccgccgccgctgcctc

SEQ ID NO: 12146 - DNA, 438 bp, Homo sapiens; identical to SEQ ID NO: 1205
  misc_feature 1..438: note = chr15:48936775-48937213
  misc_feature 1..438: note = hyper
  source 1..438: mol_type = genomic DNA

SEQ ID NO: 12147 - DNA, 432 bp, Homo sapiens; identical to SEQ ID NO: 1206
  misc_feature 1..432: note = chr15:48937214-48937646
  misc_feature 1..432: note = hyper
  source 1..432: mol_type = genomic DNA

SEQ ID NO: 12148 - DNA, 638 bp, Homo sapiens; identical to SEQ ID NO: 1207
  misc_feature 1..638: note = chr15:48937709-48938347
  misc_feature 1..638: note = hyper
  source 1..638: mol_type = genomic DNA

SEQ ID NO: 12149 - DNA, 162 bp, Homo sapiens; identical to SEQ ID NO: 1208
  misc_feature 1..162: note = chr15:48938348-48938510
  misc_feature 1..162: note = hyper
  source 1..162: mol_type = genomic DNA

SEQ ID NO: 12150 - DNA, 342 bp, Homo sapiens; identical to SEQ ID NO: 4220
  misc_feature 1..342: note = chr15:51385864-51386206
  misc_feature 1..342: note = hyper
  source 1..342: mol_type = genomic DNA

SEQ ID NO: 12151 - DNA, 414 bp, Homo sapiens
  misc_feature 1..414: note = chr15:51559380-51559794
  misc_feature 1..414: note = hyper
  source 1..414: mol_type = genomic DNA
gcaaaaccagctcctcgtattgtgtcccattcacagctggagcagctcgggcactaggcgaggcagggggtgcggcgagcggtctccagccggctgcctgcggtcggtgccgcccgcagaatctgcgcggcccagtgcaaaataaaaacgcggggccccgcgttcaaaaagcaggaaaaagcctttccctttctcccgtggtctttctgtccacctgtctcggcagggtttatttgctagttaagttgcgctggcttgagcacagggacgctggcgggccaaaggccgaccctcacaggcgacccagcgtggcggcgaggtcccttggctgtacgccgaggtctgcgccgcccccacgtccgtggccggccactgcccagggcggagggcagcggtgttcgccgggtgggggcc

SEQ ID NO: 12152 - DNA, 15 bp, Homo sapiens
  misc_feature 1..15: note = chr15:53075850-53075865
  misc_feature 1..15: note = hyper
  source 1..15: mol_type = genomic DNA
acaaaacaaaggaac

SEQ ID NO: 12153 - DNA, 1016 bp, Homo sapiens; identical to SEQ ID NO: 1210
  misc_feature 1..1016: note = chr15:53075985-53077001
  misc_feature 1..1016: note = hyper
  source 1..1016: mol_type = genomic DNA

SEQ ID NO: 12154 - DNA, 461 bp, Homo sapiens; identical to SEQ ID NO: 1211
  misc_feature 1..461: note = chr15:53077065-53077526
  misc_feature 1..461: note = hyper
  source 1..461: mol_type = genomic DNA

SEQ ID NO: 12155 - DNA, 158 bp, Homo sapiens
  misc_feature 1..158: note = chr15:53078040-53078198
  misc_feature 1..158: note = hyper
  source 1..158: mol_type = genomic DNA
ctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagcc

SEQ ID NO: 12156 - DNA, 70 bp, Homo sapiens
  misc_feature 1..70: note = chr15:53078922-53078992
  misc_feature 1..70: note = hyper
  source 1..70: mol_type = genomic DNA
ccatggctcagaggtcgtctctgaacagaacgtgtcagtctgtccttccagggggcgacagcaggcagtg

SEQ ID NO: 12157 - DNA, 414 bp, Homo sapiens; identical to SEQ ID NO: 4224
  misc_feature 1..414: note = chr15:53079264-53079678
  misc_feature 1..414: note = hyper
  source 1..414: mol_type = genomic DNA

SEQ ID NO: 12158 - DNA, 175 bp, Homo sapiens; identical to SEQ ID NO: 4225
  misc_feature 1..175: note = chr15:53079717-53079892
  misc_feature 1..175: note = hyper
  source 1..175: mol_type = genomic DNA

SEQ ID NO: 12159 - DNA, 84 bp, Homo sapiens; identical to SEQ ID NO: 4226
  misc_feature 1..84: note = chr15:53079970-53080054
  misc_feature 1..84: note = hyper
  source 1..84: mol_type = genomic DNA

SEQ ID NO: 12160 - DNA, 205 bp, Homo sapiens; identical to SEQ ID NO: 4227
  misc_feature 1..205: note = chr15:53080337-53080542
  misc_feature 1..205: note = hyper
  source 1..205: mol_type = genomic DNA

SEQ ID NO: 12161 - DNA, 56 bp, Homo sapiens; identical to SEQ ID NO: 4228
  misc_feature 1..56: note = chr15:53080935-53080991
  misc_feature 1..56: note = hyper
  source 1..56: mol_type = genomic DNA

SEQ ID NO: 12162 - DNA, 243 bp, Homo sapiens; identical to SEQ ID NO: 4229
  misc_feature 1..243: note = chr15:53081054-53081297
  misc_feature 1..243: note = hyper
  source 1..243: mol_type = genomic DNA

SEQ ID NO: 12163 - DNA, 293 bp, Homo sapiens; identical to SEQ ID NO: 4230
  misc_feature 1..293: note = chr15:53081398-53081691
  misc_feature 1..293: note = hyper
  source 1..293: mol_type = genomic DNA

SEQ ID NO: 12164 - DNA, 56 bp, Homo sapiens
  misc_feature 1..56: note = chr15:53082987-53083043
  misc_feature 1..56: note = hyper
  source 1..56: mol_type = genomic DNA
ctaagctttatttcccggggggctgctgggagtgcgctttcccacccttgaattca

SEQ ID NO: 12165 - DNA, 19 bp, Homo sapiens
  misc_feature 1..19: note = chr15:53083116-53083135
  misc_feature 1..19: note = hyper
  source 1..19: mol_type = genomic DNA
cgttgacccggcacccttc

SEQ ID NO: 12166 - skipped

SEQ ID NO: 12167 - DNA, 401 bp, Homo sapiens
  misc_feature 1..401: note = chr15:53095746-53096147
  misc_feature 1..401: note = hyper
  source 1..401: mol_type = genomic DNA
tcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctct

SEQ ID NO: 12168 - DNA, 36 bp, Homo sapiens
  misc_feature 1..36: note = chr15:53096459-53096495
  misc_feature 1..36: note = hyper
  source 1..36: mol_type = genomic DNA
acatgagatcaggttcgcgttcgaggatttgccccc

SEQ ID NO: 12169 - DNA, 238 bp, Homo sapiens
  misc_feature 1..238: note = chr15:53097098-53097336
  misc_feature 1..238: note = hyper
  source 1..238: mol_type = genomic DNA
tggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggagg

SEQ ID NO: 12170 - DNA, 15 bp, Homo sapiens
  misc_feature 1..15: note = chr15:53097554-53097569
  misc_feature 1..15: note = hyper
  source 1..15: mol_type = genomic DNA
tttttttcgctttgc

SEQ ID NO: 12171 - DNA, 59 bp, Homo sapiens; identical to SEQ ID NO: 4232
  misc_feature 1..59: note = chr15:53097777-53097836
  misc_feature 1..59: note = hyper
  source 1..59: mol_type = genomic DNA

SEQ ID NO: 12172 - DNA, 274 bp, Homo sapiens; identical to SEQ ID NO: 4233
  misc_feature 1..274: note = chr15:53098416-53098690
  misc_feature 1..274: note = hyper
  source 1..274: mol_type = genomic DNA

SEQ ID NO: 12173 - DNA, 45 bp, Homo sapiens
  misc_feature 1..45: note = chr15:54051776-54051821
  misc_feature 1..45: note = hyper
  source 1..45: mol_type = genomic DNA
caccagcctgggacccggcagcccgacctgcgctctgggggtgcc

SEQ ID NO: 12174 - DNA, 296 bp, Homo sapiens
  misc_feature 1..296: note = chr15:54270601-54270897
  misc_feature 1..296: note = hyper
  source 1..296: mol_type = genomic DNA
gaggaggctggggatcgcagtgccggtgctgcattcagaaaagactcagccgcagccggcgatgtgtgaagttcccagcacgcactcagcccggctgctcctcaccctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaa

SEQ ID NO: 12175 - DNA, 45 bp, Homo sapiens
  misc_feature 1..45: note = chr15:56034885-56034930
  misc_feature 1..45: note = hyper
  source 1..45: mol_type = genomic DNA
cgcagggcgagagcgggggccgggggtcagcgccaccacggagga

SEQ ID NO: 12176 - DNA, 21 bp, Homo sapiens
  misc_feature 1..21: note = chr15:58357799-58357820
  misc_feature 1..21: note = hyper
  source 1..21: mol_type = genomic DNA
cggggtcggccttcacctcgc

SEQ ID NO: 12177 - DNA, 155 bp, Homo sapiens
  misc_feature 1..155: note = chr15:58358573-58358728
  misc_feature 1..155: note = hyper
  source 1..155: mol_type = genomic DNA
aggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggagg

SEQ ID NO: 12178 - DNA, 548 bp, Homo sapiens; identical to SEQ ID NO: 1212
  misc_feature 1..548: note = chr15:60287038-60287586
  misc_feature 1..548: note = hyper
  source 1..548: mol_type = genomic DNA

SEQ ID NO: 12179 - DNA, 33 bp, Homo sapiens; identical to SEQ ID NO: 1213
  misc_feature 1..33: note = chr15:60287643-60287676
  misc_feature 1..33: note = hyper
  source 1..33: mol_type = genomic DNA

SEQ ID NO: 12180 - DNA, 30 bp, Homo sapiens
  misc_feature 1..30: note = chr15:60288814-60288844
  misc_feature 1..30: note = hyper
  source 1..30: mol_type = genomic DNA
cgatcctctgaagatcgggttaatgattta

SEQ ID NO: 12181 - DNA, 189 bp, Homo sapiens; identical to SEQ ID NO: 4236
  misc_feature 1..189: note = chr15:60289310-60289499
  misc_feature 1..189: note = hyper
  source 1..189: mol_type = genomic DNA

SEQ ID NO: 12182 - DNA, 266 bp, Homo sapiens; identical to SEQ ID NO: 1214
  misc_feature 1..266: note = chr15:60295917-60296183
  misc_feature 1..266: note = hyper
  source 1..266: mol_type = genomic DNA

SEQ ID NO: 12183 - DNA, 18 bp, Homo sapiens
  misc_feature 1..18: note = chr15:60296600-60296618
  misc_feature 1..18: note = hyper
  source 1..18: mol_type = genomic DNA
cgctgccaccatccgcgc

SEQ ID NO: 12184 - DNA, 256 bp, Homo sapiens; identical to SEQ ID NO: 1216
  misc_feature 1..256: note = chr15:60297153-60297409
  misc_feature 1..256: note = hyper
  source 1..256: mol_type = genomic DNA

SEQ ID NO: 12185 - DNA, 153 bp, Homo sapiens; identical to SEQ ID NO: 4240
  misc_feature 1..153: note = chr15:60297674-60297827
  misc_feature 1..153: note = hyper
  source 1..153: mol_type = genomic DNA

SEQ ID NO: 12186 - DNA, 228 bp, Homo sapiens; identical to SEQ ID NO: 4241
  misc_feature 1..228: note = chr15:60297941-60298169
  misc_feature 1..228: note = hyper
  source 1..228: mol_type = genomic DNA

SEQ ID NO: 12187 - DNA, 82 bp, Homo sapiens
  misc_feature 1..82: note = chr15:61519939-61520021
  misc_feature 1..82: note = hyper
  source 1..82: mol_type = genomic DNA
ggccggtacccaagccggggctggagaaatcctctccgtccccagctccaggcggctcgcgcgagcacgcttcctccggagt

SEQ ID NO: 12188 - DNA, 30 bp, Homo sapiens
  misc_feature 1..30: note = chr15:61520432-61520462
  misc_feature 1..30: note = hyper
  source 1..30: mol_type = genomic DNA
cggatgcgcgtggagcgccccacaggaccg

SEQ ID NO: 12189 - DNA, 30 bp, Homo sapiens
  misc_feature 1..30: note = chr15:61520933-61520963
  misc_feature 1..30: note = hyper
  source 1..30: mol_type = genomic DNA
atttaattgaggcaacgcagctttcctcca

SEQ ID NO: 12190 - DNA, 30 bp, Homo sapiens
  misc_feature 1..30: note = chr15:61521442-61521472
  misc_feature 1..30: note = hyper
  source 1..30: mol_type = genomic DNA
ggagatggcgagctccgagactccctctat

SEQ ID NO: 12191 - DNA, 32 bp, Homo sapiens
  misc_feature 1..32: note = chr15:61521809-61521841
  misc_feature 1..32: note = hyper
  source 1..32: mol_type = genomic DNA
gagaacagagcctcccgcgccccaatcctccc

SEQ ID NO: 12192 - DNA, 75 bp, Homo sapiens
  misc_feature 1..75: note = chr15:62457193-62457268
  misc_feature 1..75: note = hyper
  source 1..75: mol_type = genomic DNA
tggggctaggagtggcgggaagaggtgcgcctgcgggggagagaagctgctgagtttgggcgcctggagctgctg

SEQ ID NO: 12193 - DNA, 91 bp, Homo sapiens
  misc_feature 1..91: note = chr15:65669680-65669771
  misc_feature 1..91: note = hyper
  source 1..91: mol_type = genomic DNA
cagcgcttagccttgcggtctcccctggctcgtttccctcggtctccacgccagcccgccccgcttgctcccgcttcgctgcactccttgc

SEQ ID NO: 12194 - DNA, 35 bp, Homo sapiens
  misc_feature 1..35: note = chr15:65715528-65715563
  misc_feature 1..35: note = hyper
  source 1..35: mol_type = genomic DNA
gtgcctcgccctctccgggtcgccgcgggcccccg

SEQ ID NO: 12195 - DNA, 126 bp, Homo sapiens
  misc_feature 1..126: note = chr15:68113248-68113374
  misc_feature 1..126: note = hyper
  source 1..126: mol_type = genomic DNA
gcaatcggtaaagtgcggtccgcggtgatattaacccgccggacgccggcccatagtagagccccagctcctacccccacgacctgctccccggtgcccagccctgagcagcggggcttccccagc

SEQ ID NO: 12196 - DNA, 260 bp, Homo sapiens
  misc_feature 1..260: note = chr15:68114139-68114399
  misc_feature 1..260: note = hyper
  source 1..260: mol_type = genomic DNA
cggggcctaggagaacggtaacctacgtcagccagggtagccgggaagaaggcaaaggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgaggga

SEQ ID NO: 12197 - DNA, 939 bp, Homo sapiens; identical to SEQ ID NO: 4242
  misc_feature 1..939: note = chr15:68115594-68116533
  misc_feature 1..939: note = hyper
  source 1..939: mol_type = genomic DNA

SEQ ID NO: 12198 - DNA, 326 bp, Homo sapiens; identical to SEQ ID NO: 4243
  misc_feature 1..326: note = chr15:68117665-68117991
  misc_feature 1..326: note = hyper
  source 1..326: mol_type = genomic DNA

SEQ ID NO: 12199 - DNA, 404 bp, Homo sapiens
  misc_feature 1..404: note = chr15:68118253-68118657
  misc_feature 1..404: note = hyper
  source 1..404: mol_type = genomic DNA
ctgctttctctatttcgcaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaa

SEQ ID NO: 12200 - DNA, 809 bp, Homo sapiens; identical to SEQ ID NO: 1217
  misc_feature 1..809: note = chr15:68121149-68121958
  misc_feature 1..809: note = hyper
  source 1..809: mol_type = genomic DNA

SEQ ID NO: 12201 - DNA, 40 bp, Homo sapiens
  misc_feature 1..40: note = chr15:68122643-68122683
  misc_feature 1..40: note = hyper
  source 1..40: mol_type = genomic DNA
agcccttgaacccatcgctctccaccgcacccaggagctg

SEQ ID NO: 12202 - DNA, 488 bp, Homo sapiens; identical to SEQ ID NO: 1218
  misc_feature 1..488: note = chr15:68125223-68125711
  misc_feature 1..488: note = hyper
  source 1..488: mol_type = genomic DNA

SEQ ID NO: 12203 - DNA, 33 bp, Homo sapiens
  misc_feature 1..33: note = chr15:68126071-68126104
  misc_feature 1..33: note = hyper
  source 1..33: mol_type = genomic DNA
ctccccagaagcccacgacgccctgcaccattt

SEQ ID NO: 12204 - DNA, 647 bp, Homo sapiens; identical to SEQ ID NO: 4246
  misc_feature 1..647: note = chr15:68127766-68128413
  misc_feature 1..647: note = hyper
  source 1..647: mol_type = genomic DNA

SEQ ID NO: 12205 - DNA, 44 bp, Homo sapiens
  misc_feature 1..44: note = chr15:68723523-68723567
  misc_feature 1..44: note = hyper
  source 1..44: mol_type = genomic DNA
tcagggctggcttcccgctcccagccgcgcgcccctcgggccgg

SEQ ID NO: 12206 - DNA, 124 bp, Homo sapiens
  misc_feature 1..124: note = chr15:68723898-68724022
  misc_feature 1..124: note = hyper
  source 1..124: mol_type = genomic DNA
tttgagatgcttccccggagccaggcaggagggcagccagggcacactctcttggcgctgattcccttccccagccggggccgtgcgccctcggcgctcccgggacacccgagtgcccctggca

SEQ ID NO: 12207 - DNA, 121 bp, Homo sapiens
  misc_feature 1..121: note = chr15:69136224-69136345
  misc_feature 1..121: note = hyper
  source 1..121: mol_type = genomic DNA
acatacacacacacacgtgtgtgtgtttcggggctgctcaggaggacaggcggctctgcgctgcggctgtggtgggctccgtgcacaccgcgctaggctcatagggcggctggcaggtcca

SEQ ID NO: 12208 - DNA, 34 bp, Homo sapiens
  misc_feature 1..34: note = chr15:71408553-71408587
  misc_feature 1..34: note = hyper
  source 1..34: mol_type = genomic DNA
gttgctgcaacccagcgagcgcctggagcccgag

SEQ ID NO: 12209 - DNA, 132 bp, Homo sapiens
  misc_feature 1..132: note = chr15:72476743-72476875
  misc_feature 1..132: note = hyper
  source 1..132: mol_type = genomic DNA
cacagccagagcttgcgcaggccggggagctgccaggagtgccgcagccgtgcccccacctgctgggctcccgggaaaaggagcgcgcgcccctctgagccccttcctggtgcagtgcgtgtaccaagcgtg

SEQ ID NO: 12210 - DNA, 727 bp, Homo sapiens
  misc_feature 1..727: note = chr15:73659600-73660327
  misc_feature 1..727: note = hyper
  source 1..727: mol_type = genomic DNA
aatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaag

SEQ ID NO: 12211 - DNA, 267 bp, Homo sapiens
  misc_feature 1..267: note = chr15:73660446-73660713
  misc_feature 1..267: note = hyper
  source 1..267: mol_type = genomic DNA
cgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcc

SEQ ID NO: 12212 - DNA, 109 bp, Homo sapiens
  misc_feature 1..109: note = chr15:73661626-73661735
  misc_feature 1..109: note = hyper
  source 1..109: mol_type = genomic DNA
tttcctcttgggaggcgaccgggttcgtctggatgcagagtcccggccttcccgcaaccctcctggagagggggcttccggaaatgcgccgcgtcggggaggctcccac

SEQ ID NO: 12213 - DNA, 109 bp, Homo sapiens
  misc_feature 1..109: note = chr15:74422006-74422115
  misc_feature 1..109: note = hyper
  source 1..109: mol_type = genomic DNA
atcagagctagggagcgacagtcgggaacagcgagtctgccgaagccggctgttgtgtgagggtgtgagacggcggggcggtgaggggccaccgcggcttgggggatag

SEQ ID NO: 12214 - DNA, 30 bp, Homo sapiens
  misc_feature 1..30: note = chr15:74428205-74428235
  misc_feature 1..30: note = hyper
  source 1..30: mol_type = genomic DNA
tccaaagcctcctgccggcagggaaccaaa

SEQ ID NO: 12215 - DNA, 59 bp, Homo sapiens
  misc_feature 1..59: note = chr15:74429026-74429085
  misc_feature 1..59: note = hyper
  source 1..59: mol_type = genomic DNA
gatcagccctctccgcgaagcgcagcacaagcgcgggcctgggacggagtagccccccg

SEQ ID NO: 12216 - DNA, 254 bp, Homo sapiens; identical to SEQ ID NO: 4247
  misc_feature 1..254: note = chr15:74658143-74658397
  misc_feature 1..254: note = hyper
  source 1..254: mol_type = genomic DNA

SEQ ID NO: 12217 - DNA, 52 bp, Homo sapiens; identical to SEQ ID NO: 4248
  misc_feature 1..52: note = chr15:74658501-74658553
  misc_feature 1..52: note = hyper
  source 1..52: mol_type = genomic DNA

SEQ ID NO: 12218 - DNA, 91 bp, Homo sapiens; identical to SEQ ID NO: 4249
  misc_feature 1..91: note = chr15:74658554-74658645
  misc_feature 1..91: note = hyper
  source 1..91: mol_type = genomic DNA

SEQ ID NO: 12219 - DNA, 114 bp, Homo sapiens
  misc_feature 1..114: note = chr15:75251672-75251786
  misc_feature 1..114: note = hyper
  source 1..114: mol_type = genomic DNA
tacatcgtgattagccgcggggtcgctaattacagctgaagccattcattacactgtcagcgcgcgtcgcagcccgccggctgtgcgctccctcctagccgtgaaggggtgtag

SEQ ID NO: 12220 - DNA, 10 bp, Homo sapiens
  misc_feature 1..10: note = chr15:75471217-75471227
  misc_feature 1..10: note = hyper
  source 1..10: mol_type = genomic DNA
cggtttcccc

SEQ ID NO: 12221 - DNA, 29 bp, Homo sapiens
  misc_feature 1..29: note = chr15:76627508-76627537
  misc_feature 1..29: note = hyper
  source 1..29: mol_type = genomic DNA
tcctaaaggtggaggcggagctcaaaagc

SEQ ID NO: 12222 - DNA, 251 bp, Homo sapiens; identical to SEQ ID NO: 1220
  misc_feature 1..251: note = chr15:76627575-76627826
  misc_feature 1..251: note = hyper
  source 1..251: mol_type = genomic DNA

SEQ ID NO: 12223 - DNA, 462 bp, Homo sapiens; identical to SEQ ID NO: 4252
  misc_feature 1..462: note = chr15:76628564-76629026
  misc_feature 1..462: note = hyper
  source 1..462: mol_type = genomic DNA

SEQ ID NO: 12224 - DNA, 58 bp, Homo sapiens; identical to SEQ ID NO: 4253
  misc_feature 1..58: note = chr15:76629162-76629220
  misc_feature 1..58: note = hyper
  source 1..58: mol_type = genomic DNA

SEQ ID NO: 12225 - DNA, 281 bp, Homo sapiens; identical to SEQ ID NO: 1221
  misc_feature 1..281: note = chr15:76629814-76630095
  misc_feature 1..281: note = hyper
  source 1..281: mol_type = genomic DNA

SEQ ID NO: 12226 - DNA, 29 bp, Homo sapiens
  misc_feature 1..29: note = chr15:76630096-76630125
  misc_feature 1..29: note = hyper
  source 1..29: mol_type = genomic DNA
gccccgcgcccttccccggcagagaagcc

SEQ ID NO: 12227 - DNA, 244 bp, Homo sapiens; identical to SEQ ID NO: 1223
  misc_feature 1..244: note = chr15:76630519-76630763
  misc_feature 1..244: note = hyper
  source 1..244: mol_type = genomic DNA

SEQ ID NO: 12228 - DNA, 38 bp, Homo sapiens
  misc_feature 1..38: note = chr15:76638937-76638975
  misc_feature 1..38: note = hyper
  source 1..38: mol_type = genomic DNA
cgagctacaaccagacgcggccgcgctcacctgggcgt

SEQ ID NO: 12229 - DNA, 83 bp, Homo sapiens
  misc_feature 1..83: note = chr15:77924565-77924648
  misc_feature 1..83: note = hyper
  source 1..83: mol_type = genomic DNA
gggcgcagccagggccgatggcggcccccaggggcactcgccgcggggctgcccgctcggggctcggccgcggccgcctggct

SEQ ID NO: 12230 - DNA, 148 bp, Homo sapiens
  misc_feature 1..148: note = chr15:78111627-78111775
  misc_feature 1..148: note = hyper
  source 1..148: mol_type = genomic DNA
gtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgt

SEQ ID NO: 12231 - DNA, 111 bp, Homo sapiens
  misc_feature 1..111: note = chr15:78236783-78236894
  misc_feature 1..111: note = hyper
  source 1..111: mol_type = genomic DNA
cgcacacactgtttgcggagaggccagggcagacaacctccacccgtttccggagccactggcgccccctcattcccgctccagcagcccatgcctcgcttcacccctggt

SEQ ID NO: 12232 - DNA, 59 bp, Homo sapiens
  misc_feature 1..59: note = chr15:78633047-78633106
  misc_feature 1..59: note = hyper
  source 1..59: mol_type = genomic DNA
ttgctgaatgtttggcgccctcctcgatggtgcggactttatctcgtgctagatcatag

SEQ ID NO: 12233 - DNA, 91 bp, Homo sapiens; identical to SEQ ID NO: 4257
  misc_feature 1..91: note = chr15:78912281-78912372
  misc_feature 1..91: note = hyper
  source 1..91: mol_type = genomic DNA

SEQ ID NO: 12234 - DNA, 212 bp, Homo sapiens; identical to SEQ ID NO: 4258
  misc_feature 1..212: note = chr15:78912441-78912653
  misc_feature 1..212: note = hyper
  source 1..212: mol_type = genomic DNA

SEQ ID NO: 12235 - DNA, 30 bp, Homo sapiens
  misc_feature 1..30: note = chr15:78912912-78912942
  misc_feature 1..30: note = hyper
  source 1..30: mol_type = genomic DNA
agtctgcgcgggttccgagtccccggcgac

SEQ ID NO: 12236 - DNA, 174 bp, Homo sapiens
  misc_feature 1..174: note = chr15:78913296-78913470
  misc_feature 1..174: note = hyper
  source 1..174: mol_type = genomic DNA
cagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggc

SEQ ID NO: 12237 - DNA, 197 bp, Homo sapiens
  misc_feature 1..197: note = chr15:78913480-78913677
  misc_feature 1..197: note = hyper
  source 1..197: mol_type = genomic DNA
cgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatatt

SEQ ID NO: 12238 - DNA, 230 bp, Homo sapiens
  misc_feature 1..230: note = chr15:78933407-78933637
  misc_feature 1..230: note = hyper
  source 1..230: mol_type = genomic DNA
gaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccact

SEQ ID NO: 12239 - DNA, 900 bp, Homo sapiens; identical to SEQ ID NO: 1224
  misc_feature 1..900: note = chr15:79382098-79382998
  misc_feature 1..900: note = hyper
  source 1..900: mol_type = genomic DNA

SEQ ID NO: 12240 - DNA, 258 bp, Homo sapiens; identical to SEQ ID NO: 1225
  misc_feature 1..258: note = chr15:79382999-79383257
  misc_feature 1..258: note = hyper
  source 1..258: mol_type = genomic DNA

SEQ ID NO: 12241 - DNA, 67 bp, Homo sapiens; identical to SEQ ID NO: 1226
  misc_feature 1..67: note = chr15:79383317-79383384
  misc_feature 1..67: note = hyper
  source 1..67: mol_type = genomic DNA

SEQ ID NO: 12242 - DNA, 81 bp, Homo sapiens; identical to SEQ ID NO: 1227
  misc_feature 1..81: note = chr15:79383438-79383519
  misc_feature 1..81: note = hyper
  source 1..81: mol_type = genomic DNA

SEQ ID NO: 12243 - DNA, 199 bp, Homo sapiens
  misc_feature 1..199: note = chr15:79383947-79384146
  misc_feature 1..199: note = hyper
  source 1..199: mol_type = genomic DNA
gcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 12244 - DNA, 82 bp, Homo sapiens
  misc_feature 1..82: note = chr15:79502170-79502252
  misc_feature 1..82: note = hyper
  source 1..82: mol_type = genomic DNA
actgtaagtgttggacggagaactgataagggtaggtgattgacactcacagcctccggaacccccgcgccgcctgcacttg

SEQ ID NO: 12245 - DNA, 94 bp, Homo sapiens
  misc_feature 1..94: note = chr15:79574968-79575062
  misc_feature 1..94: note = hyper
  source 1..94: mol_type = genomic DNA
gggtggggcagcaggcgcctctgccgaggctgcaggtaggcacttccccacccccgcggccccctccttcctccttcctcgcagctcgcacacc

SEQ ID NO: 12246 - DNA, 206 bp, Homo sapiens
  misc_feature 1..206: note = chr15:79575293-79575499
  misc_feature 1..206: note = hyper
  source 1..206: mol_type = genomic DNA
cgcaacttggaggagcggtggaccgatttgaaggaactgacgcagaggttttattcacgaaccttgaagaagttctgggcaagtgactcaacaggacccgcggggcccggggtagccccagctcccggcgctggttcagtctggcagtgccctctggcagccaacccgcagctgcaggtaggggtgctggacgccccctgattttg

SEQ ID NO: 12247 - DNA, 223 bp, Homo sapiens
  misc_feature 1..223: note = chr15:79576060-79576283
  misc_feature 1..223: note = hyper
  source 1..223: mol_type = genomic DNA
gctggcacactctgccggcgcggccggagccccggagttcagcacctcggacagagcccgagccccgccgcccgaggcgcacagtgagcgtggaacagcccggctccctagcccccggccaacgctgctctcagttcagggcagctacgtaacaccgcccctagctccgcgccagaaagggctctcgaatcgcaaaagcaaacgtgttcgatttctgatctgc

SEQ ID NO: 12248 - DNA, 210 bp, Homo sapiens; identical to SEQ ID NO: 4263
  misc_feature 1..210: note = chr15:79724351-79724561
  misc_feature 1..210: note = hyper
  source 1..210: mol_type = genomic DNA

SEQ ID NO: 12249 - DNA, 187 bp, Homo sapiens; identical to SEQ ID NO: 4264
  misc_feature 1..187: note = chr15:79724606-79724793
  misc_feature 1..187: note = hyper
  source 1..187: mol_type = genomic DNA

SEQ ID NO: 12250 - DNA, 163 bp, Homo sapiens; identical to SEQ ID NO: 4265
  misc_feature 1..163: note = chr15:79724863-79725026
  misc_feature 1..163: note = hyper
  source 1..163: mol_type = genomic DNA

SEQ ID NO: 12251 - DNA, 75 bp, Homo sapiens; identical to SEQ ID NO: 4266
  misc_feature 1..75: note = chr15:79725422-79725497
  misc_feature 1..75: note = hyper
  source 1..75: mol_type = genomic DNA

SEQ ID NO: 12252 - DNA, 162 bp, Homo sapiens
  misc_feature 1..162: note = chr15:80544504-80544666
  misc_feature 1..162: note = hyper
  source 1..162: mol_type = genomic DNA
gagcccccagcggcgcgggcgagcccgggccagcagccgagagggggctctgagcggagccgcggccgtcctggcattttaaaggcgaggcagctggacgctgttcaagcggaaacgcagagagaaacttcagcccccggggcagagcgttggcagcgaggg

SEQ ID NO: 12253 - DNA, 290 bp, Homo sapiens
  misc_feature 1..290: note = chr15:82336879-82337169
  misc_feature 1..290: note = hyper
  source 1..290: mol_type = genomic DNA
agacaggctcctccccgcgaactggggtcttgatgtaagtattggtcttcgcccgcagcgctttgattttacaacctacgaaccagggtgcggaggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccat

SEQ ID NO: 12254 - DNA, 180 bp, Homo sapiens; identical to SEQ ID NO: 4267
  misc_feature 1..180: note = chr15:82340007-82340187
  misc_feature 1..180: note = hyper
  source 1..180: mol_type = genomic DNA

SEQ ID NO: 12255 - DNA, 35 bp, Homo sapiens
  misc_feature 1..35: note = chr15:83314969-83315004
  misc_feature 1..35: note = hyper
  source 1..35: mol_type = genomic DNA
ccgctagcaagggaccgcaccgtcacctgaggggc

SEQ ID NO: 12256 - DNA, 84 bp, Homo sapiens
  misc_feature 1..84: note = chr15:83315297-83315381
  misc_feature 1..84: note = hyper
  source 1..84: mol_type = genomic DNA
ccccagctgagagcacggtgcaaggggccagggctgcagggagcaaagtgcccccgaaaaataagcgcgcgcccacgaaagcgc

SEQ ID NO: 12257 - DNA, 409 bp, Homo sapiens; identical to SEQ ID NO: 4268
  misc_feature 1..409: note = chr15:83316231-83316640
  misc_feature 1..409: note = hyper
  source 1..409: mol_type = genomic DNA

SEQ ID NO: 12258 - DNA, 333 bp, Homo sapiens; identical to SEQ ID NO: 4269
  misc_feature 1..333: note = chr15:83316641-83316974
  misc_feature 1..333: note = hyper
  source 1..333: mol_type = genomic DNA

SEQ ID NO: 12259 - DNA, 542 bp, Homo sapiens; identical to SEQ ID NO: 4270
  misc_feature 1..542: note = chr15:83349070-83349612
  misc_feature 1..542: note = hyper
  source 1..542: mol_type = genomic DNA

SEQ ID NO: 12260 - DNA, 38 bp, Homo sapiens; identical to SEQ ID NO: 4271
  misc_feature 1..38: note = chr15:83349671-83349709
  misc_feature 1..38: note = hyper
  source 1..38: mol_type = genomic DNA

SEQ ID NO: 12261 - DNA, 165 bp, Homo sapiens
  misc_feature 1..165: note = chr15:83378857-83379022
  misc_feature 1..165: note = hyper
  source 1..165: mol_type = genomic DNA
agctgcccccacccccgaccacctggcctcggcgggacgggcctctggggctccgctctccccagacgcacgcgcggatgctcacccacgccgtggagggaaagcgggaactggaaagaaggctgtgcccgcaggctgggggttctagagcgggaaggggtcacc

SEQ ID NO: 12262 - DNA, 69 bp, Homo sapiens; identical to SEQ ID NO: 4272
  misc_feature 1..69: note = chr15:83775933-83776002
  misc_feature 1..69: note = hyper
  source 1..69: mol_type = genomic DNA

SEQ ID NO: 12263 - DNA, 116 bp, Homo sapiens; identical to SEQ ID NO: 4273
  misc_feature 1..116: note = chr15:83776022-83776138
  misc_feature 1..116: note = hyper
  source 1..116: mol_type = genomic DNA

SEQ ID NO: 12264 - DNA, 112 bp, Homo sapiens; identical to SEQ ID NO: 4274
  misc_feature 1..112: note = chr15:83776157-83776269
  misc_feature 1..112: note = hyper
  source 1..112: mol_type = genomic DNA

SEQ ID NO: 12265 - DNA, 37 bp, Homo sapiens; identical to SEQ ID NO: 4275
  misc_feature 1..37: note = chr15:83776270-83776307
  misc_feature 1..37: note = hyper
  source 1..37: mol_type = genomic DNA

SEQ ID NO: 12266 - DNA, 385 bp, Homo sapiens; identical to SEQ ID NO: 4276
  misc_feature 1..385: note = chr15:83776332-83776717
  misc_feature 1..385: note = hyper
  source 1..385: mol_type = genomic DNA

SEQ ID NO: 12267 - DNA, 176 bp, Homo sapiens
  misc_feature 1..176: note = chr15:83875705-83875881
  misc_feature 1..176: note = hyper
  source 1..176: mol_type = genomic DNA
cgttcgcccgggacccagggtatccaccaatgaccctgcccggagccgaagcctccgtcgcaggcccgctgcccggcggcgtggcttcccggtcggcaccggctttccaggaggaaggcagcgtcgggcctgcgggggccggacccgccttcgaaagtgggcggaaggatggccgc

SEQ ID NO: 12268 - DNA, 260 bp, Homo sapiens
  misc_feature 1..260: note = chr15:83876223-83876483
  misc_feature 1..260: note = hyper
  source 1..260: mol_type = genomic DNA
ccccccgcgggccgacgaattgcgccgcgctccccgcgggcctcaagccgggcggacgagcggccgctccgacgaggggaagcggcgaggcggcggctgaggcaaggggtgggcggggggcgcagcaggcccggcaaatcacggcccggcagcgggggaggggagcccccggccgttcggcgctcgcccgcgtccggccgcgccaaggtccccgccgccgccgccgccgccgccgcgcgcgctgctcaccagcgccgcgt

SEQ ID NO: 12269 - DNA, 34 bp, Homo sapiens
  misc_feature 1..34: note = chr15:83876788-83876822
  misc_feature 1..34: note = hyper
  source 1..34: mol_type = genomic DNA
gaagcccgcgccgggcgggcgggagtgcctactc

SEQ ID NO: 12270 - DNA, 113 bp, Homo sapiens
  misc_feature 1..113: note = chr15:83877036-83877149
  misc_feature 1..113: note = hyper
  source 1..113: mol_type = genomic DNA
agtgggggacaaaggcgctccaggcctgggggacggcggcgcgaggggaccctctgctgggcaccaagctgccggaaagagcaccgctccggagtcagcgaccttattggatt

SEQ ID NO: 12271 - DNA, 64 bp, Homo sapiens; identical to SEQ ID NO: 1228
  misc_feature 1..64: note = chr15:84115747-84115811
  misc_feature 1..64: note = hyper
  source 1..64: mol_type = genomic DNA

SEQ ID NO: 12272 - DNA, 42 bp, Homo sapiens; identical to SEQ ID NO: 1229
  misc_feature 1..42: note = chr15:84115812-84115854
  misc_feature 1..42: note = hyper
  source 1..42: mol_type = genomic DNA

SEQ ID NO: 12273 - DNA, 194 bp, Homo sapiens; identical to SEQ ID NO: 1230
  misc_feature 1..194: note = chr15:84115931-84116125
  misc_feature 1..194: note = hyper
  source 1..194: mol_type = genomic DNA

SEQ ID NO: 12274 - DNA, 41 bp, Homo sapiens
  misc_feature 1..41: note = chr15:84116828-84116869
  misc_feature 1..41: note = hyper
  source 1..41: mol_type = genomic DNA
cgaaatggccccgtctggactgtgcccggctccccggctgg

SEQ ID NO: 12275 - DNA, 33 bp, Homo sapiens
  misc_feature 1..33: note = chr15:84322478-84322511
  misc_feature 1..33: note = hyper
  source 1..33: mol_type = genomic DNA
cggcggcggtggcggcgtcggcaatcccggctc

SEQ ID NO: 12276 - DNA, 44 bp, Homo sapiens
  misc_feature 1..44: note = chr15:84322993-84323037
  misc_feature 1..44: note = hyper
  source 1..44: mol_type = genomic DNA
ggggctgcacgtcccagatacttctgcggcgcaaggtgggtgca

SEQ ID NO: 12277 - DNA, 42 bp, Homo sapiens; identical to SEQ ID NO: 1231
  misc_feature 1..42: note = chr15:84748578-84748620
  misc_feature 1..42: note = hyper
  source 1..42: mol_type = genomic DNA

SEQ ID NO: 12278 - DNA, 691 bp, Homo sapiens; identical to SEQ ID NO: 1232
  misc_feature 1..691: note = chr15:84748678-84749369
  misc_feature 1..691: note = hyper
  source 1..691: mol_type = genomic DNA

SEQ ID NO: 12279 - DNA, 41 bp, Homo sapiens
  misc_feature 1..41: note = chr15:88799221-88799262
  misc_feature 1..41: note = hyper
  source 1..41: mol_type = genomic DNA
ggaagaggttcccatcgtccggccgccggcaattgatctca

SEQ ID NO: 12280 - DNA, 492 bp, Homo sapiens; identical to SEQ ID NO: 1233
  misc_feature 1..492: note = chr15:88799507-88799999
  misc_feature 1..492: note = hyper
  source 1..492: mol_type = genomic DNA

SEQ ID NO: 12281 - DNA, 302 bp, Homo sapiens; identical to SEQ ID NO: 1234
  misc_feature 1..302: note = chr15:88800000-88800302
  misc_feature 1..302: note = hyper
  source 1..302: mol_type = genomic DNA

SEQ ID NO: 12282 - DNA, 555 bp, Homo sapiens; identical to SEQ ID NO: 1235
  misc_feature 1..555: note = chr15:88800412-88800967
  misc_feature 1..555: note = hyper
  source 1..555: mol_type = genomic DNA

SEQ ID NO: 12283 - DNA, 30 bp, Homo sapiens
  misc_feature 1..30: note = chr15:88801202-88801232
  misc_feature 1..30: note = hyper
  source 1..30: mol_type = genomic DNA
tgaaaaaaaaaaaaacgagcattcgctgtg

SEQ ID NO: 12284 - DNA, 30 bp, Homo sapiens
  misc_feature 1..30: note = chr15:89147617-89147647
  misc_feature 1..30: note = hyper
  source 1..30: mol_type = genomic DNA
gtgtctcttctggtccgggcacaactggat

SEQ ID NO: 12285 - DNA, 35 bp, Homo sapiens
  misc_feature 1..35: note = chr15:89148146-89148181
  misc_feature 1..35: note = hyper
  source 1..35: mol_type = genomic DNA
gtcttcctccctagccgcggcgacccatgccaggt

SEQ ID NO: 12286 - DNA, 231 bp, Homo sapiens
  misc_feature 1..231: note = chr15:89148437-89148668
  misc_feature 1..231: note = hyper
  source 1..231: mol_type = genomic DNA
gttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctc

SEQ ID NO: 12287 - DNA, 40 bp, Homo sapiens
  misc_feature 1..40: note = chr15:89148879-89148919
  misc_feature 1..40: note = hyper
  source 1..40: mol_type = genomic DNA
tctgctgaaagagagcgcctaatgccgttacttcccagtg

SEQ ID NO: 12288 - DNA, 213 bp, Homo sapiens; identical to SEQ ID NO: 4285
  misc_feature 1..213: note = chr15:89149139-89149352
  misc_feature 1..213: note = hyper
  source 1..213: mol_type = genomic DNA

SEQ ID NO: 12289 - DNA, 53 bp, Homo sapiens
  misc_feature 1..53: note = chr15:89248428-89248481
  misc_feature 1..53: note = hyper
  source 1..53: mol_type = genomic DNA
ggaggctgacgggggcgcagcttttcctcctgagtgttcgctgcccgggctgg

SEQ ID NO: 12290 - DNA, 92 bp, Homo sapiens
  misc_feature 1..92: note = chr15:89248695-89248787
  misc_feature 1..92: note = hyper
  source 1..92: mol_type = genomic DNA
ggggagggactggatcgggcgccaatcccgcccgccgcgcgccgcccgggctccctcgggctctcatttaccccggccgctggcagcgggac

SEQ ID NO: 12291 - DNA, 289 bp, Homo sapiens; identical to SEQ ID NO: 1236
  misc_feature 1..289: note = chr15:89346038-89346327
  misc_feature 1..289: note = hyper
  source 1..289: mol_type = genomic DNA

SEQ ID NO: 12292 - DNA, 115 bp, Homo sapiens; identical to SEQ ID NO: 1237
  misc_feature 1..115: note = chr15:89346346-89346461
  misc_feature 1..115: note = hyper
  source 1..115: mol_type = genomic DNA

SEQ ID NO: 12293 - DNA, 321 bp, Homo sapiens
  misc_feature 1..321: note = chr15:89346895-89347216
  misc_feature 1..321: note = hyper
  source 1..321: mol_type = genomic DNA
gcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagca

SEQ ID NO: 12294 - DNA, 383 bp, Homo sapiens; identical to SEQ ID NO: 1238
  misc_feature 1..383: note = chr15:89903431-89903814
  misc_feature 1..383: note = hyper
  source 1..383: mol_type = genomic DNA

SEQ ID NO: 12295 - DNA, 86 bp, Homo sapiens
  misc_feature 1..86: note = chr15:89906156-89906242
  misc_feature 1..86: note = hyper
  source 1..86: mol_type = genomic DNA
ggtgcgctcccactgcgggtgggaggcaggactcagtcatcccgggcaaagggttgtggggcagtgggaagcgcccagaggtgagg

SEQ ID NO: 12296 - DNA, 30 bp, Homo sapiens
  misc_feature 1..30: note = chr15:89909322-89909352
  misc_feature 1..30: note = hyper
  source 1..30: mol_type = genomic DNA
aaaggaatgtgtctgcgaagtgggatttcg

SEQ ID NO: 12297 - DNA, 493 bp, Homo sapiens
  misc_feature 1..493: note = chr15:89910545-89911038
  misc_feature 1..493: note = hyper
  source 1..493: mol_type = genomic DNA
ccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcag

SEQ ID NO: 12298 - DNA, 486 bp, Homo sapiens
  misc_feature 1..486: note = chr15:89911610-89912096
  misc_feature 1..486: note = hyper
  source 1..486: mol_type = genomic DNA
gggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcggg

SEQ ID NO: 12299 - DNA, 95 bp, Homo sapiens
  misc_feature 1..95: note = chr15:89913460-89913555
  misc_feature 1..95: note = hyper
  source 1..95: mol_type = genomic DNA
gccttcctccctcaccggccaacgggtgtgggcaaaccctgggccccgggcttcgatcttcccctcccaccacccctacccgtttgctgtgttgc

SEQ ID NO: 12300 - DNA, 118 bp, Homo sapiens
  misc_feature 1..118: note = chr15:89914332-89914450
  misc_feature 1..118: note = hyper
  source 1..118: mol_type = genomic DNA
ccactgacagggcagcgatcagtacagccaccgtggtgggcgaggcatccggggcttccttttctctggtccacgaactcccaactccgaacgctgtgggactgcatgggcctctgcc

SEQ ID NO: 12301 - DNA, 503 bp, Homo sapiens
  misc_feature 1..503: note = chr15:89914866-89915369
  misc_feature 1..503: note = hyper
  source 1..503: mol_type = genomic DNA
cgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccacccca

SEQ ID NO: 12302 - DNA, 248 bp, Homo sapiens; identical to SEQ ID NO: 1239
  misc_feature 1..248: note = chr15:89922499-89922747
  misc_feature 1..248: note = hyper
  source 1..248: mol_type = genomic DNA

SEQ ID NO: 12303 - DNA, 590 bp, Homo sapiens
  misc_feature 1..590: note = chr15:89942665-89943255
  misc_feature 1..590: note = hyper
  source 1..590: mol_type = genomic DNA
ggcagaaccactgaccggcaggcggcgctccccggggctcccggctcgagccccagggcaccgggaggagtaaggaccccgagcgggagggagacgactggggggcgcgcggcacaaagagctttttattcaaatttgtttagagtttcgcgaatttgcatgaaaaatgtgtgagaaaagccagctccggtgacctcatccgcacctgccattaacgttcaattagcggctgaatagcggccgccgacgcgacgtgcagagaatccggcctgccccgcgcagcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaa

SEQ ID NO: 12304 - DNA, 326 bp, Homo sapiens; identical to SEQ ID NO: 1240
  misc_feature 1..326: note = chr15:89949616-89949942
  misc_feature 1..326: note = hyper
  source 1..326: mol_type = genomic DNA

SEQ ID NO: 12305 - DNA, 126 bp, Homo sapiens; identical to SEQ ID NO: 1241
  misc_feature 1..126: note = chr15:89950355-89950481
  misc_feature 1..126: note = hyper
  source 1..126: mol_type = genomic DNA

SEQ ID NO: 12306 - DNA, 15 bp, Homo sapiens
  misc_feature 1..15: note = chr15:89950722-89950737
  misc_feature 1..15: note = hyper
  source 1..15: mol_type = genomic DNA
agttagttacttagc

SEQ ID NO: 12307 - DNA, 208 bp, Homo sapiens; identical to SEQ ID NO: 4293
  misc_feature 1..208: note = chr15:89951081-89951289
  misc_feature 1..208: note = hyper
  source 1..208: mol_type = genomic DNA

SEQ ID NO: 12308 - DNA, 28 bp, Homo sapiens
  misc_feature 1..28: note = chr15:89951349-89951377
  misc_feature 1..28: note = hyper
  source 1..28: mol_type = genomic DNA
gataaactcgcttttcttccggtaagtg

SEQ ID NO: 12309 - DNA, 90 bp, Homo sapiens; identical to SEQ ID NO: 4295
  misc_feature 1..90: note = chr15:89951465-89951555
  misc_feature 1..90: note = hyper
  source 1..90: mol_type = genomic DNA

SEQ ID NO: 12310 - DNA, 308 bp, Homo sapiens; identical to SEQ ID NO: 1242
  misc_feature 1..308: note = chr15:89952145-89952453
  misc_feature 1..308: note = hyper
  source 1..308: mol_type = genomic DNA

SEQ ID NO: 12311 - DNA, 375 bp, Homo sapiens; identical to SEQ ID NO: 1243
  misc_feature 1..375: note = chr15:89952699-89953074
  misc_feature 1..375: note = hyper
  source 1..375: mol_type = genomic DNA

SEQ ID NO: 12312 - DNA, 30 bp, Homo sapiens
  misc_feature 1..30: note = chr15:89954324-89954354
  misc_feature 1..30: note = hyper
  source 1..30: mol_type = genomic DNA
ttagctcagccctggcgctgccttccagga

SEQ ID NO: 12313 - DNA, 42 bp, Homo sapiens
  misc_feature 1..42: note = chr15:89954800-89954842
  misc_feature 1..42: note = hyper
  source 1..42: mol_type = genomic DNA
cattgtgcagactcccggggtcaggtcgcagggtcacgtgca

SEQ ID NO: 12314 - DNA, 28 bp, Homo sapiens
  misc_feature 1..28: note = chr15:89955001-89955029
  misc_feature 1..28: note = hyper
  source 1..28: mol_type = genomic DNA
gggatagtcgcaccgacaaaaatcacag

SEQ ID NO: 12315 - DNA, 15 bp, Homo sapiens
  misc_feature 1..15: note = chr15:89956339-89956354
  misc_feature 1..15: note = hyper
  source 1..15: mol_type = genomic DNA
tatattttaagcccc

SEQ ID NO: 12316 - DNA, 30 bp, Homo sapiens
  misc_feature 1..30: note = chr15:89962817-89962847
  misc_feature 1..30: note = hyper
  source 1..30: mol_type = genomic DNA
ctccgttggggtcaccgacagaggctcact

SEQ ID NO: 12317 - DNA, 224 bp, Homo sapiens
  misc_feature 1..224: note = chr15:90039584-90039808
  misc_feature 1..224: note = hyper
  source 1..224: mol_type = genomic DNA
gacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcaggtgagcggcagccgccagcggaggttggtgttccaggccatgctgcaggggtgcctggccgggctggcagcggg

SEQ ID NO: 12318 - DNA, 177 bp, Homo sapiens
  misc_feature 1..177: note = chr15:90357883-90358060
  misc_feature 1..177: note = hyper
  source 1..177: mol_type = genomic DNA
gcagaagtccagctccgcacgcgccaagcgctgggtctgcagctccctcggttcccgcgcacccaactgccccacgacccctacccgcgcccgcagcccccgccctcccgccccacttgcctgggccgccgggcgctggaacctggaccctggaccctggcgggttccgagctgcgc

SEQ ID NO: 12319 - DNA, 248 bp, Homo sapiens
  misc_feature 1..248: note = chr15:90358102-90358350
  misc_feature 1..248: note = hyper
  source 1..248: mol_type = genomic DNA
cgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctg

SEQ ID NO: 12320 - DNA, 120 bp, Homo sapiens
  misc_feature 1..120: note = chr15:91427788-91427908
  misc_feature 1..120: note = hyper
  source 1..120: mol_type = genomic DNA
ggggcctggaggagcggtgggagctgggggcgcggcaggcaggggcagagcaggcgttccgagggccagagacccacccaggtgggggtaggggccgcggaagggcggggatggccgcag

SEQ ID NO: 12321 - DNA, 42 bp, Homo sapiens
  misc_feature 1..42: note = chr15:92936971-92937013
  misc_feature 1..42: note = hyper
  source 1..42: mol_type = genomic DNA
gttggtgggaggaggcgagcagaggcgcggagcaaagctgtc

SEQ ID NO: 12322 - DNA, 30 bp, Homo sapiens
  misc_feature 1..30: note = chr15:92937326-92937356
  misc_feature 1..30: note = hyper
  source 1..30: mol_type = genomic DNA
cgcgctcacgctgctcgtggtcttcctcat

SEQ ID NO: 12323 - DNA, 35 bp, Homo sapiens; identical to SEQ ID NO: 4298
  misc_feature 1..35: note = chr15:92937700-92937735
  misc_feature 1..35: note = hyper
  source 1..35: mol_type = genomic DNA

SEQ ID NO: 12324 - DNA, 293 bp, Homo sapiens; identical to SEQ ID NO: 4299
  misc_feature 1..293: note = chr15:92937736-92938029
  misc_feature 1..293: note = hyper
  source 1..293: mol_type = genomic DNA

SEQ ID NO: 12325 - DNA, 84 bp, Homo sapiens
  misc_feature 1..84: note = chr15:93198720-93198804
  misc_feature 1..84: note = hyper
  source 1..84: mol_type = genomic DNA
accgggtggtgttcccgggccccgggccgggcggtggccgcgactcgcgctcgggttcgggccacggcgcggagacggactcgg

SEQ ID NO: 12326 - DNA, 95 bp, Homo sapiens
  misc_feature 1..95: note = chr15:93616156-93616251
  misc_feature 1..95: note = hyper
  source 1..95: mol_type = genomic DNA
tgcagagaaggaaggcgagggtcggccagaatcccagggctgaacgtcctgcccctctccccatacccatccatccagctcggcctgttaccact

SEQ ID NO: 12327 - DNA, 108 bp, Homo sapiens
  misc_feature 1..108: note = chr15:93616545-93616653
  misc_feature 1..108: note = hyper
  source 1..108: mol_type = genomic DNA
gggacccaggctgcccggccgcagcgctcgccgtgaggacctcggaaaaccacggccctagatcagagggcgcgccacgctccccgaccctcgcgccatctccagccc

SEQ ID NO: 12328 - DNA, 382 bp, Homo sapiens
  misc_feature 1..382: note = chr15:93631632-93632014
  misc_feature 1..382: note = hyper
  source 1..382: mol_type = genomic DNA
cgtacgccggcgcgccgaggcaaagggccgccgggacgcgagcccacgcggtgcactgcgccgacatccccgagggcaggagatggccaggcagctccgcagccgggcgtcgagcgggaggcgggggcccgggcggcgcgggccaatgggggttcacggcgggacagtcgggtggccggctccgtccggggctccgcgagccgggctgagggaaggagctcccagcccgcacacggtgtaagggacgtgtgccgggtctgcccaaccacgcgcgctggcggctgcccgggggagagtattttaggaaaaaagaacaaacaccaaaccacaaaaactttcctgctgccaacagctaaagcgatagaggcgcagcaaagctcca

SEQ ID NO: 12329 - DNA, 439 bp, Homo sapiens; identical to SEQ ID NO: 4300
  misc_feature 1..439: note = chr15:93632291-93632730
  misc_feature 1..439: note = hyper
  source 1..439: mol_type = genomic DNA

SEQ ID NO: 12330 - DNA, 87 bp, Homo sapiens; identical to SEQ ID NO: 4301
  misc_feature 1..87: note = chr15:93632731-93632818
  misc_feature 1..87: note = hyper
  source 1..87: mol_type = genomic DNA

SEQ ID NO: 12331 - DNA, 221 bp, Homo sapiens; identical to SEQ ID NO: 4302
  misc_feature 1..221: note = chr15:93633045-93633266
  misc_feature 1..221: note = hyper
  source 1..221: mol_type = genomic DNA

SEQ ID NO: 12332 - DNA, 14 bp, Homo sapiens
  misc_feature 1..14: note = chr15:95388665-95388679
  misc_feature 1..14: note = hyper
  source 1..14: mol_type = genomic DNA
ggagaagaatatct

SEQ ID NO: 12333 - DNA, 30 bp, Homo sapiens
  misc_feature 1..30: note = chr15:96865078-96865108
  misc_feature 1..30: note = hyper
  source 1..30: mol_type = genomic DNA
ccgccacccggcggccgcccctgacaccga

SEQ ID NO: 12334 - DNA, 133 bp, Homo sapiens
  misc_feature 1..133: note = chr15:96897877-96898010
  misc_feature 1..133: note = hyper
  source 1..133: mol_type = genomic DNA
gttccgccacgggtccgacggggcaccctgggtccccgcagcccgtcacaggcgtttgcacatttgtgtgcacgaccactggcgggggcgttgagcctctgctagccgcctcgggctccgcacacccttgggt

SEQ ID NO: 12335 - DNA, 250 bp, Homo sapiens
  misc_feature 1..250: note = chr15:96911442-96911692
  misc_feature 1..250: note = hyper
  source 1..250: mol_type = genomic DNA
gaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccggagctaggagcc

SEQ ID NO: 12336 - skipped

SEQ ID NO: 12337 - DNA, 36 bp, Homo sapiens
  misc_feature 1..36: note = chr15:96953131-96953167
  misc_feature 1..36: note = hyper
  source 1..36: mol_type = genomic DNA
cgcgcggcccggagccgaccccgcctcctcttccga

SEQ ID NO: 12338 - DNA, 231 bp, Homo sapiens
  misc_feature 1..231: note = chr15:96959730-96959961
  misc_feature 1..231: note = hyper
  source 1..231: mol_type = genomic DNA
gcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccc

SEQ ID NO: 12339 - DNA, 163 bp, Homo sapiens
  misc_feature 1..163: note = chr15:98836021-98836184
  misc_feature 1..163: note = hyper
  source 1..163: mol_type = genomic DNA
taattaggtaaactacgccaagagaggctcagaaacctgcccaaaatgagctggagcatcagcaggggttccaaatggcaggcgtcctctcccctctgtcccacaaagaacagtccgtcccctgggctgggagctgggcccggagccccggggcagcccgccc

SEQ ID NO: 12340 - DNA, 30 bp, Homo sapiens
  misc_feature 1..30: note = chr15:98965287-98965317
  misc_feature 1..30: note = hyper
  source 1..30: mol_type = genomic DNA
ccggtgcgccgccgccgatggggtcttagg

SEQ ID NO: 12341 - DNA, 30 bp, Homo sapiens
  misc_feature 1..30: note = chr15:98971901-98971931
  misc_feature 1..30: note = hyper
  source 1..30: mol_type = genomic DNA
ctcactgctgcaacccgggtctcagtcttc

SEQ ID NO: 12342 - DNA, 437 bp, Homo sapiens
  misc_feature 1..437: note = chr15:100881407-100881844
  misc_feature 1..437: note = hyper
  source 1..437: mol_type = genomic DNA
gctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccgg

SEQ ID NO: 12343 - DNA, 149 bp, Homo sapiens; identical to SEQ ID NO: 4303
  misc_feature 1..149: note = chr15:100913447-100913596
  misc_feature 1..149: note = hyper
  source 1..149: mol_type = genomic DNA

SEQ ID NO: 12344 - DNA, 45 bp, Homo sapiens
  misc_feature 1..45: note = chr15:101420521-101420566
  misc_feature 1..45: note = hyper
  source 1..45: mol_type = genomic DNA
tcgcgagtggaggtgcgcgccgcgttgactcggagcgcgctggtt

SEQ ID NO: 12345 - DNA, 70 bp, Homo sapiens
  misc_feature 1..70: note = chr16:215301-215371
  misc_feature 1..70: note = hyper
  source 1..70: mol_type = genomic DNA
gctgagtgatgggtccgggggcttcgcaggaactcggtcgtccccactgtcgtcgcggcctggggttcac

SEQ ID NO: 12346 - DNA, 214 bp, Homo sapiens; identical to SEQ ID NO: 4304
  misc_feature 1..214: note = chr16:215659-215873
  misc_feature 1..214: note = hyper
  source 1..214: mol_type = genomic DNA

SEQ ID NO: 12347 - DNA, 48 bp, Homo sapiens; identical to SEQ ID NO: 4305
  misc_feature 1..48: note = chr16:215912-215960
  misc_feature 1..48: note = hyper
  source 1..48: mol_type = genomic DNA

SEQ ID NO: 12348 - DNA, 263 bp, Homo sapiens; identical to SEQ ID NO: 4306
  misc_feature 1..263: note = chr16:215961-216224
  misc_feature 1..263: note = hyper
  source 1..263: mol_type = genomic DNA

SEQ ID NO: 12349 - DNA, 393 bp, Homo sapiens
  misc_feature 1..393: note = chr16:216583-216976
  misc_feature 1..393: note = hyper
  source 1..393: mol_type = genomic DNA
aatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttg

SEQ ID NO: 12350 - DNA, 38 bp, Homo sapiens
  misc_feature 1..38: note = chr16:223349-223387
  misc_feature 1..38: note = hyper
  source 1..38: mol_type = genomic DNA
atctgggtcgaggggcgagatggcgccttcctctcagg

SEQ ID NO: 12351 - DNA, 15 bp, Homo sapiens
  misc_feature 1..15: note = chr16:230301-230316
  misc_feature 1..15: note = hyper
  source 1..15: mol_type = genomic DNA
cgattcagagggccc

SEQ ID NO: 12352 - DNA, 30 bp, Homo sapiens
  misc_feature 1..30: note = chr16:230859-230889
  misc_feature 1..30: note = hyper
  source 1..30: mol_type = genomic DNA
cagcttccaggtgagcggctgccgtgctgg

SEQ ID NO: 12353 - DNA, 270 bp, Homo sapiens
  misc_feature 1..270: note = chr16:610046-610316
  misc_feature 1..270: note = hyper
  source 1..270: mol_type = genomic DNA
acccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcc

SEQ ID NO: 12354 - DNA, 151 bp, Homo sapiens
  misc_feature 1..151: note = chr16:610343-610494
  misc_feature 1..151: note = hyper
  source 1..151: mol_type = genomic DNA
cgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctc

SEQ ID NO: 12355 - DNA, 30 bp, Homo sapiens
  misc_feature 1..30: note = chr16:681006-681036
  misc_feature 1..30: note = hyper
  source 1..30: mol_type = genomic DNA
ctggagaggaaccagcgtcacacagacggc

SEQ ID NO: 12356 - DNA, 253 bp, Homo sapiens
  misc_feature 1..253: note = chr16:725597-725850
  misc_feature 1..253: note = hyper
  source 1..253: mol_type = genomic DNA
cgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctgg

SEQ ID NO: 12357 - DNA, 343 bp, Homo sapiens
  misc_feature 1..343: note = chr16:750505-750848
  misc_feature 1..343: note = hyper
  source 1..343: mol_type = genomic DNA
tttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccac

SEQ ID NO: 12358 - DNA, 177 bp, Homo sapiens
  misc_feature 1..177: note = chr16:1030521-1030698
  misc_feature 1..177: note = hyper
  source 1..177: mol_type = genomic DNA
gggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcg

SEQ ID NO: 12359 - DNA, 284 bp, Homo sapiens
  misc_feature 1..284: note = chr16:1031782-1032066
  misc_feature 1..284: note = hyper
  source 1..284: mol_type = genomic DNA
cggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcg

SEQ ID NO: 12360 - DNA, 276 bp, Homo sapiens
  misc_feature 1..276: note = chr16:1203265-1203541
  misc_feature 1..276: note = hyper
  source 1..276: mol_type = genomic DNA
gggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgagacgcggcgaggacgcgcgcccgggaccctcttcaacttgcgcgaagcgggccggggagcccctcgg

SEQ ID NO: 12361 - DNA, 50 bp, Homo sapiens
  misc_feature 1..50: note = chr16:1203913-1203963
  misc_feature 1..50: note = hyper
  source 1..50: mol_type = genomic DNA
cgcggagctgggtgccgacgaggagcagcgcgtcccgtacccggccttgg

SEQ ID NO: 12362 - DNA, 109 bp, Homo sapiens
  misc_feature 1..109: note = chr16:1204002-1204111
  misc_feature 1..109: note = hyper
  source 1..109: mol_type = genomic DNA
cgcgcagctggtgcctccggctggtctgcaacccatatccttcccggccggcggggggcggggggcggggggcgtggggagggtgggggcccggggcgcgggactccct

SEQ ID NO: 12363 - DNA, 103 bp, Homo sapiens
  misc_feature 1..103: note = chr16:1204128-1204231
  misc_feature 1..103: note = hyper
  source 1..103: mol_type = genomic DNA
cgcccctgttggtgggacctggcgtgggccgggcgcgcgggggtgcagggcaggggctggaggaccgcgctctaatttctgagagtggcgggcttggggggcc

SEQ ID NO: 12364 - DNA, 248 bp, Homo sapiens
  misc_feature 1..248: note = chr16:1382374-1382622
  misc_feature 1..248: note = hyper
  source 1..248: mol_type = genomic DNA
tgcccaggtgcccttcgggtgaaaactccaaagtctgaccaccccccaccccttgtccccaaagggctgcgagtgtccagctgtattcgaccaagggcaggtgcgaccggggggccgctgcgccctcggcaagtctgagagcctcaggcccccgacaggaccatgcttagcacggacttctcaaagtgtggtccctggactggcggcagcagactggagctgggaagtgcaggcgctggctggcgtgg

SEQ ID NO: 12365 - DNA, 65 bp, Homo sapiens
  misc_feature 1..65: note = chr16:1382901-1382966
  misc_feature 1..65: note = hyper
  source 1..65: mol_type = genomic DNA
aaaaaagggaaaaaacgcagatcgcgcccccacccagacttcgggaccagcgggttggggacagg

SEQ ID NO: 12366 - DNA, 30 bp, Homo sapiens
  misc_feature 1..30: note = chr16:1384604-1384634
  misc_feature 1..30: note = hyper
  source 1..30: mol_type = genomic DNA
ggagcccaaggccaccggcagcgcttgtta

SEQ ID NO: 12367 - DNA, 114 bp, Homo sapiens; identical to SEQ ID NO: 1244
  misc_feature 1..114: note = chr16:2040847-2040961
  misc_feature 1..114: note = hyper
  source 1..114: mol_type = genomic DNA

SEQ ID NO: 12368 - skipped

SEQ ID NO: 12369 - DNA, 531 bp, Homo sapiens; identical to SEQ ID NO: 1246
  misc_feature 1..531: note = chr16:2040982-2041513
  misc_feature 1..531: note = hyper
  source 1..531: mol_type = genomic DNA

SEQ ID NO: 12370 - DNA, 619 bp, Homo sapiens; identical to SEQ ID NO: 1247
  misc_feature 1..619: note = chr16:2041581-2042200
  misc_feature 1..619: note = hyper
  source 1..619: mol_type = genomic DNA

SEQ ID NO: 12371 - DNA, 30 bp, Homo sapiens
  misc_feature 1..30: note = chr16:2070078-2070108
  misc_feature 1..30: note = hyper
  source 1..30: mol_type = genomic DNA
ctatctgtggcgccgcgcgctgcgcgcggc

SEQ ID NO: 12372 - DNA, 76 bp, Homo sapiens
  misc_feature 1..76: note = chr16:2892527-2892603
  misc_feature 1..76: note = hyper
  source 1..76: mol_type = genomic DNA
gctccccactgttgtcgcctctcagccccacgcccactcatccacaggcagccgggatgctcacgcagccacgtca

SEQ ID NO: 12373 - DNA, 15 bp, Homo sapiens
  misc_feature 1..15: note = chr16:2892626-2892641
  misc_feature 1..15: note = hyper
  source 1..15: mol_type = genomic DNA
cgactctgccaacag

SEQ ID NO: 12374 - DNA, 37 bp, Homo sapiens
  misc_feature 1..37: note = chr16:3016812-3016849
  misc_feature 1..37: note = hyper
  source 1..37: mol_type = genomic DNA
gaccaggggcctgggcgggcctcgaggtggggcctgg

SEQ ID NO: 12375 - DNA, 275 bp, Homo sapiens; identical to SEQ ID NO: 4311
  misc_feature 1..275: note = chr16:3017156-3017431
  misc_feature 1..275: note = hyper
  source 1..275: mol_type = genomic DNA

SEQ ID NO: 12376 - DNA, 183 bp, Homo sapiens
  misc_feature 1..183: note = chr16:3068171-3068354
  misc_feature 1..183: note = hyper
  source 1..183: mol_type = genomic DNA
tcctaggccgagtgtcgggacaggggcggaggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggca

SEQ ID NO: 12377 - DNA, 30 bp, Homo sapiens
  misc_feature 1..30: note = chr16:3096912-3096942
  misc_feature 1..30: note = hyper
  source 1..30: mol_type = genomic DNA
cgcaccatgcggctgcggctccggcttctg

SEQ ID NO: 12378 - DNA, 40 bp, Homo sapiens; identical to SEQ ID NO: 4312
  misc_feature 1..40: note = chr16:3220590-3220630
  misc_feature 1..40: note = hyper
  source 1..40: mol_type = genomic DNA

SEQ ID NO: 12379 - DNA, 560 bp, Homo sapiens; identical to SEQ ID NO: 1248
  misc_feature 1..560: note = chr16:3221141-3221701
  misc_feature 1..560: note = hyper
  source 1..560: mol_type = genomic DNA

SEQ ID NO: 12380 - DNA, 267 bp, Homo sapiens; identical to SEQ ID NO: 1249
  misc_feature 1..267: note = chr16:3221786-3222053
  misc_feature 1..267: note = hyper
  source 1..267: mol_type = genomic DNA

SEQ ID NO: 12381 - DNA, 15 bp, Homo sapiens
  misc_feature 1..15: note = chr16:3222113-3222128
  misc_feature 1..15: note = hyper
  source 1..15: mol_type = genomic DNA
cgagccctagaagtg

SEQ ID NO: 12382 - DNA, 30 bp, Homo sapiens
  misc_feature 1..30: note = chr16:3224981-3225011
  misc_feature 1..30: note = hyper
  source 1..30: mol_type = genomic DNA
ggtcctagaaaggaacgggaaaccgtcacc

SEQ ID NO: 12383 - DNA, 39 bp, Homo sapiens
  misc_feature 1..39: note = chr16:3225568-3225607
  misc_feature 1..39: note = hyper
  source 1..39: mol_type = genomic DNA
caggcctgagggcaacgcttactgcggagcaactgtgtt

SEQ ID NO: 12384 - DNA, 376 bp, Homo sapiens; identical to SEQ ID NO: 1251
  misc_feature 1..376: note = chr16:3232641-3233017
  misc_feature 1..376: note = hyper
  source 1..376: mol_type = genomic DNA

SEQ ID NO: 12385 - DNA, 133 bp, Homo sapiens; identical to SEQ ID NO: 1252
  misc_feature 1..133: note = chr16:3233198-3233331
  misc_feature 1..133: note = hyper
  source 1..133: mol_type = genomic DNA

SEQ ID NO: 12386 - DNA, 670 bp, Homo sapiens; identical to SEQ ID NO: 1253
  misc_feature 1..670: note = chr16:3233434-3234104
  misc_feature 1..670: note = hyper
  source 1..670: mol_type = genomic DNA

SEQ ID NO: 12387 - DNA, 196 bp, Homo sapiens; identical to SEQ ID NO: 1254
  misc_feature 1..196: note = chr16:3234164-3234360
  misc_feature 1..196: note = hyper
  source 1..196: mol_type = genomic DNA

SEQ ID NO: 12388 - DNA, 164 bp, Homo sapiens; identical to SEQ ID NO: 1255
  misc_feature 1..164: note = chr16:3237900-3238064
  misc_feature 1..164: note = hyper
  source 1..164: mol_type = genomic DNA

SEQ ID NO: 12389 - DNA, 1500 bp, Homo sapiens; identical to SEQ ID NO: 1256
  misc_feature 1..1500: note = chr16:3238124-3239624
  misc_feature 1..1500: note = hyper
  source 1..1500: mol_type = genomic DNA

SEQ ID NO: 12390 - DNA, 164 bp, Homo sapiens; identical to SEQ ID NO: 1257
  misc_feature 1..164: note = chr16:3239684-3239848
  misc_feature 1..164: note = hyper
  source 1..164: mol_type = genomic DNA

SEQ ID NO: 12391 - DNA, 107 bp, Homo sapiens
  misc_feature 1..107: note = chr16:3241556-3241663
  misc_feature 1..107: note = hyper
  source 1..107: mol_type = genomic DNA
gagccccacgttgggcgacttgttttcttccttgctaccttggagttctggaaacagccagcatttaatgaacactaccaggtgccacatcgcgctctgtgatggta

SEQ ID NO: 12392 - DNA, 25 bp, Homo sapiens
  misc_feature 1..25: note = chr16:3355209-3355234
  misc_feature 1..25: note = hyper
  source 1..25: mol_type = genomic DNA
acccggcgaggctcccgggaccaaa

SEQ ID NO: 12393 - DNA, 468 bp, Homo sapiens
  misc_feature 1..468: note = chr16:3355250-3355718
  misc_feature 1..468: note = hyper
  source 1..468: mol_type = genomic DNA
cgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagcc

SEQ ID NO: 12394 - DNA, 154 bp, Homo sapiens
  misc_feature 1..154: note = chr16:4363926-4364080
  misc_feature 1..154: note = hyper
  source 1..154: mol_type = genomic DNA
gcctgaggtcggatgcggtcggctgcagggcagggctccgggctgaagcgcagcgattcccgccgccgtgagggggcgctctgcgggcctcggcctcggcccttccggacgcccgcacaggtcgccggacccagagagtcggcccttaatagcc

SEQ ID NO: 12395 - DNA, 329 bp, Homo sapiens
  misc_feature 1..329: note = chr16:4377992-4378321
  misc_feature 1..329: note = hyper
  source 1..329: mol_type = genomic DNA
tctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggag

SEQ ID NO: 12396 - DNA, 201 bp, Homo sapiens
  misc_feature 1..201: note = chr16:4588308-4588509
  misc_feature 1..201: note = hyper
  source 1..201: mol_type = genomic DNA
cgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcacccccccca

SEQ ID NO: 12397 - DNA, 86 bp, Homo sapiens
  misc_feature 1..86: note = chr16:5037621-5037707
  misc_feature 1..86: note = hyper
  source 1..86: mol_type = genomic DNA
gcgagtcccgcagcccggacggggctgtgcacgtggtggagcggagctgccggctgcgcgtggacgccccgcggctgctgcggaag

SEQ ID NO: 12398 - DNA, 51 bp, Homo sapiens
  misc_feature 1..51: note = chr16:5037911-5037962
  misc_feature 1..51: note = hyper
  source 1..51: mol_type = genomic DNA
gtagcgggaactgggcggggttcgcggggccagggccggagctgggtggtg

SEQ ID NO: 12399 - DNA, 30 bp, Homo sapiens
  misc_feature 1..30: note = chr16:6070172-6070202
  misc_feature 1..30: note = hyper
  source 1..30: mol_type = genomic DNA
ctacccccaggaggccgagaccctgagccc

SEQ ID NO: 12400 - DNA, 30 bp, Homo sapiens
  misc_feature 1..30: note = chr16:6533480-6533510
  misc_feature 1..30: note = hyper
  source 1..30: mol_type = genomic DNA
gaggcactttgcagccgacaatgaaatctt

SEQ ID NO: 12401 - DNA, 30 bp, Homo sapiens
  misc_feature 1..30: note = chr16:10274399-10274429
  misc_feature 1..30: note = hyper
  source 1..30: mol_type = genomic DNA
aggctgctgggatcacggactccattccga

SEQ ID NO: 12402 - DNA, 212 bp, Homo sapiens
  misc_feature 1..212: note = chr16:10274813-10275025
  misc_feature 1..212: note = hyper
  source 1..212: mol_type = genomic DNA
ctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttc

SEQ ID NO: 12403 - DNA, 190 bp, Homo sapiens
  misc_feature 1..190: note = chr16:10275308-10275498
  misc_feature 1..190: note = hyper
  source 1..190: mol_type = genomic DNA
acacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggac

SEQ ID NO: 12404 - DNA, 104 bp, Homo sapiens
  misc_feature 1..104: note = chr16:10275801-10275905
  misc_feature 1..104: note = hyper
  source 1..104: mol_type = genomic DNA
agccaccgggtttagcgggttcccgcatgctgcggccccagcgcgctcccctggctgtcccgcgctgtccgcatcgcccccacggggggcggctatcccagccg

SEQ ID NO: 12405 - DNA, 202 bp, Homo sapiens; identical to SEQ ID NO: 4323
  misc_feature 1..202: note = chr16:10276597-10276799
  misc_feature 1..202: note = hyper
  source 1..202: mol_type = genomic DNA

SEQ ID NO: 12406 - DNA, 251 bp, Homo sapiens; identical to SEQ ID NO: 4324
  misc_feature 1..251: note = chr16:10276800-10277051
  misc_feature 1..251: note = hyper
  source 1..251: mol_type = genomic DNA

SEQ ID NO: 12407 - DNA, 328 bp, Homo sapiens; identical to SEQ ID NO: 4325
  misc_feature 1..328: note = chr16:10277071-10277399
  misc_feature 1..328: note = hyper
  source 1..328: mol_type = genomic DNA

SEQ ID NO: 12408 - DNA, 94 bp, Homo sapiens
  misc_feature 1..94: note = chr16:10480064-10480158
  misc_feature 1..94: note = hyper
  source 1..94: mol_type = genomic DNA
cggccccggaggcctcggagcgccgggcctaccggacgtttgcggcgaagctgccctgactgaaaagcgtccgcggggccgtctgacaggtccg

SEQ ID NO: 12409 - DNA, 287 bp, Homo sapiens; identical to SEQ ID NO: 4326
  misc_feature 1..287: note = chr16:12994459-12994746
  misc_feature 1..287: note = hyper
  source 1..287: mol_type = genomic DNA

SEQ ID NO: 12410 - DNA, 285 bp, Homo sapiens
  misc_feature 1..285: note = chr16:12994952-12995237
  misc_feature 1..285: note = hyper
  source 1..285: mol_type = genomic DNA
ctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgc

SEQ ID NO: 12411 - DNA, 139 bp, Homo sapiens
  misc_feature 1..139: note = chr16:12995478-12995617
  misc_feature 1..139: note = hyper
  source 1..139: mol_type = genomic DNA
cttcagcgcacttggcgagctggtgaggtgagagggatactgcgagagggctaggggcggccagtccggggctgccggccaaggctaggcgctgccagcccgattctcctctgctctccacccccgcctcacccagtgg

SEQ ID NO: 12412 - DNA, 591 bp, Homo sapiens
  misc_feature 1..591: note = chr16:12996242-12996833
  misc_feature 1..591: note = hyper
  source 1..591: mol_type = genomic DNA
tgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtcaccgggaagccaacttcggcttggaacacggagaaggggcgctgggctcagcacaggtgtgggtctgagcgtgttcgtgtgtgtgtgagcgtgtgtgtgtgtgtgtgtgactctgctccctcaccctctggccgcctcctcccgctggtgactgaggcggacttgagacacgtagcctgggagcccgtggccccgaaatcttcgggtttggggagag

SEQ ID NO: 12413 - DNA, 289 bp, Homo sapiens
  misc_feature 1..289: note = chr16:12997414-12997703
  misc_feature 1..289: note = hyper
  source 1..289: mol_type = genomic DNA
ccgtaactttggaggcggaggacgcagccactaggagcactaagcccccggccgcgggagaggctgggggttggcgtgaggtccgggcgggcggggtggaaggagtgactagcggcctgcgaacagctggatggttggggcataagctttaactgtcccctttcagagtctgggcaacgaagtcgctgtatttttctctaccctctccccaccccttcttccgcgccccctctgccgggggcctgtgtgtgtgcgcgcgtgtgtgcacgcgctccgtgtgatgcctaaa

SEQ ID NO: 12414 - DNA, 63 bp, Homo sapiens
  misc_feature 1..63: note = chr16:15950853-15950916
  misc_feature 1..63: note = hyper
  source 1..63: mol_type = genomic DNA
acgcacctcccaggccggagcgtccaaatctccctgcgcgtcctcggacgcctctctttatag

SEQ ID NO: 12415 - DNA, 338 bp, Homo sapiens
  misc_feature 1..338: note = chr16:19567111-19567449
  misc_feature 1..338: note = hyper
  source 1..338: mol_type = genomic DNA
tacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctg

SEQ ID NO: 12416 - DNA, 30 bp, Homo sapiens
  misc_feature 1..30: note = chr16:20085391-20085421
  misc_feature 1..30: note = hyper
  source 1..30: mol_type = genomic DNA
tagacctgggagccccgaaggaagaccgga

SEQ ID NO: 12417 - DNA, 299 bp, Homo sapiens
  misc_feature 1..299: note = chr16:21294997-21295296
  misc_feature 1..299: note = hyper
  source 1..299: mol_type = genomic DNA
gggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgct

SEQ ID NO: 12418 - DNA, 22 bp, Homo sapiens
  misc_feature 1..22: note = chr16:21295340-21295362
  misc_feature 1..22: note = hyper
  source 1..22: mol_type = genomic DNA
cgctggccgctgctccagacgc

SEQ ID NO: 12419 - DNA, 49 bp, Homo sapiens
  misc_feature 1..49: note = chr16:21675345-21675394
  misc_feature 1..49: note = hyper
  source 1..49: mol_type = genomic DNA
ataggaagtcccaggcggggactgtgacccccgccgctgccctggctga

SEQ ID NO: 12420 - DNA, 323 bp, Homo sapiens
  misc_feature 1..323: note = chr16:21831608-21831931
  misc_feature 1..323: note = hyper
  source 1..323: mol_type = genomic DNA
atcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagag

SEQ ID NO: 12421 - DNA, 83 bp, Homo sapiens
  misc_feature 1..83: note = chr16:22173801-22173884
  misc_feature 1..83: note = hyper
  source 1..83: mol_type = genomic DNA
gagaaggaggtggcccggtggccctggcggcgcggagactggcgcagcgcggggagcacgcagcgccgcgggagcccgggcca

SEQ ID NO: 12422 - DNA, 377 bp, Homo sapiens
  misc_feature 1..377: note = chr16:22203596-22203973
  misc_feature 1..377: note = hyper
  source 1..377: mol_type = genomic DNA
tccttttatagatgacgaaaactggggctttgtctcattccaaagagcagaggagggtgggggtttctgctctacagctgggggaatttggaggagcaccgcctaagccgccactggcctaaacacaacacgtggtaacttctactcttctacactctggccatgccaaggcttgcggttgaactctggtctcgttctctcagagccgcaaacctcggaccatttgaagctggcggtcctggggcttcctttcctctcgataacatgtttacatccaaactcacttccttcctctctttcttctccctgctaatcctgggaaatctgttcttcgagcaggaaaaacaatctcacactgctcacgttattttctagat

SEQ ID NO: 12423 - DNA, 476 bp, Homo sapiens
  misc_feature 1..476: note = chr16:22824601-22825077
  misc_feature 1..476: note = hyper
  source 1..476: mol_type = genomic DNA
tcctcactcagccctcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctaggg

SEQ ID NO: 12424 - DNA, 143 bp, Homo sapiens; identical to SEQ ID NO: 1258
  misc_feature 1..143: note = chr16:22825327-22825470
  misc_feature 1..143: note = hyper
  source 1..143: mol_type = genomic DNA

SEQ ID NO: 12425 - DNA, 88 bp, Homo sapiens; identical to SEQ ID NO: 4328
  misc_feature 1..88: note = chr16:22825937-22826025
  misc_feature 1..88: note = hyper
  source 1..88: mol_type = genomic DNA

SEQ ID NO: 12426 - DNA, 30 bp, Homo sapiens
  misc_feature 1..30: note = chr16:22826278-22826308
  misc_feature 1..30: note = hyper
  source 1..30: mol_type = genomic DNA
agccctcattgtgggcgtgaagaagggggg

SEQ ID NO: 12427 - DNA, 72 bp, Homo sapiens
  misc_feature 1..72: note = chr16:23313400-23313472
  misc_feature 1..72: note = hyper
  source 1..72: mol_type = genomic DNA
gtatcgctggtgtcccgaggtggggagggagaatgcggagcgcgtgcgtgcggggggcgtccagtgtccctg

SEQ ID NO: 12428 - DNA, 89 bp, Homo sapiens
  misc_feature 1..89: note = chr16:23706462-23706551
  misc_feature 1..89: note = hyper
  source 1..89: mol_type = genomic DNA
catcactctccagcccggaccttcccactcaccctccctgaaccgcaatgcaactcacctcctgcaaggaggcccggcagagctccagg

SEQ ID NO: 12429 - DNA, 30 bp, Homo sapiens
  misc_feature 1..30: note = chr16:23765970-23766000
  misc_feature 1..30: note = hyper
  source 1..30: mol_type = genomic DNA
gtcgacgccggggagcgccctggggttggg

SEQ ID NO: 12430 - DNA, 216 bp, Homo sapiens; identical to SEQ ID NO: 1259
  misc_feature 1..216: note = chr16:23846838-23847054
  misc_feature 1..216: note = hyper
  source 1..216: mol_type = genomic DNA

SEQ ID NO: 12431 - DNA, 15 bp, Homo sapiens
  misc_feature 1..15: note = chr16:23847310-23847325
  misc_feature 1..15: note = hyper
  source 1..15: mol_type = genomic DNA
cggcagcagctgggc

SEQ ID NO: 12432 - DNA, 186 bp, Homo sapiens; identical to SEQ ID NO: 1261
  misc_feature 1..186: note = chr16:23847326-23847512
  misc_feature 1..186: note = hyper
  source 1..186: mol_type = genomic DNA

SEQ ID NO: 12433 - DNA, 28 bp, Homo sapiens
  misc_feature 1..28: note = chr16:23847788-23847816
  misc_feature 1..28: note = hyper
  source 1..28: mol_type = genomic DNA
ggactcccggctccggaccctgctgccc

SEQ ID NO: 12434 - DNA, 58 bp, Homo sapiens; identical to SEQ ID NO: 1263
  misc_feature 1..58: note = chr16:23847817-23847875
  misc_feature 1..58: note = hyper
  source 1..58: mol_type = genomic DNA

SEQ ID NO: 12435 - DNA, 70 bp, Homo sapiens; identical to SEQ ID NO: 1264
  misc_feature 1..70: note = chr16:23847933-23848003
  misc_feature 1..70: note = hyper
  source 1..70: mol_type = genomic DNA

SEQ ID NO: 12436 - DNA, 68 bp, Homo sapiens; identical to SEQ ID NO: 1265
  misc_feature 1..68: note = chr16:23848004-23848072
  misc_feature 1..68: note = hyper
  source 1..68: mol_type = genomic DNA

SEQ ID NO: 12437 - DNA, 181 bp, Homo sapiens
  misc_feature 1..181: note = chr16:23848310-23848491
  misc_feature 1..181: note = hyper
  source 1..181: mol_type = genomic DNA
cccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctct

SEQ ID NO: 12438 - DNA, 120 bp, Homo sapiens; identical to SEQ ID NO: 4336
  misc_feature 1..120: note = chr16:24267025-24267145
  misc_feature 1..120: note = hyper
  source 1..120: mol_type = genomic DNA

SEQ ID NO: 12439 - DNA, 388 bp, Homo sapiens; identical to SEQ ID NO: 4337
  misc_feature 1..388: note = chr16:24267220-24267608
  misc_feature 1..388: note = hyper
  source 1..388: mol_type = genomic DNA

SEQ ID NO: 12440 - DNA, 37 bp, Homo sapiens
  misc_feature 1..37: note = chr16:24621912-24621949
  misc_feature 1..37: note = hyper
  source 1..37: mol_type = genomic DNA
ggctctggggagctgcggctctcgggccctgccaaac

SEQ ID NO: 12441 - DNA, 98 bp, Homo sapiens
  misc_feature 1..98: note = chr16:25702837-25702935
  misc_feature 1..98: note = hyper
  source 1..98: mol_type = genomic DNA
gttgggatgggaaagcggttgtagaaaaggattcactcctggaccgaaggcaggaggatatcccgggcgagagaagggagggtcggggatgggctgag

SEQ ID NO: 12442 - DNA, 971 bp, Homo sapiens; identical to SEQ ID NO: 4338
  misc_feature 1..971: note = chr16:25703152-25704123
  misc_feature 1..971: note = hyper
  source 1..971: mol_type = genomic DNA

SEQ ID NO: 12443 - DNA, 255 bp, Homo sapiens; identical to SEQ ID NO: 4339
  misc_feature 1..255: note = chr16:25704389-25704644
  misc_feature 1..255: note = hyper
  source 1..255: mol_type = genomic DNA

SEQ ID NO: 12444 - DNA, 70 bp, Homo sapiens
  misc_feature 1..70: note = chr16:28074185-28074255
  misc_feature 1..70: note = hyper
  source 1..70: mol_type = genomic DNA
gcggggcgtcccgcacgtccccccatgctggtccccggccccggaacggcgcgcgccccctgccccggaa

SEQ ID NO: 12445 - DNA, 481 bp, Homo sapiens
  misc_feature 1..481: note = chr16:28074417-28074898
  misc_feature 1..481: note = hyper
  source 1..481: mol_type = genomic DNA
cgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccc

SEQ ID NO: 12446 - skipped

SEQ ID NO: 12447 - DNA, 30 bp, Homo sapiens
  misc_feature 1..30: note = chr16:31498683-31498713
  misc_feature 1..30: note = hyper
  source 1..30: mol_type = genomic DNA
cgtcattctggggggcgcctgcatcctcat

SEQ ID NO: 12448 - DNA, 100 bp, Homo sapiens
  misc_feature 1..100: note = chr16:31540961-31541061
  misc_feature 1..100: note = hyper
  source 1..100: mol_type = genomic DNA
cgggggtgcgcggggcgggggcgcggctaggaggcgccgcacagcaatcagacgcggctcagggtgcgcgcggggagctggagggcgcagttctggacct

SEQ ID NO: 12449 - DNA, 259 bp, Homo sapiens; identical to SEQ ID NO: 4341
  misc_feature 1..259: note = chr16:31580480-31580739
  misc_feature 1..259: note = hyper
  source 1..259: mol_type = genomic DNA

SEQ ID NO: 12450 - DNA, 132 bp, Homo sapiens
  misc_feature 1..132: note = chr16:47177106-47177238
  misc_feature 1..132: note = hyper
  source 1..132: mol_type = genomic DNA
gcggcctccgctccacgacaggaatctcacaactttgcaaagggatgcgcggaattctacggaagcggcgcgagggcgcagcccggagggccctgctgggcccaggggcctcctggccgccttcccgacccg

SEQ ID NO: 12451 - DNA, 340 bp, Homo sapiens; identical to SEQ ID NO: 4342
  misc_feature 1..340: note = chr16:49309108-49309448
  misc_feature 1..340: note = hyper
  source 1..340: mol_type = genomic DNA

SEQ ID NO: 12452 - DNA, 523 bp, Homo sapiens; identical to SEQ ID NO: 4343
  misc_feature 1..523: note = chr16:49311467-49311990
  misc_feature 1..523: note = hyper
  source 1..523: mol_type = genomic DNA

SEQ ID NO: 12453 - DNA, 199 bp, Homo sapiens; identical to SEQ ID NO: 4344
  misc_feature 1..199: note = chr16:49312032-49312231
  misc_feature 1..199: note = hyper
  source 1..199: mol_type = genomic DNA

SEQ ID NO: 12454 - DNA, 347 bp, Homo sapiens; identical to SEQ ID NO: 4345
  misc_feature 1..347: note = chr16:49313363-49313710
  misc_feature 1..347: note = hyper
  source 1..347: mol_type = genomic DNA

SEQ ID NO: 12455 - DNA, 625 bp, Homo sapiens; identical to SEQ ID NO: 4346
  misc_feature 1..625: note = chr16:49313936-49314561
  misc_feature 1..625: note = hyper
  source 1..625: mol_type = genomic DNA

SEQ ID NO: 12456 - DNA, 38 bp, Homo sapiens
  misc_feature 1..38: note = chr16:49314784-49314822
  misc_feature 1..38: note = hyper
  source 1..38: mol_type = genomic DNA
ccagtaacccccctacggggccagggcccggcacgagg

SEQ ID NO: 12457 - DNA, 552 bp, Homo sapiens; identical to SEQ ID NO: 1266
  misc_feature 1..552: note = chr16:49315764-49316316
  misc_feature 1..552: note = hyper
  source 1..552: mol_type = genomic DNA

SEQ ID NO: 12458 - DNA, 35 bp, Homo sapiens
  misc_feature 1..35: note = chr16:49317700-49317735
  misc_feature 1..35: note = hyper
  source 1..35: mol_type = genomic DNA
gactggcagctctggcggcgcgctggaggggaccg

SEQ ID NO: 12459 - DNA, 45 bp, Homo sapiens
  misc_feature 1..45: note = chr16:51183963-51184008
  misc_feature 1..45: note = hyper
  source 1..45: mol_type = genomic DNA
cgctaggcctgggagctttgaggccggtaccgtgaaacaccttta

SEQ ID NO: 12460 - DNA, 100 bp, Homo sapiens; identical to SEQ ID NO: 4348
  misc_feature 1..100: note = chr16:51184324-51184424
  misc_feature 1..100: note = hyper
  source 1..100: mol_type = genomic DNA

SEQ ID NO: 12461 - DNA, 188 bp, Homo sapiens; identical to SEQ ID NO: 4349
  misc_feature 1..188: note = chr16:51184770-51184958
  misc_feature 1..188: note = hyper
  source 1..188: mol_type = genomic DNA

SEQ ID NO: 12462 - DNA, 238 bp, Homo sapiens; identical to SEQ ID NO: 4350
  misc_feature 1..238: note = chr16:51185054-51185292
  misc_feature 1..238: note = hyper
  source 1..238: mol_type = genomic DNA

SEQ ID NO: 12463 - DNA, 423 bp, Homo sapiens; identical to SEQ ID NO: 4351
  misc_feature 1..423: note = chr16:51185542-51185965
  misc_feature 1..423: note = hyper
  source 1..423: mol_type = genomic DNA

SEQ ID NO: 12464 - DNA, 200 bp, Homo sapiens; identical to SEQ ID NO: 4352
  misc_feature 1..200: note = chr16:51186025-51186225
  misc_feature 1..200: note = hyper
  source 1..200: mol_type = genomic DNA

SEQ ID NO: 12465 - DNA, 100 bp, Homo sapiens
  misc_feature 1..100: note = chr16:51186595-51186695
  misc_feature 1..100: note = hyper
  source 1..100: mol_type = genomic DNA
gggacgaggtggcggcgcagagccggaaagcggggtggggggagggcggtggggaggtgttctgtccgaggctgcctggcggcgccgaagctcgcctcca

SEQ ID NO: 12466 - DNA, 219 bp, Homo sapiens
  misc_feature 1..219: note = chr16:51186895-51187114
  misc_feature 1..219: note = hyper
  source 1..219: mol_type = genomic DNA
tcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccg

SEQ ID NO: 12467 - DNA, 30 bp, Homo sapiens
  misc_feature 1..30: note = chr16:51189298-51189328
  misc_feature 1..30: note = hyper
  source 1..30: mol_type = genomic DNA
ggggacgaggcacatcgatggtatcaacat

SEQ ID NO: 12468 - DNA, 72 bp, Homo sapiens
  misc_feature 1..72: note = chr16:51190143-51190215
  misc_feature 1..72: note = hyper
  source 1..72: mol_type = genomic DNA
ccggtattaagaaaccgacttcgctagcgactgcaagtgcttgcgattttgactttccgtccacagttgagc

SEQ ID NO: 12469 - DNA, 60 bp, Homo sapiens
  misc_feature 1..60: note = chr16:54318670-54318730
  misc_feature 1..60: note = hyper
  source 1..60: mol_type = genomic DNA
cggtggagacccccccgcgccgggaggcgagcggcgcgggttgtccgggcttgtggcagt

SEQ ID NO: 12470 - DNA, 105 bp, Homo sapiens
  misc_feature 1..105: note = chr16:54319377-54319482
  misc_feature 1..105: note = hyper
  source 1..105: mol_type = genomic DNA
tgctctccctggtggcgttcttgggacgggacgggtccccgaactggtactggccatacgggtagaaggcggggtgcgggtgcggaaacgcggcagccgcggccg

SEQ ID NO: 12471 - DNA, 38 bp, Homo sapiens
  misc_feature 1..38: note = chr16:54321664-54321702
  misc_feature 1..38: note = hyper
  source 1..38: mol_type = genomic DNA
cttcacggattagggcgtgcagtcgatagcggcattga

SEQ ID NO: 12472 - DNA, 176 bp, Homo sapiens; identical to SEQ ID NO: 4353
  misc_feature 1..176: note = chr16:54628691-54628867
  misc_feature 1..176: note = hyper
  source 1..176: mol_type = genomic DNA

SEQ ID NO: 12473 - DNA, 30 bp, Homo sapiens
  misc_feature 1..30: note = chr16:54966792-54966822
  misc_feature 1..30: note = hyper
  source 1..30: mol_type = genomic DNA
cgaccccgagggccccgaagcaggttggtg

SEQ ID NO: 12474 - DNA, 66 bp, Homo sapiens; identical to SEQ ID NO: 4354
  misc_feature 1..66: note = chr16:54967141-54967207
  misc_feature 1..66: note = hyper
  source 1..66: mol_type = genomic DNA

SEQ ID NO: 12475 - DNA, 20 bp, Homo sapiens
  misc_feature 1..20: note = chr16:54971546-54971566
  misc_feature 1..20: note = hyper
  source 1..20: mol_type = genomic DNA
cttagctttgaactccggcc

SEQ ID NO: 12476 - DNA, 30 bp, Homo sapiens
  misc_feature 1..30: note = chr16:54972930-54972960
  misc_feature 1..30: note = hyper
  source 1..30: mol_type = genomic DNA
gggaaagtgagaaggcgtggtgttggcatt

SEQ ID NO: 12477 - DNA, 72 bp, Homo sapiens
  misc_feature 1..72: note = chr16:55090748-55090820
  misc_feature 1..72: note = hyper
  source 1..72: mol_type = genomic DNA
caaaaggcagatttccgcgccgggcacctgtttgcagggctgcgcctccttccgctgcggtgttttatctcg

SEQ ID NO: 12478 - DNA, 319 bp, Homo sapiens
  misc_feature 1..319: note = chr16:55357622-55357941
  misc_feature 1..319: note = hyper
  source 1..319: mol_type = genomic DNA
ggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgagg

SEQ ID NO: 12479 - DNA, 360 bp, Homo sapiens
  misc_feature 1..360: note = chr16:55357991-55358351
  misc_feature 1..360: note = hyper
  source 1..360: mol_type = genomic DNA
cgacgctgcccggagctgctccaacgagagccgggcctgtggcgtgaacaaactttacttcagcgcaggggcggaggaaccgggctggaggcttctcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgcaggggaggaggtgagcgcgctgcgcccggggcctg

SEQ ID NO: 12480 - DNA, 273 bp, Homo sapiens
  misc_feature 1..273: note = chr16:55358798-55359071
  misc_feature 1..273: note = hyper
  source 1..273: mol_type = genomic DNA
cggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccaggtaagaggcgcctctatggggga

SEQ ID NO: 12481 - DNA, 87 bp, Homo sapiens; identical to SEQ ID NO: 1267
  misc_feature 1..87: note = chr16:55363136-55363223
  misc_feature 1..87: note = hyper
  source 1..87: mol_type = genomic DNA

SEQ ID NO: 12482 - DNA, 487 bp, Homo sapiens
  misc_feature 1..487: note = chr16:55364732-55365219
  misc_feature 1..487: note = hyper
  source 1..487: mol_type = genomic DNA
ggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaaga

SEQ ID NO: 12483 - DNA, 202 bp, Homo sapiens
  misc_feature 1..202: note = chr16:55404998-55405200
  misc_feature 1..202: note = hyper
  source 1..202: mol_type = genomic DNA
tccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctc

SEQ ID NO: 12484 - DNA, 13 bp, Homo sapiens
  misc_feature 1..13: note = chr16:55405201-55405214
  misc_feature 1..13: note = hyper
  source 1..13: mol_type = genomic DNA
tttctaagcagca

SEQ ID NO: 12485 - DNA, 19 bp, Homo sapiens
  misc_feature 1..19: note = chr16:55512935-55512954
  misc_feature 1..19: note = hyper
  source 1..19: mol_type = genomic DNA
cggccggggaaaagaggtg

SEQ ID NO: 12486 - DNA, 138 bp, Homo sapiens
  misc_feature 1..138: note = chr16:55513226-55513364
  misc_feature 1..138: note = hyper
  source 1..138: mol_type = genomic DNA
ggccggaccatgagccgctgagccgggcaaaccccaggccaccgagccagcggaccctcggagcgcagccctgcgccgcggagcaggctccaaccaggcggcgaggcggccacacgcaccgagccagcgacccccggg

SEQ ID NO: 12487 - DNA, 40 bp, Homo sapiens
  misc_feature 1..40: note = chr16:55513482-55513522
  misc_feature 1..40: note = hyper
  source 1..40: mol_type = genomic DNA
cgtcgcccatcatcaagttccccggcgatgtcgcccccaa

SEQ ID NO: 12488 - DNA, 30 bp, Homo sapiens
  misc_feature 1..30: note = chr16:55514115-55514145
  misc_feature 1..30: note = hyper
  source 1..30: mol_type = genomic DNA
ccttcggcacagatccggagagggaccttt

SEQ ID NO: 12489 - DNA, 178 bp, Homo sapiens
  misc_feature 1..178: note = chr16:55690202-55690380
  misc_feature 1..178: note = hyper
  source 1..178: mol_type = genomic DNA
tggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccgg

SEQ ID NO: 12490 - DNA, 124 bp, Homo sapiens
  misc_feature 1..124: note = chr16:55690453-55690577
  misc_feature 1..124: note = hyper
  source 1..124: mol_type = genomic DNA
cgcgcgctcatcccagtgtctaaggcgctcccgggtggtcttgggagttgcaagtagggaggaacggccgggtaaccacctcttttccctttatccaagcagagcctcggcgtgcccccaggac

SEQ ID NO: 12491 - DNA, 225 bp, Homo sapiens; identical to SEQ ID NO: 4356
  misc_feature 1..225: note = chr16:56224557-56224782
  misc_feature 1..225: note = hyper
  source 1..225: mol_type = genomic DNA

SEQ ID NO: 12492 - DNA, 10 bp, Homo sapiens
  misc_feature 1..10: note = chr16:56224783-56224793
  misc_feature 1..10: note = hyper
  source 1..10: mol_type = genomic DNA
ggtttattcc

SEQ ID NO: 12493 - DNA, 39 bp, Homo sapiens; identical to SEQ ID NO: 4358
  misc_feature 1..39: note = chr16:56224794-56224833
  misc_feature 1..39: note = hyper
  source 1..39: mol_type = genomic DNA

SEQ ID NO: 12494 - DNA, 89 bp, Homo sapiens; identical to SEQ ID NO: 4359
  misc_feature 1..89: note = chr16:56224880-56224969
  misc_feature 1..89: note = hyper
  source 1..89: mol_type = genomic DNA

SEQ ID NO: 12495 - DNA, 30 bp, Homo sapiens
  misc_feature 1..30: note = chr16:56225583-56225613
  misc_feature 1..30: note = hyper
  source 1..30: mol_type = genomic DNA
ccgcggacgcaccgacggctgaagagcggc

SEQ ID NO: 12496 - DNA, 14 bp, Homo sapiens
  misc_feature 1..14: note = chr16:56228577-56228591
  misc_feature 1..14: note = hyper
  source 1..14: mol_type = genomic DNA
gggggaggggagtg

SEQ ID NO: 12497 - DNA, 116 bp, Homo sapiens
  misc_feature 1..116: note = chr16:56623236-56623352
  misc_feature 1..116: note = hyper
  source 1..116: mol_type = genomic DNA
gggcgcacgcgcgggcgtgggcgagcgggccccggcagtgcacacacacggcaggggcgggcgacagatgcagtgcgtgcgccggagcccaagcgcacaaacggaaagagcgggcg

SEQ ID NO: 12498 - DNA, 167 bp, Homo sapiens
  misc_feature 1..167: note = chr16:56623702-56623869
  misc_feature 1..167: note = hyper
  source 1..167: mol_type = genomic DNA
ggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccc

SEQ ID NO: 12499 - DNA, 84 bp, Homo sapiens
  misc_feature 1..84: note = chr16:56651238-56651322
  misc_feature 1..84: note = hyper
  source 1..84: mol_type = genomic DNA
cgggtgccaagcaagagacccgcggtgcacaccttgcgcccggccggcctgctgctcacagtccctccacgtacccacaggagg

SEQ ID NO: 12500 - DNA, 610 bp, Homo sapiens; identical to SEQ ID NO: 1268
  misc_feature 1..610: note = chr16:56659128-56659738
  misc_feature 1..610: note = hyper
  source 1..610: mol_type = genomic DNA

SEQ ID NO: 12501 - DNA, 44 bp, Homo sapiens
  misc_feature 1..44: note = chr16:56665985-56666029
  misc_feature 1..44: note = hyper
  source 1..44: mol_type = genomic DNA
ccgtgttgctgtgtacggaggagccagtccgagggaccgcggtg

SEQ ID NO: 12502 - DNA, 34 bp, Homo sapiens
  misc_feature 1..34: note = chr16:56666408-56666442
  misc_feature 1..34: note = hyper
  source 1..34: mol_type = genomic DNA
gctcaggggatggtgcgcccggcacttatgctgg

SEQ ID NO: 12503 - DNA, 30 bp, Homo sapiens; identical to SEQ ID NO: 1269
  misc_feature 1..30: note = chr16:56672513-56672543
  misc_feature 1..30: note = hyper
  source 1..30: mol_type = genomic DNA

SEQ ID NO: 12504 - DNA, 308 bp, Homo sapiens
  misc_feature 1..308: note = chr16:56677180-56677488
  misc_feature 1..308: note = hyper
  source 1..308: mol_type = genomic DNA
ggactcccacagagccgaagctcacgtcactggtgcggggtgcgggggtggggataccgcgaccacctgaggctgggttcccggaccgcccaagggcaggaatggagtgcaatctccgggaaattcgggagggccgggattatagcagggacgccgcgtaccgccaggagcacagcccctccaaagcgagcgtgagccaaagggccgcccccagggtgcgcaacagccacgttaaggaggatcctgcgcccggcccgcctggtgcgcacagccccgccctgaaccctgggcagcgctgacactgagct

SEQ ID NO: 12505 - DNA, 56 bp, Homo sapiens
  misc_feature 1..56: note = chr16:56709837-56709893
  misc_feature 1..56: note = hyper
  source 1..56: mol_type = genomic DNA
cgggccccaaaagggcggtccccgggagcccaccaggctgcactcaggggatggtg

SEQ ID NO: 12506 - DNA, 100 bp, Homo sapiens
  misc_feature 1..100: note = chr16:56709949-56710049
  misc_feature 1..100: note = hyper
  source 1..100: mol_type = genomic DNA
cgcgtgggggtgggtgagaagggtactctgcacccggccccctcttctaactataaattgagcttccggttcctagaatccaccacgcctcccacctgcc

SEQ ID NO: 12507 - DNA, 317 bp, Homo sapiens; identical to SEQ ID NO: 4362
  misc_feature 1..317: note = chr16:58018579-58018896
  misc_feature 1..317: note = hyper
  source 1..317: mol_type = genomic DNA

SEQ ID NO: 12508 - DNA, 271 bp, Homo sapiens; identical to SEQ ID NO: 4363
  misc_feature 1..271: note = chr16:58019164-58019435
  misc_feature 1..271: note = hyper
  source 1..271: mol_type = genomic DNA

SEQ ID NO: 12509 - DNA, 122 bp, Homo sapiens
  misc_feature 1..122: note = chr16:58497214-58497336
  misc_feature 1..122: note = hyper
  source 1..122: mol_type = genomic DNA
tctaaacaaagactacggcagcgccgtcccctcccccgggaacccgacgccgcgcggccacagggggcctggaggggcgggcagggcctcgcagcgcacccagcacagtccgcgcggcggag

SEQ ID NO: 12510 - DNA, 265 bp, Homo sapiens
  misc_feature 1..265: note = chr16:58497469-58497734
  misc_feature 1..265: note = hyper
  source 1..265: mol_type = genomic DNA
cgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccag

SEQ ID NO: 12511 - DNA, 591 bp, Homo sapiens
  misc_feature 1..591: note = chr16:58497994-58498585
  misc_feature 1..591: note = hyper
  source 1..591: mol_type = genomic DNA
tctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgc

SEQ ID NO: 12512 - DNA, 64 bp, Homo sapiens
  misc_feature 1..64: note = chr16:58498586-58498650
  misc_feature 1..64: note = hyper
  source 1..64: mol_type = genomic DNA
ggagcaccggtcagggggtggccccatggggtctctgaccagcggagctcggattaggaccctg

SEQ ID NO: 12513 - DNA, 138 bp, Homo sapiens
  misc_feature 1..138: note = chr16:62069136-62069274
  misc_feature 1..138: note = hyper
  source 1..138: mol_type = genomic DNA
cgcgaccagcccctcaaaggttcccggatgagaagcggccagaccacagaaagcgcaggtctgggctcagctgtccctaggagagcggctacggagtccccggcttaagggggcctccgtgcacgcaatctcgagttg

SEQ ID NO: 12514 - DNA, 35 bp, Homo sapiens
  misc_feature 1..35: note = chr16:62069336-62069371
  misc_feature 1..35: note = hyper
  source 1..35: mol_type = genomic DNA
cgcagggcgactccggagcccggcaagtttgtagc

SEQ ID NO: 12515 - DNA, 30 bp, Homo sapiens
  misc_feature 1..30: note = chr16:62070756-62070786
  misc_feature 1..30: note = hyper
  source 1..30: mol_type = genomic DNA
cccgcagctattttccgtaggaggaagagg

SEQ ID NO: 12516 - DNA, 172 bp, Homo sapiens
  misc_feature 1..172: note = chr16:65155754-65155926
  misc_feature 1..172: note = hyper
  source 1..172: mol_type = genomic DNA
agaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctc

SEQ ID NO: 12517 - DNA, 30 bp, Homo sapiens
  misc_feature 1..30: note = chr16:65156359-65156389
  misc_feature 1..30: note = hyper
  source 1..30: mol_type = genomic DNA
tccttcccccaaatccgctccagctggcca

SEQ ID NO: 12518 - DNA, 23 bp, Homo sapiens
  misc_feature 1..23: note = chr16:65156872-65156895
  misc_feature 1..23: note = hyper
  source 1..23: mol_type = genomic DNA
aagggcctaatggggcgcagcgc

SEQ ID NO: 12519 - DNA, 132 bp, Homo sapiens
  misc_feature 1..132: note = chr16:65157154-65157286
  misc_feature 1..132: note = hyper
  source 1..132: mol_type = genomic DNA
aggcaagagaggaggcggaggaaggtggagacgccagtgggtgaaggctaaaaaggaaccgcctagggggacggggatgaggctgggaaaggagaagagatggacccgcgaaaaagacggggaaggaggctg

SEQ ID NO: 12520 - DNA, 15 bp, Homo sapiens
  misc_feature 1..15: note = chr16:65157823-65157838
  misc_feature 1..15: note = hyper
  source 1..15: mol_type = genomic DNA
gtaaccccccaacct

SEQ ID NO: 12521 - DNA, 262 bp, Homo sapiens; identical to SEQ ID NO: 4364
  misc_feature 1..262: note = chr16:66461578-66461840
  misc_feature 1..262: note = hyper
  source 1..262: mol_type = genomic DNA

SEQ ID NO: 12522 - DNA, 185 bp, Homo sapiens
  misc_feature 1..185: note = chr16:66612882-66613067
  misc_feature 1..185: note = hyper
  source 1..185: mol_type = genomic DNA
cgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtga

SEQ ID NO: 12523 - DNA, 36 bp, Homo sapiens
  misc_feature 1..36: note = chr16:66638302-66638338
  misc_feature 1..36: note = hyper
  source 1..36: mol_type = genomic DNA
cccggatcccagacacgcgcacgggcaggaagttag

SEQ ID NO: 12524 - DNA, 32 bp, Homo sapiens
  misc_feature 1..32: note = chr16:66878288-66878320
  misc_feature 1..32: note = hyper
  source 1..32: mol_type = genomic DNA
tttaagaggctgctccgcggtagcgagcgggg

SEQ ID NO: 12525 - DNA, 106 bp, Homo sapiens
  misc_feature 1..106: note = chr16:66878819-66878925
  misc_feature 1..106: note = hyper
  source 1..106: mol_type = genomic DNA
tgcggggagcgcgcacggcaagtgagcggggacctcgggggagcggggctccgcgtggcaagggcgcagtgtcccccggagagaatttccccgcagaagtggccga

SEQ ID NO: 12526 - DNA, 605 bp, Homo sapiens
  misc_feature 1..605: note = chr16:67197667-67198272
  misc_feature 1..605: note = hyper
  source 1..605: mol_type = genomic DNA
ataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgc

SEQ ID NO: 12527 - DNA, 146 bp, Homo sapiens
  misc_feature 1..146: note = chr16:67198775-67198921
  misc_feature 1..146: note = hyper
  source 1..146: mol_type = genomic DNA
tcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcc

SEQ ID NO: 12528 - DNA, 51 bp, Homo sapiens
  misc_feature 1..51: note = chr16:67199411-67199462
  misc_feature 1..51: note = hyper
  source 1..51: mol_type = genomic DNA
gcgttcttggtagagcgggaccagtttcctcgtaagcgaccagagccgttt

SEQ ID NO: 12529 - DNA, 45 bp, Homo sapiens
  misc_feature 1..45: note = chr16:68118410-68118455
  misc_feature 1..45: note = hyper
  source 1..45: mol_type = genomic DNA
gccacccaatttaggcggctccatccctcccgctttcatggatat

SEQ ID NO: 12530 - DNA, 98 bp, Homo sapiens
  misc_feature 1..98: note = chr16:68118803-68118901
  misc_feature 1..98: note = hyper
  source 1..98: mol_type = genomic DNA
ggatgaggatgtgggcggcgtccaggtaactctgaggggccctgatgccttccctagagccagccatcaggagtaacacgatgcgcccccacatcacc

SEQ ID NO: 12531 - DNA, 69 bp, Homo sapiens
  misc_feature 1..69: note = chr16:68504068-68504137
  misc_feature 1..69: note = hyper
  source 1..69: mol_type = genomic DNA
gtaaaggaagcaacacggaacaaccacgtttttgttattcgaaatgcagctacacgtgtttacagtcct

SEQ ID NO: 12532 - DNA, 119 bp, Homo sapiens
  misc_feature 1..119: note = chr16:68544259-68544378
  misc_feature 1..119: note = hyper
  source 1..119: mol_type = genomic DNA
tacgggcctcagctgcgcagcgcagacggaggagggcgctggcggttaagaactcctacttgtcaaccggaaaaacatcccccataaaaaaacggtcaaagggccgggacagaagcatt

SEQ ID NO: 12533 - DNA, 245 bp, Homo sapiens; identical to SEQ ID NO: 4365
  misc_feature 1..245: note = chr16:68676360-68676605
  misc_feature 1..245: note = hyper
  source 1..245: mol_type = genomic DNA

SEQ ID NO: 12534 - DNA, 15 bp, Homo sapiens
  misc_feature 1..15: note = chr16:68676841-68676856
  misc_feature 1..15: note = hyper
  source 1..15: mol_type = genomic DNA
cgtggtccaccccca

SEQ ID NO: 12535 - DNA, 110 bp, Homo sapiens; identical to SEQ ID NO: 1270
  misc_feature 1..110: note = chr16:71459979-71460089
  misc_feature 1..110: note = hyper
  source 1..110: mol_type = genomic DNA

SEQ ID NO: 12536 - DNA, 81 bp, Homo sapiens; identical to SEQ ID NO: 1271
  misc_feature 1..81: note = chr16:71460270-71460351
  misc_feature 1..81: note = hyper
  source 1..81: mol_type = genomic DNA

SEQ ID NO: 12537 - DNA, 72 bp, Homo sapiens
  misc_feature 1..72: note = chr16:75528797-75528869
  misc_feature 1..72: note = hyper
  source 1..72: mol_type = genomic DNA
tgtggggacatcccccgcggagaatgaagaaccaacgtaccccaaagcttggcggctctgcccgagctgcag

SEQ ID NO: 12538 - DNA, 207 bp, Homo sapiens
  misc_feature 1..207: note = chr16:75528922-75529129
  misc_feature 1..207: note = hyper
  source 1..207: mol_type = genomic DNA
cgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacag

SEQ ID NO: 12539 - DNA, 208 bp, Homo sapiens
  misc_feature 1..208: note = chr16:77246657-77246865
  misc_feature 1..208: note = hyper
  source 1..208: mol_type = genomic DNA
ggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgag

SEQ ID NO: 12540 - DNA, 48 bp, Homo sapiens
  misc_feature 1..48: note = chr16:77469028-77469076
  misc_feature 1..48: note = hyper
  source 1..48: mol_type = genomic DNA
gggctcgtccgagcccccgggctggtgcaagggcgtgggattcccggc

SEQ ID NO: 12541 - DNA, 85 bp, Homo sapiens; identical to SEQ ID NO: 4369
  misc_feature 1..85: note = chr16:77822334-77822419
  misc_feature 1..85: note = hyper
  source 1..85: mol_type = genomic DNA

SEQ ID NO: 12542 - DNA, 688 bp, Homo sapiens; identical to SEQ ID NO: 4370
  misc_feature 1..688: note = chr16:77822420-77823108
  misc_feature 1..688: note = hyper
  source 1..688: mol_type = genomic DNA

SEQ ID NO: 12543 - DNA, 57 bp, Homo sapiens
  misc_feature 1..57: note = chr16:78079844-78079901
  misc_feature 1..57: note = hyper
  source 1..57: mol_type = genomic DNA
aggccgggcaatgggcgcggagacgaaggggccggacagcggcgaggcgctggctcc

SEQ ID NO: 12544 - DNA, 83 bp, Homo sapiens
  misc_feature 1..83: note = chr16:79632686-79632769
  misc_feature 1..83: note = hyper
  source 1..83: mol_type = genomic DNA
aaactcgggagaggacgggttgtcgctgctcgagccgttttctcggaagccgctgctcaccaacttctcgtatttctccttgt

SEQ ID NO: 12545 - DNA, 38 bp, Homo sapiens
  misc_feature 1..38: note = chr16:79633490-79633528
  misc_feature 1..38: note = hyper
  source 1..38: mol_type = genomic DNA
ggggttcagctgctgcgggtagccggtcatccagtagt

SEQ ID NO: 12546 - DNA, 153 bp, Homo sapiens
  misc_feature 1..153: note = chr16:80574886-80575039
  misc_feature 1..153: note = hyper
  source 1..153: mol_type = genomic DNA
tttgtctcctagcaacggcgggtagcgttgttgacatcccgggaggctgtgccgccggcctgagcccagagtttcgcggcctccgcgatggtaaatctggggtctccgtccacgccccgccgttccaagcacgccgaccgtcaaggaccttcg

SEQ ID NO: 12547 - DNA, 64 bp, Homo sapiens
  misc_feature 1..64: note = chr16:82660432-82660496
  misc_feature 1..64: note = hyper
  source 1..64: mol_type = genomic DNA
gcggggctcgctcctcgcgaggtgctcaccccgtatctgccatgcaaaacgagggagcgttagg

SEQ ID NO: 12548 - DNA, 136 bp, Homo sapiens
  misc_feature 1..136: note = chr16:82661468-82661604
  misc_feature 1..136: note = hyper
  source 1..136: mol_type = genomic DNA
cggccagatcccgggctgccgcctctgctgccttccctgagcgggagcggagcgcagagaaaagttcaagccttgcccacccgggctgcagctgcttgttaaccctcagagcgccacggcgcgagggaagggcacg

SEQ ID NO: 12549 - DNA, 49 bp, Homo sapiens
  misc_feature 1..49: note = chr16:84633325-84633374
  misc_feature 1..49: note = hyper
  source 1..49: mol_type = genomic DNA
actttacagagactccggagaggttatgcaaacacggctcaggaaggga

SEQ ID NO: 12550 - DNA, 30 bp, Homo sapiens
  misc_feature 1..30: note = chr16:85203552-85203582
  misc_feature 1..30: note = hyper
  source 1..30: mol_type = genomic DNA
ctacgcgctgggcagcgccaccggcgacga

SEQ ID NO: 12551 - DNA, 228 bp, Homo sapiens
  misc_feature 1..228: note = chr16:85932377-85932605
  misc_feature 1..228: note = hyper
  source 1..228: mol_type = genomic DNA
gcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccg

SEQ ID NO: 12552 - DNA, 127 bp, Homo sapiens
  misc_feature 1..127: note = chr16:85932828-85932955
  misc_feature 1..127: note = hyper
  source 1..127: mol_type = genomic DNA
ggtaggcacagtgggcgggtagggcgcccgtgtcccgcgcggtccggtcccgcggggtccccgacgccaggcggggcgtgggggtggaactacctaccgtaatgtccccgggcgcagctcagtggcc

SEQ ID NO: 12553 - DNA, 30 bp, Homo sapiens
  misc_feature 1..30: note = chr16:86320396-86320426
  misc_feature 1..30: note = hyper
  source 1..30: mol_type = genomic DNA
tccagggacccaagacggggatctgggagg

SEQ ID NO: 12554 - DNA, 152 bp, Homo sapiens; identical to SEQ ID NO: 4371
  misc_feature 1..152: note = chr16:86320901-86321053
  misc_feature 1..152: note = hyper
  source 1..152: mol_type = genomic DNA

SEQ ID NO: 12555 - DNA, 46 bp, Homo sapiens; identical to SEQ ID NO: 4372
  misc_feature 1..46: note = chr16:86530947-86530993
  misc_feature 1..46: note = hyper
  source 1..46: mol_type = genomic DNA

SEQ ID NO: 12556 - DNA, 273 bp, Homo sapiens; identical to SEQ ID NO: 4373
  misc_feature 1..273: note = chr16:86531016-86531289
  misc_feature 1..273: note = hyper
  source 1..273: mol_type = genomic DNA

SEQ ID NO: 12557 - DNA, 107 bp, Homo sapiens; identical to SEQ ID NO: 4374
  misc_feature 1..107: note = chr16:86531374-86531481
  misc_feature 1..107: note = hyper
  source 1..107: mol_type = genomic DNA

SEQ ID NO: 12558 - DNA, 93 bp, Homo sapiens; identical to SEQ ID NO: 4375
  misc_feature 1..93: note = chr16:86531527-86531620
  misc_feature 1..93: note = hyper
  source 1..93: mol_type = genomic DNA

SEQ ID NO: 12559 - DNA, 42 bp, Homo sapiens
  misc_feature 1..42: note = chr16:86539385-86539427
  misc_feature 1..42: note = hyper
  source 1..42: mol_type = genomic DNA
ggcggccccctgccccgcccgcgcggccggcctgggctccct

SEQ ID NO: 12560 - DNA, 15 bp, Homo sapiens
  misc_feature 1..15: note = chr16:86539463-86539478
  misc_feature 1..15: note = hyper
  source 1..15: mol_type = genomic DNA
cgctctcggcccggg

SEQ ID NO: 12561 - DNA, 50 bp, Homo sapiens
  misc_feature 1..50: note = chr16:86542388-86542438
  misc_feature 1..50: note = hyper
  source 1..50: mol_type = genomic DNA
cgtgcgagccccctgcgggctggcagccaggtgcgcgagggccgcccttg

SEQ ID NO: 12562 - DNA, 44 bp, Homo sapiens
  misc_feature 1..44: note = chr16:86544243-86544287
  misc_feature 1..44: note = hyper
  source 1..44: mol_type = genomic DNA
cgcggccatggaccccgcgtcgtccggcccgtccaaggccaaga

SEQ ID NO: 12563 - DNA, 56 bp, Homo sapiens; identical to SEQ ID NO: 1272
  misc_feature 1..56: note = chr16:86544502-86544558
  misc_feature 1..56: note = hyper
  source 1..56: mol_type = genomic DNA

SEQ ID NO: 12564 - DNA, 364 bp, Homo sapiens; identical to SEQ ID NO: 1273
  misc_feature 1..364: note = chr16:86599480-86599844
  misc_feature 1..364: note = hyper
  source 1..364: mol_type = genomic DNA

SEQ ID NO: 12565 - DNA, 336 bp, Homo sapiens
  misc_feature 1..336: note = chr16:86600322-86600658
  misc_feature 1..336: note = hyper
  source 1..336: mol_type = genomic DNA
cctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgg

SEQ ID NO: 12566 - DNA, 64 bp, Homo sapiens
  misc_feature 1..64: note = chr16:86600877-86600941
  misc_feature 1..64: note = hyper
  source 1..64: mol_type = genomic DNA
cccccctcgctcccccggccgcagtccgtgcgcgagggcgccggcgagccgtctcggaagcagc

SEQ ID NO: 12567 - DNA, 205 bp, Homo sapiens
  misc_feature 1..205: note = chr16:86602037-86602242
  misc_feature 1..205: note = hyper
  source 1..205: mol_type = genomic DNA
cgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaacca

SEQ ID NO: 12568 - DNA, 46 bp, Homo sapiens
  misc_feature 1..46: note = chr16:86602455-86602501
  misc_feature 1..46: note = hyper
  source 1..46: mol_type = genomic DNA
gggacctcccctccccggcccgctccggcttcgcttcccagccccg

SEQ ID NO: 12569 - DNA, 84 bp, Homo sapiens
  misc_feature 1..84: note = chr16:86775022-86775106
  misc_feature 1..84: note = hyper
  source 1..84: mol_type = genomic DNA
cctccctgcgggagccgctgctagagggaaaggcagcgttggatcggatgccggccccagcctgggagacgtgcttcctctgca

SEQ ID NO: 12570 - DNA, 63 bp, Homo sapiens
  misc_feature 1..63: note = chr16:87635070-87635133
  misc_feature 1..63: note = hyper
  source 1..63: mol_type = genomic DNA
cagtttctggctcaccgcgctgcggtcaccggcccacactcccaggagcgaggaccctgggca

SEQ ID NO: 12571 - DNA, 156 bp, Homo sapiens
  misc_feature 1..156: note = chr16:87636626-87636782
  misc_feature 1..156: note = hyper
  source 1..156: mol_type = genomic DNA
ggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgac

SEQ ID NO: 12572 - DNA, 492 bp, Homo sapiens
  misc_feature 1..492: note = chr16:87636783-87637275
  misc_feature 1..492: note = hyper
  source 1..492: mol_type = genomic DNA
acggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaa

SEQ ID NO: 12573 - DNA, 54 bp, Homo sapiens
  misc_feature 1..54: note = chr16:87637599-87637653
  misc_feature 1..54: note = hyper
  source 1..54: mol_type = genomic DNA
cgaatctgcccaagccgagagaaagggagtgatggggagcgctaggggcggggg

SEQ ID NO: 12574 - DNA, 42 bp, Homo sapiens
  misc_feature 1..42: note = chr16:88449331-88449373
  misc_feature 1..42: note = hyper
  source 1..42: mol_type = genomic DNA
gtctgtaacctaagccgccccagcctccggggggcagacccc

SEQ ID NO: 12575 - DNA, 215 bp, Homo sapiens
  misc_feature 1..215: note = chr16:88449705-88449920
  misc_feature 1..215: note = hyper
  source 1..215: mol_type = genomic DNA
ccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccgg

SEQ ID NO: 12576 - DNA, 65 bp, Homo sapiens
  misc_feature 1..65: note = chr16:88450363-88450428
  misc_feature 1..65: note = hyper
  source 1..65: mol_type = genomic DNA
ggctcgggggactcccgcggccacccagtccttgtccctgcaccctgggccgagggcagagggac

SEQ ID NO: 12577 - DNA, 222 bp, Homo sapiens
  misc_feature 1..222: note = chr16:89007509-89007731
  misc_feature 1..222: note = hyper
  source 1..222: mol_type = genomic DNA
tggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaa

SEQ ID NO: 12578 - DNA, 162 bp, Homo sapiens
  misc_feature 1..162: note = chr16:89267663-89267825
  misc_feature 1..162: note = hyper
  source 1..162: mol_type = genomic DNA
gcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcg

SEQ ID NO: 12579 - DNA, 30 bp, Homo sapiens
  misc_feature 1..30: note = chr16:89992943-89992973
  misc_feature 1..30: note = hyper
  source 1..30: mol_type = genomic DNA
cctggcctcgaacgccgggttctgctttgt

SEQ ID NO: 12580 - DNA, 57 bp, Homo sapiens
  misc_feature 1..57: note = chr17:1083604-1083661
  misc_feature 1..57: note = hyper
  source 1..57: mol_type = genomic DNA
cccgggatctccaagcgcggcttcgcgggcgggagcggcggccgggcccctccccag

SEQ ID NO: 12581 - DNA, 29 bp, Homo sapiens
  misc_feature 1..29: note = chr17:1174333-1174362
  misc_feature 1..29: note = hyper
  source 1..29: mol_type = genomic DNA
cctcgcgcgcccagacgccgcccgcccct

SEQ ID NO: 12582 - DNA, 45 bp, Homo sapiens
  misc_feature 1..45: note = chr17:1928077-1928122
  misc_feature 1..45: note = hyper
  source 1..45: mol_type = genomic DNA
cggcgcccgggctcgcggctctttccggagcgcattcaacttcaa

SEQ ID NO: 12583 - DNA, 71 bp, Homo sapiens
  misc_feature 1..71: note = chr17:1959436-1959507
  misc_feature 1..71: note = hyper
  source 1..71: mol_type = genomic DNA
gggccccgaccgagggttgacagcccccggccagggcggcgccagggcgggcaccgcgctcccctcctccg

SEQ ID NO: 12584 - DNA, 477 bp, Homo sapiens
  misc_feature 1..477: note = chr17:2627798-2628275
  misc_feature 1..477: note = hyper
  source 1..477: mol_type = genomic DNA
cgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctcc

SEQ ID NO: 12585 - DNA, 41 bp, Homo sapiens
  misc_feature 1..41: note = chr17:2652548-2652589
  misc_feature 1..41: note = hyper
  source 1..41: mol_type = genomic DNA
gccagcagcccgccgcgagtcctgtccgcctcccgcgcgct

SEQ ID NO: 12586 - DNA, 30 bp, Homo sapiens
  misc_feature 1..30: note = chr17:2659635-2659665
  misc_feature 1..30: note = hyper
  source 1..30: mol_type = genomic DNA
cgccctttccccctccgcagtcctggcccg

SEQ ID NO: 12587 - DNA, 118 bp, Homo sapiens
  misc_feature 1..118: note = chr17:2756282-2756400
  misc_feature 1..118: note = hyper
  source 1..118: mol_type = genomic DNA
tgggcgcggggagggcggagtggggggcgcccggcccgccaggaggaagcggggtcgccgtgaagttggttattgaacccatgtggagtcaaactcccagggccgggagagccagtgt

SEQ ID NO: 12588 - DNA, 36 bp, Homo sapiens
  misc_feature 1..36: note = chr17:3438902-3438938
  misc_feature 1..36: note = hyper
  source 1..36: mol_type = genomic DNA
agaaggcccccttggcgtgcgcgttgacgtcggcgc

SEQ ID NO: 12589 - DNA, 59 bp, Homo sapiens
  misc_feature 1..59: note = chr17:3867044-3867103
  misc_feature 1..59: note = hyper
  source 1..59: mol_type = genomic DNA
ggccagctgggaggccgagcctgagtctccggccgtccctcgcccgccggtgtctgcgc

SEQ ID NO: 12590 - DNA, 230 bp, Homo sapiens
  misc_feature 1..230: note = chr17:4544550-4544780
  misc_feature 1..230: note = hyper
  source 1..230: mol_type = genomic DNA
ttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgc

SEQ ID NO: 12591 - DNA, 41 bp, Homo sapiens
  misc_feature 1..41: note = chr17:4981508-4981549
  misc_feature 1..41: note = hyper
  source 1..41: mol_type = genomic DNA
ccgttctaggaaacccggaggactcaggtcgtcaatgattc

SEQ ID NO: 12592 - skipped

SEQ ID NO: 12593 - DNA, 95 bp, Homo sapiens; identical to SEQ ID NO: 4378
  misc_feature 1..95: note = chr17:5000401-5000496
  misc_feature 1..95: note = hyper
  source 1..95: mol_type = genomic DNA

SEQ ID NO: 12594 - DNA, 46 bp, Homo sapiens
  misc_feature 1..46: note = chr17:5001155-5001201
  misc_feature 1..46: note = hyper
  source 1..46: mol_type = genomic DNA
gctctggggcgtccgcggaggctcccgcgtgcgtgtgcggggtggg

SEQ ID NO: 12595 - DNA, 62 bp, Homo sapiens
  misc_feature 1..62: note = chr17:6616271-6616333
  misc_feature 1..62: note = hyper
  source 1..62: mol_type = genomic DNA
gatctgtgctcacttcgaggtttccgtgcttgcctggacggctcttgcgccctgggatctgt

SEQ ID NO: 12596 - DNA, 246 bp, Homo sapiens; identical to SEQ ID NO: 4379
  misc_feature 1..246: note = chr17:6616637-6616883
  misc_feature 1..246: note = hyper
  source 1..246: mol_type = genomic DNA

SEQ ID NO: 12597 - DNA, 174 bp, Homo sapiens; identical to SEQ ID NO: 4380
  misc_feature 1..174: note = chr17:6616884-6617058
  misc_feature 1..174: note = hyper
  source 1..174: mol_type = genomic DNA

SEQ ID NO: 12598 - DNA, 32 bp, Homo sapiens
  misc_feature 1..32: note = chr17:6679763-6679795
  misc_feature 1..32: note = hyper
  source 1..32: mol_type = genomic DNA
gccaactccccctcccgcggtgggtaggacat

SEQ ID NO: 12599 - DNA, 36 bp, Homo sapiens
  misc_feature 1..36: note = chr17:6926208-6926244
  misc_feature 1..36: note = hyper
  source 1..36: mol_type = genomic DNA
ttgtttctgaggtcccgccctcgagacggagacccc

SEQ ID NO: 12600 - DNA, 41 bp, Homo sapiens
  misc_feature 1..41: note = chr17:7554709-7554750
  misc_feature 1..41: note = hyper
  source 1..41: mol_type = genomic DNA
ggggtctcctttgcccgcgccgccttcgctccccgtgcttt

SEQ ID NO: 12601 - DNA, 30 bp, Homo sapiens
  misc_feature 1..30: note = chr17:8055644-8055674
  misc_feature 1..30: note = hyper
  source 1..30: mol_type = genomic DNA
agatgcctacctggtcgcaggagtgtcctc

SEQ ID NO: 12602 - DNA, 378 bp, Homo sapiens
  misc_feature 1..378: note = chr17:8230404-8230782
  misc_feature 1..378: note = hyper
  source 1..378: mol_type = genomic DNA
cccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttga

SEQ ID NO: 12603 - DNA, 48 bp, Homo sapiens; identical to SEQ ID NO: 1274
  misc_feature 1..48: note = chr17:8868620-8868668
  misc_feature 1..48: note = hyper
  source 1..48: mol_type = genomic DNA

SEQ ID NO: 12604 - DNA, 399 bp, Homo sapiens; identical to SEQ ID NO: 1275
  misc_feature 1..399: note = chr17:8868814-8869213
  misc_feature 1..399: note = hyper
  source 1..399: mol_type = genomic DNA

SEQ ID NO: 12605 - DNA, 171 bp, Homo sapiens; identical to SEQ ID NO: 1276
  misc_feature 1..171: note = chr17:8869214-8869385
  misc_feature 1..171: note = hyper
  source 1..171: mol_type = genomic DNA

SEQ ID NO: 12606 - DNA, 288 bp, Homo sapiens
  misc_feature 1..288: note = chr17:8906385-8906673
  misc_feature 1..288: note = hyper
  source 1..288: mol_type = genomic DNA
cgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcg

SEQ ID NO: 12607 - DNA, 181 bp, Homo sapiens
  misc_feature 1..181: note = chr17:8906907-8907088
  misc_feature 1..181: note = hyper
  source 1..181: mol_type = genomic DNA
cggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgg

SEQ ID NO: 12608 - DNA, 434 bp, Homo sapiens; identical to SEQ ID NO: 1277
  misc_feature 1..434: note = chr17:8907294-8907728
  misc_feature 1..434: note = hyper
  source 1..434: mol_type = genomic DNA

SEQ ID NO: 12609 - DNA, 22 bp, Homo sapiens
  misc_feature 1..22: note = chr17:8907776-8907798
  misc_feature 1..22: note = hyper
  source 1..22: mol_type = genomic DNA
cgggtgacggaggctttatcct

SEQ ID NO: 12610 - DNA, 63 bp, Homo sapiens
  misc_feature 1..63: note = chr17:8925622-8925685
  misc_feature 1..63: note = hyper
  source 1..63: mol_type = genomic DNA
cgcaggcgccttctgcggcaggcggacagatcctcggcgcggcagggccggggcaagctggac

SEQ ID NO: 12611 - DNA, 15 bp, Homo sapiens
  misc_feature 1..15: note = chr17:10101095-10101110
  misc_feature 1..15: note = hyper
  source 1..15: mol_type = genomic DNA
actccggggtggaga

SEQ ID NO: 12612 - DNA, 317 bp, Homo sapiens; identical to SEQ ID NO: 1280
  misc_feature 1..317: note = chr17:10101131-10101448
  misc_feature 1..317: note = hyper
  source 1..317: mol_type = genomic DNA

SEQ ID NO: 12613 - DNA, 319 bp, Homo sapiens
  misc_feature 1..319: note = chr17:10102318-10102637
  misc_feature 1..319: note = hyper
  source 1..319: mol_type = genomic DNA
cactcgcgcccccaccgccggggaccgcgggaatggaaacgcccctctgttctgtgcctgctttgtaggcctggcggcccgtggcgtgcgggcggcttcttcgaggtgtctgcgagggatcgtttgtggttgtcattgtagtggttgaacctggggttgaacttgtctcaccggaaactgaacaatgggtgaaagacaggtttgaagcctggcgcctgagcccagcagcctggtggcagcgtggcacgctggagggacggaatggagagaagacggggtcggagttgatagaattggaaacagtcgatggggataaatg

SEQ ID NO: 12614 - DNA, 245 bp, Homo sapiens
  misc_feature 1..245: note = chr17:10633034-10633279
  misc_feature 1..245: note = hyper
  source 1..245: mol_type = genomic DNA
cgctaggccagggggcggagctgggagccgggcgggtccccctcccaccgcggccgcctgacctgcaccaaggccgccagcgcgaagaaggcggccatgagtccgttgcaggcccgccacagcgctggcgccatggctcggagaacacggcgcggggcggtgagtcctgccacgtgcggggcggtgagtcctgccacgtacggtccgccttcctccttgcgcggagggaccgagacccccgcctc

SEQ ID NO: 12615 - DNA, 34 bp, Homo sapiens
  misc_feature 1..34: note = chr17:13503911-13503945
  misc_feature 1..34: note = hyper
  source 1..34: mol_type = genomic DNA
gcacgtcggggtgcacgcgcaggaactccagcag

SEQ ID NO: 12616 - DNA, 95 bp, Homo sapiens
  misc_feature 1..95: note = chr17:13504557-13504652
  misc_feature 1..95: note = hyper
  source 1..95: mol_type = genomic DNA
gtgcgcccctgtggccgtgcgaactgtcccgggaggcagcggccggggctccgcggggaaacggaatcccgggggccccgcgcaggatccctgcc

SEQ ID NO: 12617 - DNA, 91 bp, Homo sapiens
  misc_feature 1..91: note = chr17:13505001-13505092
  misc_feature 1..91: note = hyper
  source 1..91: mol_type = genomic DNA
cgcccgagttcaggttctctcagccaaggagcgaggtccccccgagtccctctgcccgagcgggagacaggaggcccgtgcagagccgtcc

SEQ ID NO: 12618 - DNA, 106 bp, Homo sapiens; identical to SEQ ID NO: 4388
  misc_feature 1..106: note = chr17:13505466-13505572
  misc_feature 1..106: note = hyper
  source 1..106: mol_type = genomic DNA

SEQ ID NO: 12619 - DNA, 173 bp, Homo sapiens
  misc_feature 1..173: note = chr17:14201008-14201181
  misc_feature 1..173: note = hyper
  source 1..173: mol_type = genomic DNA
ggggctctgggccaccggttcaggctgccccaggaaatgcctgctttgcggtgccgcagagggtatagaggagctcggccccagagggtggctgttggggaggcggagctggccgcaggctggagcagctgcggagcctcccatcccgagcctagaatcggagaaatttcagg

SEQ ID NO: 12620 - DNA, 149 bp, Homo sapiens
  misc_feature 1..149: note = chr17:14203122-14203271
  misc_feature 1..149: note = hyper
  source 1..149: mol_type = genomic DNA
gtaagaatttgatctcgagcttccgaactccaaacgcctgggcaagaattcagcaaagcgcagcaccgctcacccgcacttcccccagctagcggttgctgtttcttggaagacgcgtttatccgccccagtcccgggtgggtgggtca

SEQ ID NO: 12621 - DNA, 115 bp, Homo sapiens
  misc_feature 1..115: note = chr17:14204011-14204126
  misc_feature 1..115: note = hyper
  source 1..115: mol_type = genomic DNA
catctgggcaactaccgccaaggctggcttctagggaacgagtgcggaaatgcgtgcgggtgtgggagcgcaccactcagtagggtaggacctctcccagcgctaggtcactgca

SEQ ID NO: 12622 - DNA, 447 bp, Homo sapiens
  misc_feature 1..447: note = chr17:14205251-14205698
  misc_feature 1..447: note = hyper
  source 1..447: mol_type = genomic DNA
ggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaa

SEQ ID NO: 12623 - DNA, 30 bp, Homo sapiens
  misc_feature 1..30: note = chr17:14206313-14206343
  misc_feature 1..30: note = hyper
  source 1..30: mol_type = genomic DNA
aagggacagtggccccggggtcacaatcac

SEQ ID NO: 12624 - DNA, 30 bp, Homo sapiens
  misc_feature 1..30: note = chr17:15164652-15164682
  misc_feature 1..30: note = hyper
  source 1..30: mol_type = genomic DNA
acccaactctgccagcgtagaggaacggtc

SEQ ID NO: 12625 - DNA, 66 bp, Homo sapiens
  misc_feature 1..66: note = chr17:15166283-15166349
  misc_feature 1..66: note = hyper
  source 1..66: mol_type = genomic DNA
actaatagagggcagcgggcgcttgagcgctggaagaagtccctctcctctcgggtcctggagccc

SEQ ID NO: 12626 - DNA, 92 bp, Homo sapiens
  misc_feature 1..92: note = chr17:15166709-15166801
  misc_feature 1..92: note = hyper
  source 1..92: mol_type = genomic DNA
ttcatagcctcctaacgtggcccgcccagcgttacagggagagaggctagcccccttcagtctcggcttggcagaggcgcgcccaactgaga

SEQ ID NO: 12627 - DNA, 145 bp, Homo sapiens
  misc_feature 1..145: note = chr17:15244987-15245132
  misc_feature 1..145: note = hyper
  source 1..145: mol_type = genomic DNA
cggccgccccggccggctcgccggagctgactggccagttataggagaggcgggagctgtcaggccaggagggaaacccgtcgggcggcggttactatggacgcgctcacgcttagtaaccgaggctccccgccctccgggagac

SEQ ID NO: 12628 - DNA, 35 bp, Homo sapiens
  misc_feature 1..35: note = chr17:15820977-15821012
  misc_feature 1..35: note = hyper
  source 1..35: mol_type = genomic DNA
cccaggctgcggctccgcgccggtgacgggggctc

SEQ ID NO: 12629 - DNA, 213 bp, Homo sapiens
  misc_feature 1..213: note = chr17:16472191-16472404
  misc_feature 1..213: note = hyper
  source 1..213: mol_type = genomic DNA
gagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttcc

SEQ ID NO: 12630 - DNA, 204 bp, Homo sapiens
  misc_feature 1..204: note = chr17:16570699-16570903
  misc_feature 1..204: note = hyper
  source 1..204: mol_type = genomic DNA
aggggcttgaggggccgagcggataaggcggctgacgcggctgaagggactgaggggctgaggtggctcaggggctgacgcgggtgaggggctgaggggctgaaaggctgaagggcgggcagcgtgccgggtccctgcggctgggtccaccgcacgtcacgtggcagaatcccggggctgctttctctccggctgctcagccac

SEQ ID NO: 12631 - DNA, 74 bp, Homo sapiens
  misc_feature 1..74: note = chr17:17398902-17398976
  misc_feature 1..74: note = hyper
  source 1..74: mol_type = genomic DNA
ggcaagacttggtgtcgaggatctgctgcctgagccgctgcacctcctcgaaggagtcgcggttgtccagactg

SEQ ID NO: 12632 - DNA, 41 bp, Homo sapiens
  misc_feature 1..41: note = chr17:18538205-18538246
  misc_feature 1..41: note = hyper
  source 1..41: mol_type = genomic DNA
cccacgcctctgctcgctcacccgcccggctgccttagggg

SEQ ID NO: 12633 - DNA, 40 bp, Homo sapiens
  misc_feature 1..40: note = chr17:19437028-19437068
  misc_feature 1..40: note = hyper
  source 1..40: mol_type = genomic DNA
gaggtgcaaggggcgcgcccaaggtcgcaggctgcctggc

SEQ ID NO: 12634 - DNA, 51 bp, Homo sapiens
  misc_feature 1..51: note = chr17:19483136-19483187
  misc_feature 1..51: note = hyper
  source 1..51: mol_type = genomic DNA
cgggacggggaggggcggggctgggtgggatcgggtcgcccccctcacccc

SEQ ID NO: 12635 - DNA, 30 bp, Homo sapiens
  misc_feature 1..30: note = chr17:20755963-20755993
  misc_feature 1..30: note = hyper
  source 1..30: mol_type = genomic DNA
agacgcgtctcccttcgggcaaagtgactg

SEQ ID NO: 12636 - DNA, 34 bp, Homo sapiens
  misc_feature 1..34: note = chr17:26120627-26120661
  misc_feature 1..34: note = hyper
  source 1..34: mol_type = genomic DNA
gcagcagtcaggcttcggccggaggatcctgcag

SEQ ID NO: 12637 - DNA, 197 bp, Homo sapiens
  misc_feature 1..197: note = chr17:26554556-26554753
  misc_feature 1..197: note = hyper
  source 1..197: mol_type = genomic DNA
ggggctctccccctgcggccccgctccaccgggggcgtggctagatctgaccgcgcccttccaggccccgccctcaggtatgggaaactaggccgcccggtcgcgcgcctctccaaaacgttcttcccagactgcgaggaccgcctcggcaggtggcggtaaaagcgcccccatcaagtcacataacatcctgcctc

SEQ ID NO: 12638 - DNA, 178 bp, Homo sapiens
  misc_feature 1..178: note = chr17:26554791-26554969
  misc_feature 1..178: note = hyper
  source 1..178: mol_type = genomic DNA
cgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcg

SEQ ID NO: 12639 - DNA, 46 bp, Homo sapiens
  misc_feature 1..46: note = chr17:26578387-26578433
  misc_feature 1..46: note = hyper
  source 1..46: mol_type = genomic DNA
ctggagggggcagggcggacagagccgcgggcggtcacgtgacccc

SEQ ID NO: 12640 - DNA, 242 bp, Homo sapiens
  misc_feature 1..242: note = chr17:27332453-27332695
  misc_feature 1..242: note = hyper
  source 1..242: mol_type = genomic DNA
cgactcactgccttgcgccccccggcacgcgccccagcaccctgagatgcctagagtgtggcgaggtagcgcgcgggtgagcgcgtgtgtgcggggagtgggtggcgtgatgaattgcatcagagaaatcccattagatctggggagatgattaaagacgaggtctcggccgggcgcgaatggcgggagccgcggcagcttcccgcccgcgaagcccgcgccccgcccggcttggccggcgc

SEQ ID NO: 12641 - DNA, 311 bp, Homo sapiens
  misc_feature 1..311: note = chr17:27940590-27940901
  misc_feature 1..311: note = hyper
  source 1..311: mol_type = genomic DNA
cgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtc

SEQ ID NO: 12642 - DNA, 629 bp, Homo sapiens
  misc_feature 1..629: note = chr17:27949499-27950128
  misc_feature 1..629: note = hyper
  source 1..629: mol_type = genomic DNA
gctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggtt

SEQ ID NO: 12643 - DNA, 30 bp, Homo sapiens
  misc_feature 1..30: note = chr17:28562797-28562827
  misc_feature 1..30: note = hyper
  source 1..30: mol_type = genomic DNA
cttgaagaatttttgcgtcactttgaggcg

SEQ ID NO: 12644 - DNA, 91 bp, Homo sapiens
  misc_feature 1..91: note = chr17:28705348-28705439
  misc_feature 1..91: note = hyper
  source 1..91: mol_type = genomic DNA
taaaaatgaatgcaccgcctagtgaggtgcgagccttcctccccacgaggcgtcccgtgcaaccgcacgcggacagcggggctccagcgga

SEQ ID NO: 12645 - DNA, 289 bp, Homo sapiens; identical to SEQ ID NO: 4389
  misc_feature 1..289: note = chr17:29249650-29249939
  misc_feature 1..289: note = hyper
  source 1..289: mol_type = genomic DNA

SEQ ID NO: 12646 - DNA, 229 bp, Homo sapiens
  misc_feature 1..229: note = chr17:29718142-29718371
  misc_feature 1..229: note = hyper
  source 1..229: mol_type = genomic DNA
ctccagagatggcagcgaatcccggccctgcctcttgccagctgtgtggcctagagtgagtccgacctctctgggcctcagcttcctccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcc

SEQ ID NO: 12647 - DNA, 412 bp, Homo sapiens
  misc_feature 1..412: note = chr17:29718805-29719217
  misc_feature 1..412: note = hyper
  source 1..412: mol_type = genomic DNA
gcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttc

SEQ ID NO: 12648 - DNA, 64 bp, Homo sapiens
  misc_feature 1..64: note = chr17:30846542-30846606
  misc_feature 1..64: note = hyper
  source 1..64: mol_type = genomic DNA
caacgccggccccagcgcccgcggctgaaacgaagccgctgcccgagcccgagcgccagcgcac

SEQ ID NO: 12649 - DNA, 118 bp, Homo sapiens; identical to SEQ ID NO: 1281
  misc_feature 1..118: note = chr17:31618291-31618409
  misc_feature 1..118: note = hyper
  source 1..118: mol_type = genomic DNA

SEQ ID NO: 12650 - DNA, 344 bp, Homo sapiens; identical to SEQ ID NO: 1282
  misc_feature 1..344: note = chr17:31618410-31618754
  misc_feature 1..344: note = hyper
  source 1..344: mol_type = genomic DNA

SEQ ID NO: 12651 - DNA, 383 bp, Homo sapiens; identical to SEQ ID NO: 4392
  misc_feature 1..383: note = chr17:31618954-31619337
  misc_feature 1..383: note = hyper
  source 1..383: mol_type = genomic DNA

SEQ ID NO: 12652 - DNA, 464 bp, Homo sapiens
  misc_feature 1..464: note = chr17:31619687-31620151
  misc_feature 1..464: note = hyper
  source 1..464: mol_type = genomic DNA
gagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctc

SEQ ID NO: 12653 - DNA, 57 bp, Homo sapiens
  misc_feature 1..57: note = chr17:32906021-32906078
  misc_feature 1..57: note = hyper
  source 1..57: mol_type = genomic DNA
agctgggcacagcagcgaggctgattcccagccagtgcccagcgaactctgggggtg

SEQ ID NO: 12654 - DNA, 153 bp, Homo sapiens
  misc_feature 1..153: note = chr17:32907265-32907418
  misc_feature 1..153: note = hyper
  source 1..153: mol_type = genomic DNA
ctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggg

SEQ ID NO: 12655 - DNA, 85 bp, Homo sapiens; identical to SEQ ID NO: 4393
  misc_feature 1..85: note = chr17:32907620-32907705
  misc_feature 1..85: note = hyper
  source 1..85: mol_type = genomic DNA

SEQ ID NO: 12656 - DNA, 99 bp, Homo sapiens; identical to SEQ ID NO: 4394
  misc_feature 1..99: note = chr17:32907706-32907805
  misc_feature 1..99: note = hyper
  source 1..99: mol_type = genomic DNA

SEQ ID NO: 12657 - DNA, 274 bp, Homo sapiens; identical to SEQ ID NO: 4395
  misc_feature 1..274: note = chr17:32907873-32908147
  misc_feature 1..274: note = hyper
  source 1..274: mol_type = genomic DNA

SEQ ID NO: 12658 - DNA, 204 bp, Homo sapiens; identical to SEQ ID NO: 4396
  misc_feature 1..204: note = chr17:32908170-32908374
  misc_feature 1..204: note = hyper
  source 1..204: mol_type = genomic DNA

SEQ ID NO: 12659 - DNA, 349 bp, Homo sapiens; identical to SEQ ID NO: 4397
  misc_feature 1..349: note = chr17:32908582-32908931
  misc_feature 1..349: note = hyper
  source 1..349: mol_type = genomic DNA

SEQ ID NO: 12660 - DNA, 301 bp, Homo sapiens
  misc_feature 1..301: note = chr17:33700472-33700773
  misc_feature 1..301: note = hyper
  source 1..301: mol_type = genomic DNA
gtgctgctcccttctcgaacctggcactcgagttacagcccgacgcggattcggctgggctagaccctgaagcacgggtagaaacgcaactccggagtcccaggctgggggcaaggaccctctctgacctctcaagctccagcgcttccgaagcccccttagcgtttccctggaggcgcccaggtcgagtccttatatactagcgggttggcgccatcccacgcacatcccacgcaggagatgcaagagccaatgggcgggtctgctaagcccgcgaactctgccgcgttaaattgcctag

SEQ ID NO: 12661 - DNA, 402 bp, Homo sapiens
  misc_feature 1..402: note = chr17:33700974-33701376
  misc_feature 1..402: note = hyper
  source 1..402: mol_type = genomic DNA
ggcccaagcagctgtcggctcctgcgctcccaacggggtggccgtttccttcctcgcaccctcttctctcccggtgcctgcggtcccaccttccagatacccctcggagagtccagctgagctctcgccagagctttccccttccaacccgctcgacttgcccagatcccaagctgggcttctctctccatcgccccagaaagtgggtcttggagaccgaggcaagaatttgggcctccgcttctgttccagaccccggaccccttgccaaaatgcggcagatgtgcagattgggccgcgcttggttcctggctgggtttatggagcctgcggctgaggcaggctccgcagaccccgagccagagtgggatttaacggcggccggtgcgctgtgcttggtca

SEQ ID NO: 12662 - DNA, 44 bp, Homo sapiens
  misc_feature 1..44: note = chr17:33775400-33775444
  misc_feature 1..44: note = hyper
  source 1..44: mol_type = genomic DNA
ggaacacagatagcccgccaagccgccggcgacaccttccaacc

SEQ ID NO: 12663 - DNA, 347 bp, Homo sapiens
  misc_feature 1..347: note = chr17:35014262-35014609
  misc_feature 1..347: note = hyper
  source 1..347: mol_type = genomic DNA
gggcggaggacgcagcgggcggcctgcggaggcggcctggctcggggtgggggctcggccggagttcccgcggctgctcggcggcggccggctcgggagcaaccttgagcgcggtcgcggaggcagtgatttaggtgccggcaccggagcgtgaaggtaaatggccacatttcaccgtcgggaggtgagccggaggcgcccgccctggcccttcccccaaggccccgggccggtgggggcgggagttttgcttcccctctctgacccgctccgaggcccgcctgggagggcggcgcccccacggtgcaggacaggagggctgcgccgggctgcggggtgagcaagac

SEQ ID NO: 12664 - DNA, 341 bp, Homo sapiens
  misc_feature 1..341: note = chr17:35078546-35078887
  misc_feature 1..341: note = hyper
  source 1..341: mol_type = genomic DNA
acggaaataaacaggcggtttggtcttctctttcttccctggcagccttaattgctacttaagcgtgggccctgcacttaacatccggggggcaggcccggtgcgtggtgcacgccgggcgcgctgtgcacagtctccggaggccgccagtgcgaccccgccccacccgcgcacccccgcccggagggccccagcgcgcatgcgctcgccgcagggcggcctgcggggctgtggacgcgaggccagctcgtagggggctgggcggtcagcggggtcaagggacagccacgctgggacggaggacggggacaggggagcccctgcggcgccacttcttcctc

SEQ ID NO: 12665 - DNA, 98 bp, Homo sapiens
  misc_feature 1..98: note = chr17:35165593-35165691
  misc_feature 1..98: note = hyper
  source 1..98: mol_type = genomic DNA
cttcaattttatcagcggccggggagccgggcgggagataggaggccggccctgacacgaattagcccggagattgtccgatacgccttggccagggc

SEQ ID NO: 12666 - DNA, 30 bp, Homo sapiens
  misc_feature 1..30: note = chr17:35165897-35165927
  misc_feature 1..30: note = hyper
  source 1..30: mol_type = genomic DNA
ccgggtcacctgggccgatccaggcgggca

SEQ ID NO: 12667 - DNA, 358 bp, Homo sapiens
  misc_feature 1..358: note = chr17:35285437-35285795
  misc_feature 1..358: note = hyper
  source 1..358: mol_type = genomic DNA
cctcccttcatccatcgcggaaggagcagcgggggggctggccctctcagccccgagagcagagagcggcagaagctgttaattcttgaggctaatgttcacatctccaacttatctctccgaggggaagtgtccatttgaccacatgatcctccctcccctaccctcccccaaggggaaatcaaatcttgaagtgagaccggaagagctgctgcggaacgtgagcacgggagagctggtgggggtagaaggcggtgaggggccgaaaggctcctcaaacccagtttctttccatgctaaggctggggaaataacctcatggcaactacactttccgataacccgcctcattaatatt

SEQ ID NO: 12668 - DNA, 288 bp, Homo sapiens
  misc_feature 1..288: note = chr17:35290388-35290676
  misc_feature 1..288: note = hyper
  source 1..288: mol_type = genomic DNA
aaggcaatttgagtccggagagaactagacgggaaggagaggcgggagaccttggcgctcagatccgagcgaccttatccacgcagttccctgcgtggcattactgcggcctcaccgagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactct

SEQ ID NO: 12669 - DNA, 70 bp, Homo sapiens
  misc_feature 1..70: note = chr17:35291829-35291899
  misc_feature 1..70: note = hyper
  source 1..70: mol_type = genomic DNA
ggagcccagctgggacgggggcggaggcaagccacccgggactggggccactatagattccagaaagggg

SEQ ID NO: 12670 - DNA, 101 bp, Homo sapiens
  misc_feature 1..101: note = chr17:35291920-35292021
  misc_feature 1..101: note = hyper
  source 1..101: mol_type = genomic DNA
cggcgagaaccgggacagctgcggggaggggaggagtgtgaggacagcagggctggactggccccctccccgcaggcctcacgcagcgcagcaggctggga

SEQ ID NO: 12671 - DNA, 48 bp, Homo sapiens
  misc_feature 1..48: note = chr17:35292273-35292321
  misc_feature 1..48: note = hyper
  source 1..48: mol_type = genomic DNA
ctgactagtcccctacgctcctccggcccgcagcggggagcccacatg

SEQ ID NO: 12672 - DNA, 30 bp, Homo sapiens
  misc_feature 1..30: note = chr17:35292596-35292626
  misc_feature 1..30: note = hyper
  source 1..30: mol_type = genomic DNA
attccatctgcacagcgggattccctgcca

SEQ ID NO: 12673 - DNA, 475 bp, Homo sapiens; identical to SEQ ID NO: 4398
  misc_feature 1..475: note = chr17:35294006-35294481
  misc_feature 1..475: note = hyper
  source 1..475: mol_type = genomic DNA

SEQ ID NO: 12674 - skipped

SEQ ID NO: 12675 - DNA, 1133 bp, Homo sapiens; identical to SEQ ID NO: 4400
  misc_feature 1..1133: note = chr17:35294492-35295625
  misc_feature 1..1133: note = hyper
  source 1..1133: mol_type = genomic DNA

SEQ ID NO: 12676 - DNA, 30 bp, Homo sapiens
  misc_feature 1..30: note = chr17:35296016-35296046
  misc_feature 1..30: note = hyper
  source 1..30: mol_type = genomic DNA
cattctccaggccttcggggttgtttgccc

SEQ ID NO: 12677 - DNA, 85 bp, Homo sapiens
  misc_feature 1..85: note = chr17:35296253-35296338
  misc_feature 1..85: note = hyper
  source 1..85: mol_type = genomic DNA
ctgcactgtagcctgcgaagtgcccggagctttttcctgcttccctggctgccgaagttgtctggtggttcggcttcagccccag

SEQ ID NO: 12678 - DNA, 430 bp, Homo sapiens; identical to SEQ ID NO: 4401
  misc_feature 1..430: note = chr17:35296716-35297146
  misc_feature 1..430: note = hyper
  source 1..430: mol_type = genomic DNA

SEQ ID NO: 12679 - DNA, 90 bp, Homo sapiens; identical to SEQ ID NO: 4402
  misc_feature 1..90: note = chr17:35297147-35297237
  misc_feature 1..90: note = hyper
  source 1..90: mol_type = genomic DNA

SEQ ID NO: 12680 - DNA, 228 bp, Homo sapiens; identical to SEQ ID NO: 1283
  misc_feature 1..228: note = chr17:35297936-35298164
  misc_feature 1..228: note = hyper
  source 1..228: mol_type = genomic DNA

SEQ ID NO: 12681 - DNA, 259 bp, Homo sapiens; identical to SEQ ID NO: 1284
  misc_feature 1..259: note = chr17:35299185-35299444
  misc_feature 1..259: note = hyper
  source 1..259: mol_type = genomic DNA

SEQ ID NO: 12682 - DNA, 89 bp, Homo sapiens; identical to SEQ ID NO: 1285
  misc_feature 1..89: note = chr17:35299600-35299689
  misc_feature 1..89: note = hyper
  source 1..89: mol_type = genomic DNA

SEQ ID NO: 12683 - DNA, 56 bp, Homo sapiens; identical to SEQ ID NO: 1286
  misc_feature 1..56: note = chr17:35299910-35299966
  misc_feature 1..56: note = hyper
  source 1..56: mol_type = genomic DNA

SEQ ID NO: 12684 - DNA, 453 bp, Homo sapiens; identical to SEQ ID NO: 1287
  misc_feature 1..453: note = chr17:35300260-35300713
  misc_feature 1..453: note = hyper
  source 1..453: mol_type = genomic DNA

SEQ ID NO: 12685 - DNA, 30 bp, Homo sapiens; identical to SEQ ID NO: 1288
  misc_feature 1..30: note = chr17:35300812-35300842
  misc_feature 1..30: note = hyper
  source 1..30: mol_type = genomic DNA

SEQ ID NO: 12686 - DNA, 210 bp, Homo sapiens; identical to SEQ ID NO: 1289
  misc_feature 1..210: note = chr17:35303325-35303535
  misc_feature 1..210: note = hyper
  source 1..210: mol_type = genomic DNA

SEQ ID NO: 12687 - DNA, 75 bp, Homo sapiens
  misc_feature 1..75: note = chr17:36102404-36102479
  misc_feature 1..75: note = hyper
  source 1..75: mol_type = genomic DNA
tttctctttgcttttcgtcttaagggaacacggtgggcaaaagaagggagtgcgtgtgcccgaggcttgggagcc

SEQ ID NO: 12688 - DNA, 280 bp, Homo sapiens
  misc_feature 1..280: note = chr17:36102707-36102987
  misc_feature 1..280: note = hyper
  source 1..280: mol_type = genomic DNA
ctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtat

SEQ ID NO: 12689 - DNA, 63 bp, Homo sapiens
  misc_feature 1..63: note = chr17:36103226-36103289
  misc_feature 1..63: note = hyper
  source 1..63: mol_type = genomic DNA
ccccggcagccctggcgccccagccgctcctaggggccactctctcgacccctcttagcctcc

SEQ ID NO: 12690 - DNA, 36 bp, Homo sapiens
  misc_feature 1..36: note = chr17:36103290-36103326
  misc_feature 1..36: note = hyper
  source 1..36: mol_type = genomic DNA
cgactcacaccttccgcctcgcggaactctcttgca

SEQ ID NO: 12691 - DNA, 63 bp, Homo sapiens; identical to SEQ ID NO: 4410
  misc_feature 1..63: note = chr17:36103540-36103603
  misc_feature 1..63: note = hyper
  source 1..63: mol_type = genomic DNA

SEQ ID NO: 12692 - DNA, 334 bp, Homo sapiens; identical to SEQ ID NO: 4411
  misc_feature 1..334: note = chr17:36104217-36104551
  misc_feature 1..334: note = hyper
  source 1..334: mol_type = genomic DNA

SEQ ID NO: 12693 - DNA, 189 bp, Homo sapiens; identical to SEQ ID NO: 4412
  misc_feature 1..189: note = chr17:36104643-36104832
  misc_feature 1..189: note = hyper
  source 1..189: mol_type = genomic DNA

SEQ ID NO: 12694 - DNA, 213 bp, Homo sapiens; identical to SEQ ID NO: 4413
  misc_feature 1..213: note = chr17:36105137-36105350
  misc_feature 1..213: note = hyper
  source 1..213: mol_type = genomic DNA

SEQ ID NO: 12695 - DNA, 254 bp, Homo sapiens; identical to SEQ ID NO: 4414
  misc_feature 1..254: note = chr17:36105458-36105712
  misc_feature 1..254: note = hyper
  source 1..254: mol_type = genomic DNA

SEQ ID NO: 12696 - DNA, 327 bp, Homo sapiens; identical to SEQ ID NO: 4415
  misc_feature 1..327: note = chr17:37321298-37321625
  misc_feature 1..327: note = hyper
  source 1..327: mol_type = genomic DNA

SEQ ID NO: 12697 - DNA, 78 bp, Homo sapiens; identical to SEQ ID NO: 4416
  misc_feature 1..78: note = chr17:37321787-37321865
  misc_feature 1..78: note = hyper
  source 1..78: mol_type = genomic DNA

SEQ ID NO: 12698 - DNA, 462 bp, Homo sapiens; identical to SEQ ID NO: 4417
  misc_feature 1..462: note = chr17:37366090-37366552
  misc_feature 1..462: note = hyper
  source 1..462: mol_type = genomic DNA

SEQ ID NO: 12699 - DNA, 423 bp, Homo sapiens; identical to SEQ ID NO: 1290
  misc_feature 1..423: note = chr17:37381007-37381430
  misc_feature 1..423: note = hyper
  source 1..423: mol_type = genomic DNA

SEQ ID NO: 12700 - DNA, 157 bp, Homo sapiens; identical to SEQ ID NO: 1291
  misc_feature 1..157: note = chr17:37381570-37381727
  misc_feature 1..157: note = hyper
  source 1..157: mol_type = genomic DNA

SEQ ID NO: 12701 - DNA, 292 bp, Homo sapiens; identical to SEQ ID NO: 1292
  misc_feature 1..292: note = chr17:37381825-37382117
  misc_feature 1..292: note = hyper
  source 1..292: mol_type = genomic DNA

SEQ ID NO: 12702 - DNA, 59 bp, Homo sapiens
  misc_feature 1..59: note = chr17:37752878-37752937
  misc_feature 1..59: note = hyper
  source 1..59: mol_type = genomic DNA
tcctctcctcctccccgcactggccgcgtaggtggcctcgggtgcggaggtcccggcct

SEQ ID NO: 12703 - DNA, 144 bp, Homo sapiens
  misc_feature 1..144: note = chr17:37753194-37753338
  misc_feature 1..144: note = hyper
  source 1..144: mol_type = genomic DNA
gcggcgtggcagtggcggctcccagcgcggagggaaccattgggcgctgttcggacctcttcccttgtgtccttccttcccttctcccgcatccactcactcccatctctccactgtctatgtccttctcgacctctgccccac

SEQ ID NO: 12704 - DNA, 85 bp, Homo sapiens
  misc_feature 1..85: note = chr17:37760446-37760531
  misc_feature 1..85: note = hyper
  source 1..85: mol_type = genomic DNA
aggggacagaatggccgcggggaggaggagccggcgagctcacctccttctgccccccggacgccggcgccgggcctgcttgtgc

SEQ ID NO: 12705 - DNA, 30 bp, Homo sapiens
  misc_feature 1..30: note = chr17:37761235-37761265
  misc_feature 1..30: note = hyper
  source 1..30: mol_type = genomic DNA
tcaagaaagagggagcgcctggctcctttt

SEQ ID NO: 12706 - DNA, 1294 bp, Homo sapiens
  misc_feature 1..1294: note = chr17:37761486-37762780
  misc_feature 1..1294: note = hyper
  source 1..1294: mol_type = genomic DNA
tggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgcgccgccaccgcctgccgccgcatacagcgtctcgtaggcggcgcagtagccgtgggtccgcagggcgtgcgccgcgccgccgcccaggccgccggccgcctggcactgtgcgcccgccaggcgcgagcacgggtacgggtaggggtgcatggcgaacgggccgcccgagccgtggaagcggccggcaccgtcggcgccttgctccgtgaggaagttgcgagagttgagctgcagacagccggccaccagattggtggtgggctgcgacagacccttgcacagagtctgcacgtaggacactaggtctggccgcttgccggagcgcaggatctccgagagcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttc

SEQ ID NO: 12707 - DNA, 51 bp, Homo sapiens
  misc_feature 1..51: note = chr17:37856662-37856713
  misc_feature 1..51: note = hyper
  source 1..51: mol_type = genomic DNA
cgagctctcctatcccgaagttgtggacagtcgagacgctcagggcagccg

SEQ ID NO: 12708 - DNA, 42 bp, Homo sapiens
  misc_feature 1..42: note = chr17:38478791-38478833
  misc_feature 1..42: note = hyper
  source 1..42: mol_type = genomic DNA
ggagtggctttatcccggccctccccccggagcctctgtccc

SEQ ID NO: 12709 - DNA, 52 bp, Homo sapiens
  misc_feature 1..52: note = chr17:40332871-40332923
  misc_feature 1..52: note = hyper
  source 1..52: mol_type = genomic DNA
cctccgtcccactcacgcgttccgtcaaaacgggtggcgatggtgtccagga

SEQ ID NO: 12710 - DNA, 188 bp, Homo sapiens
  misc_feature 1..188: note = chr17:40464190-40464378
  misc_feature 1..188: note = hyper
  source 1..188: mol_type = genomic DNA
aaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtccc

SEQ ID NO: 12711 - DNA, 49 bp, Homo sapiens
  misc_feature 1..49: note = chr17:40912947-40912996
  misc_feature 1..49: note = hyper
  source 1..49: mol_type = genomic DNA
ctggagagtcctgggcgccacgcagccgagcccccgaaatagatcccgg

SEQ ID NO: 12712 - DNA, 49 bp, Homo sapiens
  misc_feature 1..49: note = chr17:40932774-40932823
  misc_feature 1..49: note = hyper
  source 1..49: mol_type = genomic DNA
tggccctgcggcccccgcctcctcttggcaccgcggggcagccccgcct

SEQ ID NO: 12713 - DNA, 59 bp, Homo sapiens
  misc_feature 1..59: note = chr17:40932843-40932902
  misc_feature 1..59: note = hyper
  source 1..59: mol_type = genomic DNA
cgcgccgcttctccgggaaggctgagccccggccgcgctcttctcgtctcagccgccgt

SEQ ID NO: 12714 - DNA, 30 bp, Homo sapiens
  misc_feature 1..30: note = chr17:41984002-41984032
  misc_feature 1..30: note = hyper
  source 1..30: mol_type = genomic DNA
gccagaggatggggtcgaaaggccaggcgg

SEQ ID NO: 12715 - DNA, 70 bp, Homo sapiens
  misc_feature 1..70: note = chr17:41984440-41984510
  misc_feature 1..70: note = hyper
  source 1..70: mol_type = genomic DNA
gcgcaacctctgtctcgctccccaacccccggaagcgctaacagcacggttcttacgtaatgccgggctt

SEQ ID NO: 12716 - DNA, 122 bp, Homo sapiens
  misc_feature 1..122: note = chr17:42030329-42030451
  misc_feature 1..122: note = hyper
  source 1..122: mol_type = genomic DNA
caggtctgggccctccgacctgcggaagcgaaggggaaggaattggatctggggaggcgagcctgggagacgtcgttaagtgatgttgccagggtagggccaggccgcgctctcggatgcag

SEQ ID NO: 12717 - DNA, 63 bp, Homo sapiens
  misc_feature 1..63: note = chr17:42030688-42030751
  misc_feature 1..63: note = hyper
  source 1..63: mol_type = genomic DNA
agtggcgcagggaggcgtagtagcggttcagctcctccggcgaggcgtcttcgcggggagcct

SEQ ID NO: 12718 - DNA, 65 bp, Homo sapiens
  misc_feature 1..65: note = chr17:42061257-42061322
  misc_feature 1..65: note = hyper
  source 1..65: mol_type = genomic DNA
ccgggctgagtgttccgaggcgagcggctgctgtttgcgcagctaagtggcgtctgtgtacccag

SEQ ID NO: 12719 - DNA, 35 bp, Homo sapiens
  misc_feature 1..35: note = chr17:42082522-42082557
  misc_feature 1..35: note = hyper
  source 1..35: mol_type = genomic DNA
aggcatggcaggatacgctgcgggctctgcgcagc

SEQ ID NO: 12720 - DNA, 130 bp, Homo sapiens
  misc_feature 1..130: note = chr17:42083143-42083273
  misc_feature 1..130: note = hyper
  source 1..130: mol_type = genomic DNA
tctgggaggccaaggcgcagctggccaagagctgcaaggtgctggtagacgcgcttcgacacaacgccgccgctgctgtgccattttttggcggcgggtctgtgctacgcgctgccgagccggctcccca

SEQ ID NO: 12721 - DNA, 79 bp, Homo sapiens
  misc_feature 1..79: note = chr17:42083525-42083604
  misc_feature 1..79: note = hyper
  source 1..79: mol_type = genomic DNA
cgtcgctggccaaggcgctgcggcccaccaaaatcatcttcctcaataacacaggcggcctgcgcgacagcagtcataa

SEQ ID NO: 12722 - DNA, 30 bp, Homo sapiens
  misc_feature 1..30: note = chr17:42393545-42393575
  misc_feature 1..30: note = hyper
  source 1..30: mol_type = genomic DNA
cccaatatttgtgcacgaatccctgtcacc

SEQ ID NO: 12723 - DNA, 196 bp, Homo sapiens; identical to SEQ ID NO: 4421
  misc_feature 1..196: note = chr17:42393910-42394106
  misc_feature 1..196: note = hyper
  source 1..196: mol_type = genomic DNA

SEQ ID NO: 12724 - DNA, 466 bp, Homo sapiens; identical to SEQ ID NO: 1293
  misc_feature 1..466: note = chr17:42635294-42635760
  misc_feature 1..466: note = hyper
  source 1..466: mol_type = genomic DNA

SEQ ID NO: 12725 - DNA, 343 bp, Homo sapiens; identical to SEQ ID NO: 4423
  misc_feature 1..343: note = chr17:42733556-42733899
  misc_feature 1..343: note = hyper
  source 1..343: mol_type = genomic DNA

SEQ ID NO: 12726 - DNA, 30 bp, Homo sapiens
  misc_feature 1..30: note = chr17:42906618-42906648
  misc_feature 1..30: note = hyper
  source 1..30: mol_type = genomic DNA
taaaccatacattcacgtacatcttttcaa

SEQ ID NO: 12727 - DNA, 123 bp, Homo sapiens
  misc_feature 1..123: note = chr17:42907014-42907137
  misc_feature 1..123: note = hyper
  source 1..123: mol_type = genomic DNA
ggggcggcccggctccgccctgcgcccctaaccgcccgggtagttgtcggcaccgccggggcgccgccgagtgcgcgccgcttctgtccgggctccccgaccgtcgcccgacacctccgcggc

SEQ ID NO: 12728 - DNA, 416 bp, Homo sapiens
  misc_feature 1..416: note = chr17:42907735-42908151
  misc_feature 1..416: note = hyper
  source 1..416: mol_type = genomic DNA
cgagtgggaggggggcgccccagaacgcgcgggaagcgacgcgagcgccaactttccgcggtcgagtcctcgccgctctctcggatagtccgggacgcggcggaggcgcggcgcgcgtgggagtcacccgcgtggagtctggaccccgggtgggcgcagacttcgctccggacagttcattcttccaagctgattttcgggcgagagtcccccgccagccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 12729 - DNA, 80 bp, Homo sapiens
  misc_feature 1..80: note = chr17:42988684-42988764
  misc_feature 1..80: note = hyper
  source 1..80: mol_type = genomic DNA
tactcctgcaagtggcgggccatctcgtccttgaggctctgcccctcttcctccagccgcgccagcgcctcctgataact

SEQ ID NO: 12730 - DNA, 228 bp, Homo sapiens
  misc_feature 1..228: note = chr17:43045038-43045266
  misc_feature 1..228: note = hyper
  source 1..228: mol_type = genomic DNA
cgtggtgtaggtggcagtgctgatggcgccgctgccccccgcgcccggcagccccggagggcccggcttgcctggctcacccttctcccccggcggccccacagggccgggaggacctgggtccccgggaggccccggagggccgggcttgccggtgcggcccggcttcccctgggggccctgcaccagcgtggaaggcgggggcgcgccgctctgctcgctcagggc

SEQ ID NO: 12731 - DNA, 133 bp, Homo sapiens
  misc_feature 1..133: note = chr17:43045371-43045504
  misc_feature 1..133: note = hyper
  source 1..133: mol_type = genomic DNA
cgagctcaccagcacggggatgagcaccaccagcaccagcagcatcaccacacccgcggcggccgctagcagcgtctttcggcccgcgcggagcctggggagcgccgggccgcccggccgcgccgtcggggca

SEQ ID NO: 12732 - DNA, 96 bp, Homo sapiens; identical to SEQ ID NO: 1294
  misc_feature 1..96: note = chr17:43047752-43047848
  misc_feature 1..96: note = hyper
  source 1..96: mol_type = genomic DNA

SEQ ID NO: 12733 - DNA, 222 bp, Homo sapiens
  misc_feature 1..222: note = chr17:43339111-43339333
  misc_feature 1..222: note = hyper
  source 1..222: mol_type = genomic DNA
ccctactccaaggcgcgcatgcgtgtccgtgagagcacatgggtgtgcaccgcgcaggggctgaggctgggagccgtagtcaggggcaccgggtgggctttggcggcgggtcgacctgcctttcaggtgccgggggtttgggagcaggggaacgggccctgggcggattcctgaccgcccccttcgcgcccctccccctctcactttcgctttccccgcctg

SEQ ID NO: 12734 - DNA, 258 bp, Homo sapiens; identical to SEQ ID NO: 4425
  misc_feature 1..258: note = chr17:43339641-43339899
  misc_feature 1..258: note = hyper
  source 1..258: mol_type = genomic DNA

SEQ ID NO: 12735 - DNA, 127 bp, Homo sapiens; identical to SEQ ID NO: 4426
  misc_feature 1..127: note = chr17:43974231-43974358
  misc_feature 1..127: note = hyper
  source 1..127: mol_type = genomic DNA

SEQ ID NO: 12736 - DNA, 56 bp, Homo sapiens
  misc_feature 1..56: note = chr17:44919159-44919215
  misc_feature 1..56: note = hyper
  source 1..56: mol_type = genomic DNA
gaccttgagcaaccacgtcctcctctgagctccgcgtttgccgtgtgcaaagtgaa

SEQ ID NO: 12737 - DNA, 35 bp, Homo sapiens
  misc_feature 1..35: note = chr17:44928630-44928665
  misc_feature 1..35: note = hyper
  source 1..35: mol_type = genomic DNA
aatctcctccgtccccgcctcgtaccctcctcccc

SEQ ID NO: 12738 - DNA, 30 bp, Homo sapiens
  misc_feature 1..30: note = chr17:44929262-44929292
  misc_feature 1..30: note = hyper
  source 1..30: mol_type = genomic DNA
cagcttccccggctccgaatccatcgccct

SEQ ID NO: 12739 - DNA, 100 bp, Homo sapiens
  misc_feature 1..100: note = chr17:44929573-44929673
  misc_feature 1..100: note = hyper
  source 1..100: mol_type = genomic DNA
ggctgttcccggtctcggggcagaggatcgtgcgcgtccagggagaatgggggaaacctcggacggtgagagcgccagctggagacgcaggaaggaaccg

SEQ ID NO: 12740 - DNA, 34 bp, Homo sapiens
  misc_feature 1..34: note = chr17:45055871-45055905
  misc_feature 1..34: note = hyper
  source 1..34: mol_type = genomic DNA
cgccgcgtccccgcccgggcgccccaggcacgta

SEQ ID NO: 12741 - DNA, 49 bp, Homo sapiens
  misc_feature 1..49: note = chr17:45056144-45056193
  misc_feature 1..49: note = hyper
  source 1..49: mol_type = genomic DNA
acagcacgcagagcacggcgatctgcgccacccgcgacacccacaggct

SEQ ID NO: 12742 - DNA, 569 bp, Homo sapiens; identical to SEQ ID NO: 4427
  misc_feature 1..569: note = chr17:45810772-45811341
  misc_feature 1..569: note = hyper
  source 1..569: mol_type = genomic DNA

SEQ ID NO: 12743 - DNA, 114 bp, Homo sapiens
  misc_feature 1..114: note = chr17:45867029-45867143
  misc_feature 1..114: note = hyper
  source 1..114: mol_type = genomic DNA
ttgtactttcaaccacgtcccccactccaaaattctgcgcctccctcaagccagttcctcctctgcttcctcctcgcagcagccggcgcgtctttgttccgtccaggcatcttc

SEQ ID NO: 12744 - DNA, 30 bp, Homo sapiens
  misc_feature 1..30: note = chr17:45867454-45867484
  misc_feature 1..30: note = hyper
  source 1..30: mol_type = genomic DNA
tgtgcactcaaagaccgccagctctggggg

SEQ ID NO: 12745 - DNA, 811 bp, Homo sapiens; identical to SEQ ID NO: 4428
  misc_feature 1..811: note = chr17:46620623-46621434
  misc_feature 1..811: note = hyper
  source 1..811: mol_type = genomic DNA

SEQ ID NO: 12746 - DNA, 155 bp, Homo sapiens
  misc_feature 1..155: note = chr17:46621856-46622011
  misc_feature 1..155: note = hyper
  source 1..155: mol_type = genomic DNA
accccacccccaccacgcttaccgacctgcaggcgatccgaccccggaggccggaacggcggaggcggccggagaaggagacgtggcggattggctgggtttcttggcggatttcttctctttcatccaagggaactcgggggccgggggggcag

SEQ ID NO: 12747 - DNA, 324 bp, Homo sapiens; identical to SEQ ID NO: 1295
  misc_feature 1..324: note = chr17:46655070-46655394
  misc_feature 1..324: note = hyper
  source 1..324: mol_type = genomic DNA

SEQ ID NO: 12748 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 12749 - DNA, 111 bp, Homo sapiens; identical to SEQ ID NO: 1297
  misc_feature 1..111: note = chr17:46655450-46655561
  misc_feature 1..111: note = hyper
  source 1..111: mol_type = genomic DNA

SEQ ID NO: 12750 - DNA, 437 bp, Homo sapiens; identical to SEQ ID NO: 1298
  misc_feature 1..437: note = chr17:46655562-46655999
  misc_feature 1..437: note = hyper
  source 1..437: mol_type = genomic DNA

SEQ ID NO: 12751 - DNA, 341 bp, Homo sapiens; identical to SEQ ID NO: 1299
  misc_feature 1..341: note = chr17:46656057-46656398
  misc_feature 1..341: note = hyper
  source 1..341: mol_type = genomic DNA

SEQ ID NO: 12752 - DNA, 480 bp, Homo sapiens; identical to SEQ ID NO: 4434
  misc_feature 1..480: note = chr17:46659429-46659909
  misc_feature 1..480: note = hyper
  source 1..480: mol_type = genomic DNA

SEQ ID NO: 12753 - DNA, 75 bp, Homo sapiens
  misc_feature 1..75: note = chr17:46663552-46663627
  misc_feature 1..75: note = hyper
  source 1..75: mol_type = genomic DNA
agacaagagaggagacgcctaaatcactgagaaaaggaataagaagagagggaagagaaacgttaaaacttgggg

SEQ ID NO: 12754 - DNA, 198 bp, Homo sapiens
  misc_feature 1..198: note = chr17:46670978-46671176
  misc_feature 1..198: note = hyper
  source 1..198: mol_type = genomic DNA
tagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatgcggccaaatatgggg

SEQ ID NO: 12755 - DNA, 45 bp, Homo sapiens
  misc_feature 1..45: note = chr17:46671384-46671429
  misc_feature 1..45: note = hyper
  source 1..45: mol_type = genomic DNA
ggcctctgagcagagcgcgccacctcccggcgaccgacgggagcg

SEQ ID NO: 12756 - DNA, 37 bp, Homo sapiens; identical to SEQ ID NO: 4435
  misc_feature 1..37: note = chr17:46674933-46674970
  misc_feature 1..37: note = hyper
  source 1..37: mol_type = genomic DNA

SEQ ID NO: 12757 - DNA, 393 bp, Homo sapiens; identical to SEQ ID NO: 4436
  misc_feature 1..393: note = chr17:46675170-46675563
  misc_feature 1..393: note = hyper
  source 1..393: mol_type = genomic DNA

SEQ ID NO: 12758 - DNA, 297 bp, Homo sapiens
  misc_feature 1..297: note = chr17:46687941-46688238
  misc_feature 1..297: note = hyper
  source 1..297: mol_type = genomic DNA
ctgctccttggcgcccgccgccttggcggagtcgccgggacacaccccggagaggttctgctcaaagggcgcgcagtgcatgttgaaggaactcggctcgagcccatagccggccgcgtagacgccggccgcgctctggcccgccatgccccccccgccggggtacaagccctgcatcgaggcggcgaaggaagcgcccgaacccgctccatagcccgggcgctgggggttggaagcaaacgcacaagaagtttgttctgggaaggctccggtagcgaaaaccgaacttgaggctgg

SEQ ID NO: 12759 - DNA, 40 bp, Homo sapiens
  misc_feature 1..40: note = chr17:46688577-46688617
  misc_feature 1..40: note = hyper
  source 1..40: mol_type = genomic DNA
ccgcgggctggaggccgcttgcaggcgagatttggggagg

SEQ ID NO: 12760 - DNA, 225 bp, Homo sapiens
  misc_feature 1..225: note = chr17:46689986-46690211
  misc_feature 1..225: note = hyper
  source 1..225: mol_type = genomic DNA
cagagagaaagccagcgagctggggggttgcagaggggagagaggattgggaggggaaatgaggacgcagcgagagagagcgagagcgagagcgagcgagcgagagagagagagagaagggagacagaaagaattacggcgtgaataggcagtttcatgttgttgggagaacttagcagaaatcggtaccttggtcattacaaagaagcacgttcaaaggaaaaa

SEQ ID NO: 12761 - DNA, 238 bp, Homo sapiens; identical to SEQ ID NO: 4437
  misc_feature 1..238: note = chr17:46690467-46690705
  misc_feature 1..238: note = hyper
  source 1..238: mol_type = genomic DNA

SEQ ID NO: 12762 - DNA, 28 bp, Homo sapiens
  misc_feature 1..28: note = chr17:46690852-46690880
  misc_feature 1..28: note = hyper
  source 1..28: mol_type = genomic DNA
cgcctgcgtccggcggctgctgggaatg

SEQ ID NO: 12763 - DNA, 52 bp, Homo sapiens
  misc_feature 1..52: note = chr17:46691505-46691557
  misc_feature 1..52: note = hyper
  source 1..52: mol_type = genomic DNA
aagaaaggggaaaagcggcaggcgatcggaacggagccggcaagtcttccag

SEQ ID NO: 12764 - skipped

SEQ ID NO: 12765 - DNA, 378 bp, Homo sapiens; identical to SEQ ID NO: 4440
  misc_feature 1..378: note = chr17:46691987-46692365
  misc_feature 1..378: note = hyper
  source 1..378: mol_type = genomic DNA

SEQ ID NO: 12766 - DNA, 34 bp, Homo sapiens
  misc_feature 1..34: note = chr17:46710956-46710990
  misc_feature 1..34: note = hyper
  source 1..34: mol_type = genomic DNA
gccctcgcccagaagcgagggtccgagtggccac

SEQ ID NO: 12767 - DNA, 171 bp, Homo sapiens
  misc_feature 1..171: note = chr17:46713959-46714130
  misc_feature 1..171: note = hyper
  source 1..171: mol_type = genomic DNA
cccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggc

SEQ ID NO: 12768 - DNA, 154 bp, Homo sapiens
  misc_feature 1..154: note = chr17:46714131-46714285
  misc_feature 1..154: note = hyper
  source 1..154: mol_type = genomic DNA
ccctctgccaaccaagagaaacacggttaaatgagtgcgctgggacagaaatccacagctaatcaaggccccatccgctcccaccccctggcccttacctcctaactccatctccgacgctagggagccttccacagcccgaatctcctttgat

SEQ ID NO: 12769 - DNA, 938 bp, Homo sapiens; identical to SEQ ID NO: 1300
  misc_feature 1..938: note = chr17:46795436-46796374
  misc_feature 1..938: note = hyper
  source 1..938: mol_type = genomic DNA

SEQ ID NO: 12770 - DNA, 55 bp, Homo sapiens; identical to SEQ ID NO: 1301
  misc_feature 1..55: note = chr17:46796498-46796553
  misc_feature 1..55: note = hyper
  source 1..55: mol_type = genomic DNA

SEQ ID NO: 12771 - DNA, 25 bp, Homo sapiens
  misc_feature 1..25: note = chr17:46796613-46796638
  misc_feature 1..25: note = hyper
  source 1..25: mol_type = genomic DNA
cagcactactaccgtctgagcaggc

SEQ ID NO: 12772 - DNA, 74 bp, Homo sapiens; identical to SEQ ID NO: 4444
  misc_feature 1..74: note = chr17:46797140-46797214
  misc_feature 1..74: note = hyper
  source 1..74: mol_type = genomic DNA

SEQ ID NO: 12773 - DNA, 31 bp, Homo sapiens; identical to SEQ ID NO: 4445
  misc_feature 1..31: note = chr17:46797274-46797305
  misc_feature 1..31: note = hyper
  source 1..31: mol_type = genomic DNA

SEQ ID NO: 12774 - DNA, 196 bp, Homo sapiens
  misc_feature 1..196: note = chr17:46797533-46797729
  misc_feature 1..196: note = hyper
  source 1..196: mol_type = genomic DNA
gtgcgggtgtgtgcccgcctggatgagggtaaggcgatcagcctctgagtgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 12775 - DNA, 32 bp, Homo sapiens
  misc_feature 1..32: note = chr17:46799421-46799453
  misc_feature 1..32: note = hyper
  source 1..32: mol_type = genomic DNA
aggtcctgcaggtcccgcgtgctgcgaaacat

SEQ ID NO: 12776 - DNA, 30 bp, Homo sapiens
  misc_feature 1..30: note = chr17:46799842-46799872
  misc_feature 1..30: note = hyper
  source 1..30: mol_type = genomic DNA
ggcgctctgtttgcacgccttaggctagga

SEQ ID NO: 12777 - DNA, 197 bp, Homo sapiens; identical to SEQ ID NO: 4446
  misc_feature 1..197: note = chr17:46800518-46800715
  misc_feature 1..197: note = hyper
  source 1..197: mol_type = genomic DNA

SEQ ID NO: 12778 - DNA, 87 bp, Homo sapiens; identical to SEQ ID NO: 4447
  misc_feature 1..87: note = chr17:46800961-46801048
  misc_feature 1..87: note = hyper
  source 1..87: mol_type = genomic DNA

SEQ ID NO: 12779 - DNA, 169 bp, Homo sapiens; identical to SEQ ID NO: 4448
  misc_feature 1..169: note = chr17:46801108-46801277
  misc_feature 1..169: note = hyper
  source 1..169: mol_type = genomic DNA

SEQ ID NO: 12780 - DNA, 606 bp, Homo sapiens; identical to SEQ ID NO: 1303
  misc_feature 1..606: note = chr17:46802306-46802912
  misc_feature 1..606: note = hyper
  source 1..606: mol_type = genomic DNA

SEQ ID NO: 12781 - DNA, 117 bp, Homo sapiens; identical to SEQ ID NO: 1304
  misc_feature 1..117: note = chr17:46802993-46803110
  misc_feature 1..117: note = hyper
  source 1..117: mol_type = genomic DNA

SEQ ID NO: 12782 - DNA, 318 bp, Homo sapiens; identical to SEQ ID NO: 1305
  misc_feature 1..318: note = chr17:46804107-46804425
  misc_feature 1..318: note = hyper
  source 1..318: mol_type = genomic DNA

SEQ ID NO: 12783 - DNA, 315 bp, Homo sapiens
  misc_feature 1..315: note = chr17:46805609-46805924
  misc_feature 1..315: note = hyper
  source 1..315: mol_type = genomic DNA
ccgtgggagtctccgcggggtacgcggccagggtggctgcctgggcacagggtttcagcgagctccgggacactcggcaggagtagtacccgcctccaaagtaaccataaggcacgggagctggggacgtcccctggggcaccccagggcatgggtggcattgctttggcggctccgccgagcctggcagatccaagggggcatagttgacagcaggcatcagcgtaggcgccgctgggtggctggtcagaggggagtgggcgaccagattccgcccccctcccgctcccagcaagccttcgatatccttggctc

SEQ ID NO: 12784 - DNA, 728 bp, Homo sapiens; identical to SEQ ID NO: 4452
  misc_feature 1..728: note = chr17:46810368-46811096
  misc_feature 1..728: note = hyper
  source 1..728: mol_type = genomic DNA

SEQ ID NO: 12785 - DNA, 146 bp, Homo sapiens
  misc_feature 1..146: note = chr17:46811354-46811500
  misc_feature 1..146: note = hyper
  source 1..146: mol_type = genomic DNA
tctttctctcatctccgttttacttcccttcctccgcccgccacacacgtttttcctttgcagcgctctcgcccagtttttccattgttcttctctgaagtctggaaagggcctgcggggctatagctctcagcggccggagcctg

SEQ ID NO: 12786 - DNA, 53 bp, Homo sapiens
  misc_feature 1..53: note = chr17:46815930-46815983
  misc_feature 1..53: note = hyper
  source 1..53: mol_type = genomic DNA
aggccaagctttggacgagggaaagcacagactgacgccgaccagcccatcct

SEQ ID NO: 12787 - DNA, 213 bp, Homo sapiens; identical to SEQ ID NO: 4453
  misc_feature 1..213: note = chr17:46816511-46816724
  misc_feature 1..213: note = hyper
  source 1..213: mol_type = genomic DNA

SEQ ID NO: 12788 - DNA, 347 bp, Homo sapiens; identical to SEQ ID NO: 1306
  misc_feature 1..347: note = chr17:46824568-46824915
  misc_feature 1..347: note = hyper
  source 1..347: mol_type = genomic DNA

SEQ ID NO: 12789 - DNA, 469 bp, Homo sapiens; identical to SEQ ID NO: 1307
  misc_feature 1..469: note = chr17:46824916-46825385
  misc_feature 1..469: note = hyper
  source 1..469: mol_type = genomic DNA

SEQ ID NO: 12790 - DNA, 63 bp, Homo sapiens; identical to SEQ ID NO: 4456
  misc_feature 1..63: note = chr17:46826997-46827060
  misc_feature 1..63: note = hyper
  source 1..63: mol_type = genomic DNA

SEQ ID NO: 12791 - DNA, 121 bp, Homo sapiens; identical to SEQ ID NO: 4457
  misc_feature 1..121: note = chr17:46827381-46827502
  misc_feature 1..121: note = hyper
  source 1..121: mol_type = genomic DNA

SEQ ID NO: 12792 - DNA, 49 bp, Homo sapiens; identical to SEQ ID NO: 4458
  misc_feature 1..49: note = chr17:46827625-46827674
  misc_feature 1..49: note = hyper
  source 1..49: mol_type = genomic DNA

SEQ ID NO: 12793 - DNA, 157 bp, Homo sapiens; identical to SEQ ID NO: 4459
  misc_feature 1..157: note = chr17:46829979-46830136
  misc_feature 1..157: note = hyper
  source 1..157: mol_type = genomic DNA

SEQ ID NO: 12794 - DNA, 502 bp, Homo sapiens; identical to SEQ ID NO: 1308
  misc_feature 1..502: note = chr17:46831824-46832326
  misc_feature 1..502: note = hyper
  source 1..502: mol_type = genomic DNA

SEQ ID NO: 12795 - DNA, 150 bp, Homo sapiens; identical to SEQ ID NO: 1309
  misc_feature 1..150: note = chr17:46832489-46832639
  misc_feature 1..150: note = hyper
  source 1..150: mol_type = genomic DNA

SEQ ID NO: 12796 - DNA, 324 bp, Homo sapiens
  misc_feature 1..324: note = chr17:47072705-47073029
  misc_feature 1..324: note = hyper
  source 1..324: mol_type = genomic DNA
ctgggtagaacaaaacgctcattggggagggtgggctctaaggtggtggaggatatagagaaaccgagttggaagccctcccccgcccctaagtcccagccccatttcttttcagcgcgccgggaaaacggggagggggacaaaggtgctgcgtgctgtctttcaactcccgactttttgaatggcatacaatcgtccggccgcagagcggtgagccaaagtcggagtcagctcagactctgcaaacgaaaaataataacaataaaaaaaattcaaggcattcatatcggtgtagtcaacacgtgttgcggagtcggcccgggc

SEQ ID NO: 12797 - DNA, 225 bp, Homo sapiens
  misc_feature 1..225: note = chr17:47073103-47073328
  misc_feature 1..225: note = hyper
  source 1..225: mol_type = genomic DNA
cgcgtgcccccgctagaattatcctccctcccacagagtccggagtaacaccccagttttcgccctgttcaaggggattccagaatttctgggggtcgacccctcctttttccccgttccctgggcgagggggttccagggtctccgggccgcgctctcggccacccctggcgccatcccagcctccgccgctagaaactcgttggcctcgctcgccgctccgcc

SEQ ID NO: 12798 - DNA, 148 bp, Homo sapiens
  misc_feature 1..148: note = chr17:47073388-47073536
  misc_feature 1..148: note = hyper
  source 1..148: mol_type = genomic DNA
cgaaacgcgcggcgagcagccccctcccccaccgcccagacggggtgcgaccgcccacgtgtcgccccttgcccagtcgggtccttccctcgggctccgggagccggaggatccggaatgagttggtcaaagccgagggaagggaccc

SEQ ID NO: 12799 - DNA, 320 bp, Homo sapiens
  misc_feature 1..320: note = chr17:47074089-47074409
  misc_feature 1..320: note = hyper
  source 1..320: mol_type = genomic DNA
aaacattatttcctgcggcttcctcgttctccactgggataccccgttcccagctttccagtcccgcgctcgcagggtcccccggtcctgcatccccggaggcgggggagtttcgtggggctggcgtggggaaggcggagaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 12800 - DNA, 198 bp, Homo sapiens; identical to SEQ ID NO: 4462
  misc_feature 1..198: note = chr17:47074751-47074949
  misc_feature 1..198: note = hyper
  source 1..198: mol_type = genomic DNA

SEQ ID NO: 12801 - DNA, 177 bp, Homo sapiens; identical to SEQ ID NO: 1310
  misc_feature 1..177: note = chr17:47075225-47075402
  misc_feature 1..177: note = hyper
  source 1..177: mol_type = genomic DNA

SEQ ID NO: 12802 - DNA, 35 bp, Homo sapiens
  misc_feature 1..35: note = chr17:47075700-47075735
  misc_feature 1..35: note = hyper
  source 1..35: mol_type = genomic DNA
ttaggcctttccaggcgtggaaggggtacccggac

SEQ ID NO: 12803 - DNA, 176 bp, Homo sapiens
  misc_feature 1..176: note = chr17:47075879-47076055
  misc_feature 1..176: note = hyper
  source 1..176: mol_type = genomic DNA
cggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaa

SEQ ID NO: 12804 - DNA, 68 bp, Homo sapiens
  misc_feature 1..68: note = chr17:47081200-47081268
  misc_feature 1..68: note = hyper
  source 1..68: mol_type = genomic DNA
ccttttaaaggggagcggctggagtctcacagtgttacccacgggagaggggtcggagacgggtggta

SEQ ID NO: 12805 - DNA, 184 bp, Homo sapiens
  misc_feature 1..184: note = chr17:47210040-47210224
  misc_feature 1..184: note = hyper
  source 1..184: mol_type = genomic DNA
tgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcg

SEQ ID NO: 12806 - DNA, 292 bp, Homo sapiens
  misc_feature 1..292: note = chr17:47573694-47573986
  misc_feature 1..292: note = hyper
  source 1..292: mol_type = genomic DNA
ggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcg

SEQ ID NO: 12807 - DNA, 985 bp, Homo sapiens
  misc_feature 1..985: note = chr17:47574269-47575254
  misc_feature 1..985: note = hyper
  source 1..985: mol_type = genomic DNA
tggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 12808 - DNA, 116 bp, Homo sapiens
  misc_feature 1..116: note = chr17:47928213-47928329
  misc_feature 1..116: note = hyper
  source 1..116: mol_type = genomic DNA
atgattttattccttcgaaggagcgctggtctcctggccccctctcagtctcccgacctcgccagcgccagagccatcctgcatggtcccgacctcgtcagcgccagagccgtcct

SEQ ID NO: 12809 - DNA, 589 bp, Homo sapiens; identical to SEQ ID NO: 4464
  misc_feature 1..589: note = chr17:47987525-47988114
  misc_feature 1..589: note = hyper
  source 1..589: mol_type = genomic DNA

SEQ ID NO: 12810 - DNA, 89 bp, Homo sapiens
  misc_feature 1..89: note = chr17:48041152-48041241
  misc_feature 1..89: note = hyper
  source 1..89: mol_type = genomic DNA
gtgtgtctgtgtgtgcgcgcgcgcgctctgtgttgtattgtgtgcgctagtgcacgcattgtcttcgatgttgccgctagaggaacctt

SEQ ID NO: 12811 - DNA, 49 bp, Homo sapiens
  misc_feature 1..49: note = chr17:48041672-48041721
  misc_feature 1..49: note = hyper
  source 1..49: mol_type = genomic DNA
agacaccctcaaaaccgcctcattttttgttaaccgttttctctctctc

SEQ ID NO: 12812 - DNA, 102 bp, Homo sapiens
  misc_feature 1..102: note = chr17:48042039-48042141
  misc_feature 1..102: note = hyper
  source 1..102: mol_type = genomic DNA
caatccctgagaaagcgctcaggggcttgctgaggtgagcgcaaatggaagcacaaggccgggctggccgtgggctcagtaaccagtcggctgcccggcttg

SEQ ID NO: 12813 - DNA, 239 bp, Homo sapiens; identical to SEQ ID NO: 1311
  misc_feature 1..239: note = chr17:48042409-48042648
  misc_feature 1..239: note = hyper
  source 1..239: mol_type = genomic DNA

SEQ ID NO: 12814 - DNA, 206 bp, Homo sapiens; identical to SEQ ID NO: 1312
  misc_feature 1..206: note = chr17:48042750-48042956
  misc_feature 1..206: note = hyper
  source 1..206: mol_type = genomic DNA

SEQ ID NO: 12815 - DNA, 243 bp, Homo sapiens
  misc_feature 1..243: note = chr17:48049004-48049247
  misc_feature 1..243: note = hyper
  source 1..243: mol_type = genomic DNA
tccccgctcgaattgcgcagtccacgcagccagagaggcgcgggtgggctctgggctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgacc

SEQ ID NO: 12816 - DNA, 1027 bp, Homo sapiens; identical to SEQ ID NO: 1313
  misc_feature 1..1027: note = chr17:48049499-48050526
  misc_feature 1..1027: note = hyper
  source 1..1027: mol_type = genomic DNA

SEQ ID NO: 12817 - DNA, 222 bp, Homo sapiens
  misc_feature 1..222: note = chr17:48070683-48070905
  misc_feature 1..222: note = hyper
  source 1..222: mol_type = genomic DNA
gtggccagccaggctcggcagcgcgcggggaactacggggtcccgcgcgcccccgcggccctggacagccaaacaccaacctgtgtctgcgtgaggcccagctgcgcggccagctcggcgcgctcgggcagcgccaggtactgggccttctggaagcggcgctgcagggcggccagctggtagctggagtagatcgtacgcggctttcggaccttcttgggc

SEQ ID NO: 12818 - DNA, 53 bp, Homo sapiens; identical to SEQ ID NO: 4468
  misc_feature 1..53: note = chr17:48071806-48071859
  misc_feature 1..53: note = hyper
  source 1..53: mol_type = genomic DNA

SEQ ID NO: 12819 - DNA, 34 bp, Homo sapiens
  misc_feature 1..34: note = chr17:48619216-48619250
  misc_feature 1..34: note = hyper
  source 1..34: mol_type = genomic DNA
cgtcccccaccaacccgttcggcgcgggcgagcc

SEQ ID NO: 12820 - DNA, 534 bp, Homo sapiens; identical to SEQ ID NO: 4469
  misc_feature 1..534: note = chr17:48636701-48637235
  misc_feature 1..534: note = hyper
  source 1..534: mol_type = genomic DNA

SEQ ID NO: 12821 - DNA, 127 bp, Homo sapiens
  misc_feature 1..127: note = chr17:50235922-50236049
  misc_feature 1..127: note = hyper
  source 1..127: mol_type = genomic DNA
ccggggactggggcgcggtgggggcacacagactctccaggtcgcgcgcgcccttcctgctcctctgctattttcctgaactccccagaacccccagttgcctggcttccatcgcccgcaactagcg

SEQ ID NO: 12822 - DNA, 197 bp, Homo sapiens; identical to SEQ ID NO: 4470
  misc_feature 1..197: note = chr17:53341227-53341424
  misc_feature 1..197: note = hyper
  source 1..197: mol_type = genomic DNA

SEQ ID NO: 12823 - DNA, 43 bp, Homo sapiens
  misc_feature 1..43: note = chr17:53342876-53342919
  misc_feature 1..43: note = hyper
  source 1..43: mol_type = genomic DNA
atcccacctttatcccgcctccctacggcgtgctcaggtccct

SEQ ID NO: 12824 - DNA, 37 bp, Homo sapiens
  misc_feature 1..37: note = chr17:53343353-53343390
  misc_feature 1..37: note = hyper
  source 1..37: mol_type = genomic DNA
gtgcggggcagggggcgggggtcggcttgagggaggg

SEQ ID NO: 12825 - DNA, 275 bp, Homo sapiens
  misc_feature 1..275: note = chr17:53922719-53922994
  misc_feature 1..275: note = hyper
  source 1..275: mol_type = genomic DNA
cacttcagcctcttccgtctccgtggtgcagccaggccctagcgtctctccatccccgttccccgcgggctcccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcgg

SEQ ID NO: 12826 - DNA, 30 bp, Homo sapiens
  misc_feature 1..30: note = chr17:54674012-54674042
  misc_feature 1..30: note = hyper
  source 1..30: mol_type = genomic DNA
cctgacactgctcagcgctctctttattta

SEQ ID NO: 12827 - DNA, 77 bp, Homo sapiens
  misc_feature 1..77: note = chr17:54675060-54675137
  misc_feature 1..77: note = hyper
  source 1..77: mol_type = genomic DNA
cccacttggaaaacccgcccgcagccggcgagcttctcggctttcagagcaggagccggtgtgagctgggaggacgc

SEQ ID NO: 12828 - DNA, 134 bp, Homo sapiens
  misc_feature 1..134: note = chr17:54675138-54675272
  misc_feature 1..134: note = hyper
  source 1..134: mol_type = genomic DNA
ggttgcagacgtgaccggcgacagacagaccaccggatgcacagaaccagagagcaggcccgaagccgctgcggccgcgggagaggacccagcgggacccaggcagtcccagaagctaacgaaggaagtgctgg

SEQ ID NO: 12829 - DNA, 171 bp, Homo sapiens
  misc_feature 1..171: note = chr17:56234399-56234570
  misc_feature 1..171: note = hyper
  source 1..171: mol_type = genomic DNA
atgagaaggggccagcggtggcggtcgggccaggtccggggcctggggacgccgaggcggccgcggaggagcgccgcgtcaaggtctccagcctgccctacagtgtggatgcgctcgtgtcggacaagaagccgcccaaggaggcatccccagtgccggccaaaagcgcct

SEQ ID NO: 12830 - DNA, 33 bp, Homo sapiens
  misc_feature 1..33: note = chr17:56326929-56326962
  misc_feature 1..33: note = hyper
  source 1..33: mol_type = genomic DNA
gaagcctgcgctgggcgccgccaacagggctct

SEQ ID NO: 12831 - DNA, 463 bp, Homo sapiens
  misc_feature 1..463: note = chr17:56832946-56833409
  misc_feature 1..463: note = hyper
  source 1..463: mol_type = genomic DNA
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagcta

SEQ ID NO: 12832 - DNA, 425 bp, Homo sapiens
  misc_feature 1..425: note = chr17:58212827-58213252
  misc_feature 1..425: note = hyper
  source 1..425: mol_type = genomic DNA
ggccaggttggagaacgatttcaactgcgtactggacgacacacagaagactgcggggagccttagcccctacccggcctgcagtgctctctggggcacacggcagccccacgacgcctttgggtttcttcgagcgctactcgcacgcaccagcgcccacacagctgcaacgccaaacgcccgccagcaccttagggccgcgggagtcccttccccaggcccgccccacacgccggccttttctgccgcttcccaagccggagccaatcagcgctcagcagcgaccggcagggacgaccaatcgacttatcctgcgttgtgctaaagacctagaaatcgagcgtggtacattcgatcgacggaacgtctgggccctagtgctaagttgggtgactgttcggtggttgtctcggggggttgcagga

SEQ ID NO: 12833 - DNA, 247 bp, Homo sapiens
  misc_feature 1..247: note = chr17:58216590-58216837
  misc_feature 1..247: note = hyper
  source 1..247: mol_type = genomic DNA
gcagaaccctggattcgagtcccggcttcagagaccctcggctgtgtgacgtggaggcgtcggccgccctctgagagccttcgtggatgacagctgatgcttgggcctaccttcctcggctgctgagaggctcagaagggaccgcgtgtaaaacgccttggaatcttaaatctacttaattccatttacctgcttcccagaaacggtccatggcttccgtcccggtcatagcgctgcgcagcgggac

SEQ ID NO: 12834 - DNA, 70 bp, Homo sapiens; identical to SEQ ID NO: 4471
  misc_feature 1..70: note = chr17:58217229-58217299
  misc_feature 1..70: note = hyper
  source 1..70: mol_type = genomic DNA

SEQ ID NO: 12835 - DNA, 249 bp, Homo sapiens; identical to SEQ ID NO: 4472
  misc_feature 1..249: note = chr17:58217356-58217605
  misc_feature 1..249: note = hyper
  source 1..249: mol_type = genomic DNA

SEQ ID NO: 12836 - DNA, 383 bp, Homo sapiens
  misc_feature 1..383: note = chr17:58218674-58219057
  misc_feature 1..383: note = hyper
  source 1..383: mol_type = genomic DNA
cgcgctcgggctggacgtcgcgctcagcgcgcagggcccccatggacgtcgcgccgctgacctagctgtcagacatcgccacgaggagttggcaggctcgggaggccgaaacgctgtgctcacctcgagcactgccaggctgctggagaggctttccggggcacagaagctgcagcggcgcggggcggtgggctgtgagcgagcatatgtaggggagcgtttcccgcgagaaagcagaacctgcgccagccgagggccctagggctgctggtaggaggactgttctctatcgtccagctgctcccgacctcttctctgaactggccctgctctggggaacagcgccctgcttctttgtgcgacgatcacgcttgactcattgg

SEQ ID NO: 12837 - DNA, 294 bp, Homo sapiens
  misc_feature 1..294: note = chr17:58227104-58227398
  misc_feature 1..294: note = hyper
  source 1..294: mol_type = genomic DNA
gctgagtggagaggacgcggagtgggtgagggggccttgcgcacagggcaagaggtggccaggcagggcgggggaccggggagagcggaggatttcagatgagggacaggggaaggtggagaggggagggcaggccccgccagggggaggagccgcctcccgcgtccagctgtcggggctccctcccgtcgcggctccgctataaaacccaggccggcaggatcgctgcacccgcggcggcctcctcggtgcgcgacccccggctcagaggactctttgctgtcccgcaagatg

SEQ ID NO: 12838 - DNA, 200 bp, Homo sapiens; identical to SEQ ID NO: 4473
  misc_feature 1..200: note = chr17:58498777-58498977
  misc_feature 1..200: note = hyper
  source 1..200: mol_type = genomic DNA

SEQ ID NO: 12839 - DNA, 355 bp, Homo sapiens; identical to SEQ ID NO: 4474
  misc_feature 1..355: note = chr17:58498978-58499333
  misc_feature 1..355: note = hyper
  source 1..355: mol_type = genomic DNA

SEQ ID NO: 12840 - DNA, 30 bp, Homo sapiens
  misc_feature 1..30: note = chr17:59467481-59467511
  misc_feature 1..30: note = hyper
  source 1..30: mol_type = genomic DNA
cccctagtgccgggccggccgcgcatgagg

SEQ ID NO: 12841 - DNA, 71 bp, Homo sapiens; identical to SEQ ID NO: 4475
  misc_feature 1..71: note = chr17:59474176-59474247
  misc_feature 1..71: note = hyper
  source 1..71: mol_type = genomic DNA

SEQ ID NO: 12842 - DNA, 403 bp, Homo sapiens; identical to SEQ ID NO: 4476
  misc_feature 1..403: note = chr17:59474741-59475144
  misc_feature 1..403: note = hyper
  source 1..403: mol_type = genomic DNA

SEQ ID NO: 12843 - DNA, 229 bp, Homo sapiens
  misc_feature 1..229: note = chr17:59475736-59475965
  misc_feature 1..229: note = hyper
  source 1..229: mol_type = genomic DNA
cccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctcccc

SEQ ID NO: 12844 - DNA, 411 bp, Homo sapiens
  misc_feature 1..411: note = chr17:59476254-59476665
  misc_feature 1..411: note = hyper
  source 1..411: mol_type = genomic DNA
gcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgccca

SEQ ID NO: 12845 - DNA, 30 bp, Homo sapiens
  misc_feature 1..30: note = chr17:59476876-59476906
  misc_feature 1..30: note = hyper
  source 1..30: mol_type = genomic DNA
caaggccccgggacccgggctcccctcgcc

SEQ ID NO: 12846 - DNA, 32 bp, Homo sapiens
  misc_feature 1..32: note = chr17:59477323-59477355
  misc_feature 1..32: note = hyper
  source 1..32: mol_type = genomic DNA
ggcccagcccggccccgcgcagagcccccgcc

SEQ ID NO: 12847 - DNA, 414 bp, Homo sapiens; identical to SEQ ID NO: 1314
  misc_feature 1..414: note = chr17:59478133-59478547
  misc_feature 1..414: note = hyper
  source 1..414: mol_type = genomic DNA

SEQ ID NO: 12848 - DNA, 146 bp, Homo sapiens
  misc_feature 1..146: note = chr17:59488278-59488424
  misc_feature 1..146: note = hyper
  source 1..146: mol_type = genomic DNA
acattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggc

SEQ ID NO: 12849 - DNA, 275 bp, Homo sapiens; identical to SEQ ID NO: 1315
  misc_feature 1..275: note = chr17:59528876-59529151
  misc_feature 1..275: note = hyper
  source 1..275: mol_type = genomic DNA

SEQ ID NO: 12850 - DNA, 12 bp, Homo sapiens
  misc_feature 1..12: note = chr17:59529253-59529265
  misc_feature 1..12: note = hyper
  source 1..12: mol_type = genomic DNA
cgacctcgggac

SEQ ID NO: 12851 - DNA, 233 bp, Homo sapiens; identical to SEQ ID NO: 1317
  misc_feature 1..233: note = chr17:59529843-59530076
  misc_feature 1..233: note = hyper
  source 1..233: mol_type = genomic DNA

SEQ ID NO: 12852 - DNA, 49 bp, Homo sapiens; identical to SEQ ID NO: 4481
  misc_feature 1..49: note = chr17:59530303-59530352
  misc_feature 1..49: note = hyper
  source 1..49: mol_type = genomic DNA

SEQ ID NO: 12853 - DNA, 207 bp, Homo sapiens; identical to SEQ ID NO: 4482
  misc_feature 1..207: note = chr17:59531811-59532018
  misc_feature 1..207: note = hyper
  source 1..207: mol_type = genomic DNA

SEQ ID NO: 12854 - DNA, 170 bp, Homo sapiens; identical to SEQ ID NO: 1318
  misc_feature 1..170: note = chr17:59533874-59534044
  misc_feature 1..170: note = hyper
  source 1..170: mol_type = genomic DNA

SEQ ID NO: 12855 - DNA, 66 bp, Homo sapiens; identical to SEQ ID NO: 1319
  misc_feature 1..66: note = chr17:59534340-59534406
  misc_feature 1..66: note = hyper
  source 1..66: mol_type = genomic DNA

SEQ ID NO: 12856 - DNA, 225 bp, Homo sapiens; identical to SEQ ID NO: 1320
  misc_feature 1..225: note = chr17:59534556-59534781
  misc_feature 1..225: note = hyper
  source 1..225: mol_type = genomic DNA

SEQ ID NO: 12857 - DNA, 63 bp, Homo sapiens
  misc_feature 1..63: note = chr17:59535204-59535267
  misc_feature 1..63: note = hyper
  source 1..63: mol_type = genomic DNA
cgaggggaggggcagcgctatgcaaatgaatccaaacagggatcgcgacgctcaaaagtccca

SEQ ID NO: 12858 - DNA, 462 bp, Homo sapiens
  misc_feature 1..462: note = chr17:59539215-59539677
  misc_feature 1..462: note = hyper
  source 1..462: mol_type = genomic DNA
gtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcc

SEQ ID NO: 12859 - DNA, 153 bp, Homo sapiens
  misc_feature 1..153: note = chr17:60705777-60705930
  misc_feature 1..153: note = hyper
  source 1..153: mol_type = genomic DNA
cctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtg

SEQ ID NO: 12860 - DNA, 21 bp, Homo sapiens
  misc_feature 1..21: note = chr17:61778053-61778074
  misc_feature 1..21: note = hyper
  source 1..21: mol_type = genomic DNA
cccgccgccaggggccgcccc

SEQ ID NO: 12861 - DNA, 15 bp, Homo sapiens
  misc_feature 1..15: note = chr17:61778234-61778249
  misc_feature 1..15: note = hyper
  source 1..15: mol_type = genomic DNA
ggtatgcgtggttcc

SEQ ID NO: 12862 - DNA, 153 bp, Homo sapiens; identical to SEQ ID NO: 4488
  misc_feature 1..153: note = chr17:61926172-61926325
  misc_feature 1..153: note = hyper
  source 1..153: mol_type = genomic DNA

SEQ ID NO: 12863 - DNA, 96 bp, Homo sapiens; identical to SEQ ID NO: 4489
  misc_feature 1..96: note = chr17:61926507-61926603
  misc_feature 1..96: note = hyper
  source 1..96: mol_type = genomic DNA

SEQ ID NO: 12864 - DNA, 129 bp, Homo sapiens
  misc_feature 1..129: note = chr17:62777021-62777150
  misc_feature 1..129: note = hyper
  source 1..129: mol_type = genomic DNA
caacagggcctttcccggagcaacccggccgggcctggaaaaactccgagagggattcccagcgcagggacgcccaccggagcgcagtgtctcgggctggataagaaggggacccggccacagctcctt

SEQ ID NO: 12865 - DNA, 45 bp, Homo sapiens
  misc_feature 1..45: note = chr17:64961987-64962032
  misc_feature 1..45: note = hyper
  source 1..45: mol_type = genomic DNA
ccgagtctcccccaacggagacagcgacctcggtcgcggcccctc

SEQ ID NO: 12866 - DNA, 223 bp, Homo sapiens
  misc_feature 1..223: note = chr17:66596302-66596525
  misc_feature 1..223: note = hyper
  source 1..223: mol_type = genomic DNA
gctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagag

SEQ ID NO: 12867 - DNA, 165 bp, Homo sapiens
  misc_feature 1..165: note = chr17:66596728-66596893
  misc_feature 1..165: note = hyper
  source 1..165: mol_type = genomic DNA
ggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtg

SEQ ID NO: 12868 - DNA, 30 bp, Homo sapiens
  misc_feature 1..30: note = chr17:66597456-66597486
  misc_feature 1..30: note = hyper
  source 1..30: mol_type = genomic DNA
cccccacccactctccgctggcacctgcct

SEQ ID NO: 12869 - DNA, 281 bp, Homo sapiens
  misc_feature 1..281: note = chr17:70112842-70113123
  misc_feature 1..281: note = hyper
  source 1..281: mol_type = genomic DNA
tgagttgagggaagccgcatgacgcgcggctccccggtgccacagctaaggacagatattttcgcaaaacccagaatgaaaaaagagcacgctccctttgggagcgctgtccctttgggactggggccttccactcccacccctcctttttccctgatcggctccgcagctccacgacaagccagctggtctggtctctgacttgggctccggtccgtacccccggggcgccctgctgtgttacagccgcccgacgcccccagacccggccaggtcaccag

SEQ ID NO: 12870 - DNA, 21 bp, Homo sapiens
  misc_feature 1..21: note = chr17:70113546-70113567
  misc_feature 1..21: note = hyper
  source 1..21: mol_type = genomic DNA
cttccacaagaaactcgtgtc

SEQ ID NO: 12871 - DNA, 372 bp, Homo sapiens; identical to SEQ ID NO: 1322
  misc_feature 1..372: note = chr17:70113647-70114019
  misc_feature 1..372: note = hyper
  source 1..372: mol_type = genomic DNA

SEQ ID NO: 12872 - DNA, 365 bp, Homo sapiens; identical to SEQ ID NO: 1323
  misc_feature 1..365: note = chr17:70114152-70114517
  misc_feature 1..365: note = hyper
  source 1..365: mol_type = genomic DNA

SEQ ID NO: 12873 - DNA, 640 bp, Homo sapiens; identical to SEQ ID NO: 1324
  misc_feature 1..640: note = chr17:70215667-70216307
  misc_feature 1..640: note = hyper
  source 1..640: mol_type = genomic DNA

SEQ ID NO: 12874 - DNA, 54 bp, Homo sapiens; identical to SEQ ID NO: 1325
  misc_feature 1..54: note = chr17:70216392-70216446
  misc_feature 1..54: note = hyper
  source 1..54: mol_type = genomic DNA

SEQ ID NO: 12875 - DNA, 136 bp, Homo sapiens
  misc_feature 1..136: note = chr17:71161797-71161933
  misc_feature 1..136: note = hyper
  source 1..136: mol_type = genomic DNA
cgaggggagcgaggccgtgagatgccagctggggctcctgcgggagcgcacccggagatccgagcctgccagaggcaggcggcgggcgcagagcggagaaagaggggcttctctccctagacgctgaacgatctag

SEQ ID NO: 12876 - DNA, 41 bp, Homo sapiens
  misc_feature 1..41: note = chr17:71641056-71641097
  misc_feature 1..41: note = hyper
  source 1..41: mol_type = genomic DNA
gacgcgggctgtcgccggcgcccgggcgcagagcctcctgc

SEQ ID NO: 12877 - DNA, 140 bp, Homo sapiens
  misc_feature 1..140: note = chr17:71641497-71641637
  misc_feature 1..140: note = hyper
  source 1..140: mol_type = genomic DNA
agccaggcccgggagcgagccccgcagaaatacaatccgactgcgcggccgcgggcgcccagcggctctgggacccgcaggggggcagcagtgccaaccttctgccgcgccgggagagatgcgcgcgagcccctccgctc

SEQ ID NO: 12878 - DNA, 57 bp, Homo sapiens
  misc_feature 1..57: note = chr17:71897984-71898041
  misc_feature 1..57: note = hyper
  source 1..57: mol_type = genomic DNA
cacctgattacgctgcgcggacacaacagaggcgcccggacccgcagccctgccttc

SEQ ID NO: 12879 - DNA, 525 bp, Homo sapiens; identical to SEQ ID NO: 4495
  misc_feature 1..525: note = chr17:71948390-71948915
  misc_feature 1..525: note = hyper
  source 1..525: mol_type = genomic DNA

SEQ ID NO: 12880 - DNA, 62 bp, Homo sapiens
  misc_feature 1..62: note = chr17:71949206-71949268
  misc_feature 1..62: note = hyper
  source 1..62: mol_type = genomic DNA
ccacgggagttcacacgctccagtccatcggcctcccccggcccgaccgccctggctcaggc

SEQ ID NO: 12881 - DNA, 30 bp, Homo sapiens
  misc_feature 1..30: note = chr17:72208638-72208668
  misc_feature 1..30: note = hyper
  source 1..30: mol_type = genomic DNA
accccatcactccaccgcacctacccctga

SEQ ID NO: 12882 - DNA, 115 bp, Homo sapiens
  misc_feature 1..115: note = chr17:72270332-72270447
  misc_feature 1..115: note = hyper
  source 1..115: mol_type = genomic DNA
gctccggggtccttccgcgtcgccccgcgcgtccggagccaggccggggttgccaagcaaccggtaaacgccgccgtttgaggagcaccggagccgcgaccgtggattgaacgct

SEQ ID NO: 12883 - DNA, 210 bp, Homo sapiens
  misc_feature 1..210: note = chr17:72322348-72322558
  misc_feature 1..210: note = hyper
  source 1..210: mol_type = genomic DNA
gcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccc

SEQ ID NO: 12884 - DNA, 15 bp, Homo sapiens
  misc_feature 1..15: note = chr17:72322611-72322626
  misc_feature 1..15: note = hyper
  source 1..15: mol_type = genomic DNA
cgccaccccactgag

SEQ ID NO: 12885 - DNA, 324 bp, Homo sapiens; identical to SEQ ID NO: 4496
  misc_feature 1..324: note = chr17:72856941-72857265
  misc_feature 1..324: note = hyper
  source 1..324: mol_type = genomic DNA

SEQ ID NO: 12886 - DNA, 127 bp, Homo sapiens
  misc_feature 1..127: note = chr17:72889569-72889696
  misc_feature 1..127: note = hyper
  source 1..127: mol_type = genomic DNA
agctcgtcctcaccacgtcctgcaccagcacctccagctcccgcagcagcgcctcgcccccacggtgcgcgctccgcgccggttccatgggctccgtaggttccatgggctccgtgggttccatgga

SEQ ID NO: 12887 - DNA, 93 bp, Homo sapiens
  misc_feature 1..93: note = chr17:72920958-72921051
  misc_feature 1..93: note = hyper
  source 1..93: mol_type = genomic DNA
ctcttctacctcctccgaaccgtgcgctgcccctgcgcggtaccctaccgggacgcgcacgctggccccatctggctccgaggtgccagggga

SEQ ID NO: 12888 - DNA, 59 bp, Homo sapiens
  misc_feature 1..59: note = chr17:72932027-72932086
  misc_feature 1..59: note = hyper
  source 1..59: mol_type = genomic DNA
ggcctcaggtaagcccggagcgccggcggaactttcccagcttgcgcaccccagacact

SEQ ID NO: 12889 - DNA, 173 bp, Homo sapiens
  misc_feature 1..173: note = chr17:72932356-72932529
  misc_feature 1..173: note = hyper
  source 1..173: mol_type = genomic DNA
gcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccga

SEQ ID NO: 12890 - DNA, 87 bp, Homo sapiens
  misc_feature 1..87: note = chr17:73073597-73073684
  misc_feature 1..87: note = hyper
  source 1..87: mol_type = genomic DNA
gtgcctggagtgggacgacaacgcgcagaccgtgctgcacggcgcctaccaccgcacgctgggcgtggcgctcgactgcgacgccgg

SEQ ID NO: 12891 - DNA, 110 bp, Homo sapiens
  misc_feature 1..110: note = chr17:74070370-74070480
  misc_feature 1..110: note = hyper
  source 1..110: mol_type = genomic DNA
tgggcgaaagagccagactccggggcccctcatccgcctccgccccgcgtttcctccccccgatctcccaggggtcctcttttgagggcaccccagcccctcgacggtcc

SEQ ID NO: 12892 - DNA, 66 bp, Homo sapiens
  misc_feature 1..66: note = chr17:74072483-74072549
  misc_feature 1..66: note = hyper
  source 1..66: mol_type = genomic DNA
tcctgctgccgggcccgccccatttccaggctccgctgagtgtctgggacacgctgggaggccccc

SEQ ID NO: 12893 - DNA, 38 bp, Homo sapiens; identical to SEQ ID NO: 1326
  misc_feature 1..38: note = chr17:74072998-74073036
  misc_feature 1..38: note = hyper
  source 1..38: mol_type = genomic DNA

SEQ ID NO: 12894 - DNA, 136 bp, Homo sapiens
  misc_feature 1..136: note = chr17:74073246-74073382
  misc_feature 1..136: note = hyper
  source 1..136: mol_type = genomic DNA
gcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacat

SEQ ID NO: 12895 - DNA, 63 bp, Homo sapiens
  misc_feature 1..63: note = chr17:74136379-74136442
  misc_feature 1..63: note = hyper
  source 1..63: mol_type = genomic DNA
ggctgtcatccagggcgtcgggctcctccaggccgccctccggcccggcctcctccgccggcc

SEQ ID NO: 12896 - DNA, 130 bp, Homo sapiens
  misc_feature 1..130: note = chr17:74136570-74136700
  misc_feature 1..130: note = hyper
  source 1..130: mol_type = genomic DNA
cgttacacggcctcccggacgcgcgcttccatctcgcgaccccgggggcgcctcctccgaataagtatgtggtgcctgcgaggaccacggtgggagctgagcactaccccacccccgaggggacagtgtg

SEQ ID NO: 12897 - DNA, 144 bp, Homo sapiens; identical to SEQ ID NO: 4498
  misc_feature 1..144: note = chr17:74534219-74534363
  misc_feature 1..144: note = hyper
  source 1..144: mol_type = genomic DNA

SEQ ID NO: 12898 - DNA, 15 bp, Homo sapiens
  misc_feature 1..15: note = chr17:74534387-74534402
  misc_feature 1..15: note = hyper
  source 1..15: mol_type = genomic DNA
cgcccaggctctggg

SEQ ID NO: 12899 - DNA, 85 bp, Homo sapiens
  misc_feature 1..85: note = chr17:74581216-74581301
  misc_feature 1..85: note = hyper
  source 1..85: mol_type = genomic DNA
gggcttatccagacacggcgagcggaagccggggagaagggagcgggcgcggggcggacagagaccgcagcgggcgggaaaggcg

SEQ ID NO: 12900 - DNA, 293 bp, Homo sapiens
  misc_feature 1..293: note = chr17:74864739-74865032
  misc_feature 1..293: note = hyper
  source 1..293: mol_type = genomic DNA
tgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtg

SEQ ID NO: 12901 - DNA, 567 bp, Homo sapiens; identical to SEQ ID NO: 4500
  misc_feature 1..567: note = chr17:74865591-74866158
  misc_feature 1..567: note = hyper
  source 1..567: mol_type = genomic DNA

SEQ ID NO: 12902 - DNA, 128 bp, Homo sapiens
  misc_feature 1..128: note = chr17:75368774-75368902
  misc_feature 1..128: note = hyper
  source 1..128: mol_type = genomic DNA
cccaggagggtgcagcggtggcccccggggcggtggtcgtggtgggggtgttagctgcaggggtgccctcggtgggtgggagttggtggcctctcgctggtgccatgggactcgcatgttcgccctgc

SEQ ID NO: 12903 - DNA, 188 bp, Homo sapiens
  misc_feature 1..188: note = chr17:75368903-75369091
  misc_feature 1..188: note = hyper
  source 1..188: mol_type = genomic DNA
cccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgccc

SEQ ID NO: 12904 - DNA, 32 bp, Homo sapiens
  misc_feature 1..32: note = chr17:75369092-75369124
  misc_feature 1..32: note = hyper
  source 1..32: mol_type = genomic DNA
ccctcctcgccatggcccggcctccacatccg

SEQ ID NO: 12905 - DNA, 18 bp, Homo sapiens
  misc_feature 1..18: note = chr17:75369440-75369458
  misc_feature 1..18: note = hyper
  source 1..18: mol_type = genomic DNA
gcctaggggctcctccgg

SEQ ID NO: 12906 - DNA, 228 bp, Homo sapiens; identical to SEQ ID NO: 1328
  misc_feature 1..228: note = chr17:75369492-75369720
  misc_feature 1..228: note = hyper
  source 1..228: mol_type = genomic DNA

SEQ ID NO: 12907 - DNA, 35 bp, Homo sapiens
  misc_feature 1..35: note = chr17:75370281-75370316
  misc_feature 1..35: note = hyper
  source 1..35: mol_type = genomic DNA
tccgcctcccagaatcgggccgtgggggacagaag

SEQ ID NO: 12908 - DNA, 51 bp, Homo sapiens
  misc_feature 1..51: note = chr17:75524953-75525004
  misc_feature 1..51: note = hyper
  source 1..51: mol_type = genomic DNA
atgcatcttctggaacggcagctgaggcaatgcggggtgtgaagtggcggc

SEQ ID NO: 12909 - DNA, 87 bp, Homo sapiens
  misc_feature 1..87: note = chr17:75525005-75525092
  misc_feature 1..87: note = hyper
  source 1..87: mol_type = genomic DNA
ggcagaggggctcgcaggggctgggatccgcgtgcccctctctgcctcggtgcggagcacgatgtgcccgggcgggggcgaggacgt

SEQ ID NO: 12910 - DNA, 389 bp, Homo sapiens; identical to SEQ ID NO: 4503
  misc_feature 1..389: note = chr17:76227773-76228162
  misc_feature 1..389: note = hyper
  source 1..389: mol_type = genomic DNA

SEQ ID NO: 12911 - DNA, 130 bp, Homo sapiens; identical to SEQ ID NO: 4504
  misc_feature 1..130: note = chr17:76228213-76228343
  misc_feature 1..130: note = hyper
  source 1..130: mol_type = genomic DNA

SEQ ID NO: 12912 - DNA, 18 bp, Homo sapiens
  misc_feature 1..18: note = chr17:76254836-76254854
  misc_feature 1..18: note = hyper
  source 1..18: mol_type = genomic DNA
cgccggggaggctgctgc

SEQ ID NO: 12913 - DNA, 102 bp, Homo sapiens; identical to SEQ ID NO: 4505
  misc_feature 1..102: note = chr17:77178962-77179064
  misc_feature 1..102: note = hyper
  source 1..102: mol_type = genomic DNA

SEQ ID NO: 12914 - DNA, 249 bp, Homo sapiens; identical to SEQ ID NO: 4506
  misc_feature 1..249: note = chr17:77179081-77179330
  misc_feature 1..249: note = hyper
  source 1..249: mol_type = genomic DNA

SEQ ID NO: 12915 - DNA, 75 bp, Homo sapiens; identical to SEQ ID NO: 4507
  misc_feature 1..75: note = chr17:77179380-77179455
  misc_feature 1..75: note = hyper
  source 1..75: mol_type = genomic DNA

SEQ ID NO: 12916 - DNA, 27 bp, Homo sapiens
  misc_feature 1..27: note = chr17:77179456-77179483
  misc_feature 1..27: note = hyper
  source 1..27: mol_type = genomic DNA
gcaggggggcgcccggcggcggctctg

SEQ ID NO: 12917 - DNA, 92 bp, Homo sapiens; identical to SEQ ID NO: 4509
  misc_feature 1..92: note = chr17:77179617-77179709
  misc_feature 1..92: note = hyper
  source 1..92: mol_type = genomic DNA

SEQ ID NO: 12918 - DNA, 25 bp, Homo sapiens
  misc_feature 1..25: note = chr17:77179710-77179735
  misc_feature 1..25: note = hyper
  source 1..25: mol_type = genomic DNA
ggcgagcgggcgagagcaggagtca

SEQ ID NO: 12919 - DNA, 265 bp, Homo sapiens
  misc_feature 1..265: note = chr17:77179951-77180216
  misc_feature 1..265: note = hyper
  source 1..265: mol_type = genomic DNA
cctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgc

SEQ ID NO: 12920 - DNA, 36 bp, Homo sapiens
  misc_feature 1..36: note = chr17:77772754-77772790
  misc_feature 1..36: note = hyper
  source 1..36: mol_type = genomic DNA
gaacgaacagcgcgtcgaggacgctcagatctccca

SEQ ID NO: 12921 - DNA, 295 bp, Homo sapiens
  misc_feature 1..295: note = chr17:77776679-77776974
  misc_feature 1..295: note = hyper
  source 1..295: mol_type = genomic DNA
gccgcgggccggccccatttccgccccccccccacgcgcccccccatcacacgcacacccaatccccggactgctcgctggtgctgcttgtgagacccattcctaggagccccaggcgcccttggggagcagaaagaggcggtccagagttgggccggacaaccgcaacctggaaggagtccgggagtccttgggtctgggcgctcagttctcacggtctggggagaaggggctcagacgggacggactaggcacagccaggggcggggactgcgagaggcgaggggaggccggc

SEQ ID NO: 12922 - DNA, 42 bp, Homo sapiens
  misc_feature 1..42: note = chr17:77777233-77777275
  misc_feature 1..42: note = hyper
  source 1..42: mol_type = genomic DNA
gccacggttgatgagcgcccctcctcccgtgacccagctcat

SEQ ID NO: 12923 - DNA, 64 bp, Homo sapiens; identical to SEQ ID NO: 4511
  misc_feature 1..64: note = chr17:77777585-77777649
  misc_feature 1..64: note = hyper
  source 1..64: mol_type = genomic DNA

SEQ ID NO: 12924 - DNA, 254 bp, Homo sapiens; identical to SEQ ID NO: 4512
  misc_feature 1..254: note = chr17:77777650-77777904
  misc_feature 1..254: note = hyper
  source 1..254: mol_type = genomic DNA

SEQ ID NO: 12925 - DNA, 18 bp, Homo sapiens
  misc_feature 1..18: note = chr17:77777943-77777961
  misc_feature 1..18: note = hyper
  source 1..18: mol_type = genomic DNA
cgacgcctttcctcgcag

SEQ ID NO: 12926 - DNA, 30 bp, Homo sapiens
  misc_feature 1..30: note = chr17:77778966-77778996
  misc_feature 1..30: note = hyper
  source 1..30: mol_type = genomic DNA
ccagggactcagttccgcaccctttgaaca

SEQ ID NO: 12927 - DNA, 804 bp, Homo sapiens
  misc_feature 1..804: note = chr17:78450039-78450843
  misc_feature 1..804: note = hyper
  source 1..804: mol_type = genomic DNA
cttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgccca

SEQ ID NO: 12928 - DNA, 95 bp, Homo sapiens
  misc_feature 1..95: note = chr17:78451477-78451572
  misc_feature 1..95: note = hyper
  source 1..95: mol_type = genomic DNA
gcggggctcggctcccgagatcgcggtccgggttccggcgccgggctgggggctcaggaccagggctggcgcagccgccccgccccgccccgccc

SEQ ID NO: 12929 - DNA, 59 bp, Homo sapiens
  misc_feature 1..59: note = chr17:78451801-78451860
  misc_feature 1..59: note = hyper
  source 1..59: mol_type = genomic DNA
ccgggatcgggcgtccgcccctcgggcgggagcagaggccggctcgatggagacctttt

SEQ ID NO: 12930 - DNA, 232 bp, Homo sapiens
  misc_feature 1..232: note = chr17:78452108-78452340
  misc_feature 1..232: note = hyper
  source 1..232: mol_type = genomic DNA
cggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggagg

SEQ ID NO: 12931 - DNA, 244 bp, Homo sapiens
  misc_feature 1..244: note = chr17:78452681-78452925
  misc_feature 1..244: note = hyper
  source 1..244: mol_type = genomic DNA
aggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggtta

SEQ ID NO: 12932 - DNA, 39 bp, Homo sapiens
  misc_feature 1..39: note = chr17:79316974-79317013
  misc_feature 1..39: note = hyper
  source 1..39: mol_type = genomic DNA
cgaagaggggacttgcgcggacggcgaggaggatcgatg

SEQ ID NO: 12933 - DNA, 121 bp, Homo sapiens
  misc_feature 1..121: note = chr17:79761692-79761813
  misc_feature 1..121: note = hyper
  source 1..121: mol_type = genomic DNA
ggagctgggacccaccgcgaccaccacctgctgggccagggtccgcgggctcaggggtctgcaggattagggtctgcggaaccaggacccgtgggacaaaggtctgtggggcgcgggtccg

SEQ ID NO: 12934 - DNA, 329 bp, Homo sapiens
  misc_feature 1..329: note = chr17:79761833-79762162
  misc_feature 1..329: note = hyper
  source 1..329: mol_type = genomic DNA
cgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggg

SEQ ID NO: 12935 - DNA, 75 bp, Homo sapiens
  misc_feature 1..75: note = chr17:79860521-79860596
  misc_feature 1..75: note = hyper
  source 1..75: mol_type = genomic DNA
aaacctgcagaggtgcgagcggctccccgacggccgcgggacctaccagtgcaaggcgaacgtcttcctgtccct

SEQ ID NO: 12936 - DNA, 30 bp, Homo sapiens
  misc_feature 1..30: note = chr17:80329291-80329321
  misc_feature 1..30: note = hyper
  source 1..30: mol_type = genomic DNA
ccacctgcgcgcgggcgggtccagggcttg

SEQ ID NO: 12937 - DNA, 263 bp, Homo sapiens; identical to SEQ ID NO: 4514
  misc_feature 1..263: note = chr17:80329738-80330001
  misc_feature 1..263: note = hyper
  source 1..263: mol_type = genomic DNA

SEQ ID NO: 12938 - DNA, 78 bp, Homo sapiens
  misc_feature 1..78: note = chr17:80333151-80333229
  misc_feature 1..78: note = hyper
  source 1..78: mol_type = genomic DNA
ctcaccaggaactaccgcgaccacctgcgcggccgcgtgcggggcccgggcagcgggggaggccgggggcccgttccc

SEQ ID NO: 12939 - DNA, 56 bp, Homo sapiens
  misc_feature 1..56: note = chr18:500061-500117
  misc_feature 1..56: note = hyper
  source 1..56: mol_type = genomic DNA
cgccagcgcggggaccgctcgggccgggaaacggctagaggcgggaggagagagga

SEQ ID NO: 12940 - DNA, 890 bp, Homo sapiens; identical to SEQ ID NO: 4515
  misc_feature 1..890: note = chr18:500373-501263
  misc_feature 1..890: note = hyper
  source 1..890: mol_type = genomic DNA

SEQ ID NO: 12941 - DNA, 30 bp, Homo sapiens
  misc_feature 1..30: note = chr18:903814-903844
  misc_feature 1..30: note = hyper
  source 1..30: mol_type = genomic DNA
ccgcaggccgcgctccggaggcagcatgag

SEQ ID NO: 12942 - DNA, 113 bp, Homo sapiens
  misc_feature 1..113: note = chr18:904563-904676
  misc_feature 1..113: note = hyper
  source 1..113: mol_type = genomic DNA
agcttcagaggcagccggagagacctcggagcagagaaggcgccgccgaccctcgcggctgcctggcccgcggctcctacaaaggcgggctagccgcccgccctctcccttgc

SEQ ID NO: 12943 - DNA, 55 bp, Homo sapiens
  misc_feature 1..55: note = chr18:905713-905768
  misc_feature 1..55: note = hyper
  source 1..55: mol_type = genomic DNA
ggcagctcagggtcccgggtagagccagtgagcttctggccgctggagaaccccc

SEQ ID NO: 12944 - DNA, 232 bp, Homo sapiens
  misc_feature 1..232: note = chr18:906208-906440
  misc_feature 1..232: note = hyper
  source 1..232: mol_type = genomic DNA
cagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacatta

SEQ ID NO: 12945 - DNA, 171 bp, Homo sapiens; identical to SEQ ID NO: 4516
  misc_feature 1..171: note = chr18:906736-906907
  misc_feature 1..171: note = hyper
  source 1..171: mol_type = genomic DNA

SEQ ID NO: 12946 - DNA, 305 bp, Homo sapiens
  misc_feature 1..305: note = chr18:907314-907619
  misc_feature 1..305: note = hyper
  source 1..305: mol_type = genomic DNA
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggtaggagtggttgggtgtcgttgcctcctccttacctctgctcccacccccagtcctgggagaagagacaattctcagcggaggacttttatcacctgtgaaaatccgcgcgagccccttactttggatcctcgccgagctggggaggaa

SEQ ID NO: 12947 - DNA, 34 bp, Homo sapiens
  misc_feature 1..34: note = chr18:907943-907977
  misc_feature 1..34: note = hyper
  source 1..34: mol_type = genomic DNA
acagaaaatcagcagcgggcgggtctgtgtggac

SEQ ID NO: 12948 - DNA, 87 bp, Homo sapiens
  misc_feature 1..87: note = chr18:908432-908519
  misc_feature 1..87: note = hyper
  source 1..87: mol_type = genomic DNA
gcggcggtgggtgcccgtgggggccagggtgagtctgcgcccctgggtctggggtgggcatccgccacgggtcgcagttggagattt

SEQ ID NO: 12949 - DNA, 106 bp, Homo sapiens
  misc_feature 1..106: note = chr18:909183-909289
  misc_feature 1..106: note = hyper
  source 1..106: mol_type = genomic DNA
cgtcgcctgcccggatcttatcccgggccccctccgcagggtttggtgccaggagatcctgcgtggggaggggggcatcgaggggctgccgtctcggccctcccca

SEQ ID NO: 12950 - DNA, 414 bp, Homo sapiens
  misc_feature 1..414: note = chr18:909318-909732
  misc_feature 1..414: note = hyper
  source 1..414: mol_type = genomic DNA
cggtgggcagtgcgagccccgggccctccccgaaggctcccgcgtggggtggggcccgcctgctccccgcggcgattgaacctgtgtctcccgccccgccaccctcttcccgacccctttgcttgcagtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatcca

SEQ ID NO: 12951 - DNA, 30 bp, Homo sapiens
  misc_feature 1..30: note = chr18:961954-961984
  misc_feature 1..30: note = hyper
  source 1..30: mol_type = genomic DNA
tttcttccttcagggcgctagggacaccac

SEQ ID NO: 12952 - DNA, 134 bp, Homo sapiens
  misc_feature 1..134: note = chr18:2847537-2847671
  misc_feature 1..134: note = hyper
  source 1..134: mol_type = genomic DNA
cgggcgatccgaaaacgactcccaggaattccatgagcccctgggaccatgggtgcttttctttcccgtcttggtcgggtccaggcgcgcgctctccagaggcgcacccgggcaccctccggcgtctgctcggt

SEQ ID NO: 12953 - DNA, 60 bp, Homo sapiens
  misc_feature 1..60: note = chr18:2848078-2848138
  misc_feature 1..60: note = hyper
  source 1..60: mol_type = genomic DNA
gcggggcaccggccacgctgggctatttagggagtgggtgctgcccgagtgagtggggag

SEQ ID NO: 12954 - DNA, 270 bp, Homo sapiens; identical to SEQ ID NO: 4517
  misc_feature 1..270: note = chr18:3499101-3499371
  misc_feature 1..270: note = hyper
  source 1..270: mol_type = genomic DNA

SEQ ID NO: 12955 - DNA, 15 bp, Homo sapiens
  misc_feature 1..15: note = chr18:5196244-5196259
  misc_feature 1..15: note = hyper
  source 1..15: mol_type = genomic DNA
gtcggacgttcacaa

SEQ ID NO: 12956 - DNA, 68 bp, Homo sapiens; identical to SEQ ID NO: 4518
  misc_feature 1..68: note = chr18:5196575-5196643
  misc_feature 1..68: note = hyper
  source 1..68: mol_type = genomic DNA

SEQ ID NO: 12957 - DNA, 90 bp, Homo sapiens
  misc_feature 1..90: note = chr18:5196858-5196948
  misc_feature 1..90: note = hyper
  source 1..90: mol_type = genomic DNA
gactggggagaggggcgaaggcgacgcgccgaggcactcctccgccccatgagcacagacagtaactccgaaacgcgcagatgggccgta

SEQ ID NO: 12958 - DNA, 70 bp, Homo sapiens
  misc_feature 1..70: note = chr18:5197202-5197272
  misc_feature 1..70: note = hyper
  source 1..70: mol_type = genomic DNA
gctagatcctggggccgcagctccagccgccgccgcgcgctctgcctccacaatgcggccacagcggcgg

SEQ ID NO: 12959 - DNA, 430 bp, Homo sapiens
  misc_feature 1..430: note = chr18:5197329-5197759
  misc_feature 1..430: note = hyper
  source 1..430: mol_type = genomic DNA
cgacgtacactgctgcttagggagcaaagcacttccaccgctttcacgcgacgaaggtcggaagagcaagagagagaaaggtaaacttcccggcaggggacagtgaattgcttttaattacctgctgtggctcgtcgccgtggatattggactgacatttaagatagatttgtcaaaaaaaaaaaactctaagagctttctttactctcgaggatgactctgagttctccgagttgggctggctcgaatagaggggcgggtctgtcaagttaataggtcctggaggtccgtgagtcctctctcgcgagtcccagtcctctgctaacgtcaggaagagagcaagaggaaggacacagtgactatggagcgctcgaggagggcgctactatcaggttccgctcccaggtggcaaatccggctctgaaagctc

SEQ ID NO: 12960 - DNA, 173 bp, Homo sapiens
  misc_feature 1..173: note = chr18:5542985-5543158
  misc_feature 1..173: note = hyper
  source 1..173: mol_type = genomic DNA
tccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccc

SEQ ID NO: 12961 - DNA, 30 bp, Homo sapiens
  misc_feature 1..30: note = chr18:5544135-5544165
  misc_feature 1..30: note = hyper
  source 1..30: mol_type = genomic DNA
gcctgccctcccagccgcgggggagggggc

SEQ ID NO: 12962 - DNA, 97 bp, Homo sapiens
  misc_feature 1..97: note = chr18:5628134-5628231
  misc_feature 1..97: note = hyper
  source 1..97: mol_type = genomic DNA
gaggggcaagtcttgcggggcccgtcggtaactgccattatttgaatgcgatataggagatcccacatagaccctgctctaccgggttagaatctgt

SEQ ID NO: 12963 - DNA, 522 bp, Homo sapiens
  misc_feature 1..522: note = chr18:5628849-5629371
  misc_feature 1..522: note = hyper
  source 1..522: mol_type = genomic DNA
cctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgc

SEQ ID NO: 12964 - DNA, 40 bp, Homo sapiens
  misc_feature 1..40: note = chr18:5629372-5629412
  misc_feature 1..40: note = hyper
  source 1..40: mol_type = genomic DNA
cctctgcctcccggaggatcgcactcgctcatccttacac

SEQ ID NO: 12965 - DNA, 26 bp, Homo sapiens
  misc_feature 1..26: note = chr18:5629800-5629826
  misc_feature 1..26: note = hyper
  source 1..26: mol_type = genomic DNA
agccagaccccaggtcgctccaactc

SEQ ID NO: 12966 - DNA, 371 bp, Homo sapiens
  misc_feature 1..371: note = chr18:5630262-5630633
  misc_feature 1..371: note = hyper
  source 1..371: mol_type = genomic DNA
ctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagtt

SEQ ID NO: 12967 - DNA, 486 bp, Homo sapiens
  misc_feature 1..486: note = chr18:5895017-5895503
  misc_feature 1..486: note = hyper
  source 1..486: mol_type = genomic DNA
cgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacaca

SEQ ID NO: 12968 - DNA, 30 bp, Homo sapiens
  misc_feature 1..30: note = chr18:5896006-5896036
  misc_feature 1..30: note = hyper
  source 1..30: mol_type = genomic DNA
tactcctcggcacggcgcagcctgggctct

SEQ ID NO: 12969 - DNA, 41 bp, Homo sapiens
  misc_feature 1..41: note = chr18:6730009-6730050
  misc_feature 1..41: note = hyper
  source 1..41: mol_type = genomic DNA
cgccttgtgcctgagcgcacgaccgccgtcactggatgttg

SEQ ID NO: 12970 - DNA, 115 bp, Homo sapiens
  misc_feature 1..115: note = chr18:7117059-7117174
  misc_feature 1..115: note = hyper
  source 1..115: mol_type = genomic DNA
cgcctgcgggtccccctgcccgggacggctggctaggggcgcccttctcgccgcgtctctccccactagcccgcttggctgccaggggccccgaggaatccgccctttcccggcc

SEQ ID NO: 12971 - skipped

SEQ ID NO: 12972 - DNA, 149 bp, Homo sapiens
  misc_feature 1..149: note = chr18:7117942-7118091
  misc_feature 1..149: note = hyper
  source 1..149: mol_type = genomic DNA
ttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattc

SEQ ID NO: 12973 - DNA, 46 bp, Homo sapiens
  misc_feature 1..46: note = chr18:7118131-7118177
  misc_feature 1..46: note = hyper
  source 1..46: mol_type = genomic DNA
cggccctgcagtccccgggccaggacccacgcgcccctgccaggag

SEQ ID NO: 12974 - DNA, 46 bp, Homo sapiens
  misc_feature 1..46: note = chr18:7566590-7566636
  misc_feature 1..46: note = hyper
  source 1..46: mol_type = genomic DNA
gcccacacgggacaccgaggcatgatgaggacgcagaacagcagaa

SEQ ID NO: 12975 - DNA, 276 bp, Homo sapiens
  misc_feature 1..276: note = chr18:7567754-7568030
  misc_feature 1..276: note = hyper
  source 1..276: mol_type = genomic DNA
ccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctg

SEQ ID NO: 12976 - DNA, 110 bp, Homo sapiens
  misc_feature 1..110: note = chr18:7568429-7568539
  misc_feature 1..110: note = hyper
  source 1..110: mol_type = genomic DNA
cgcggctggcgaccccgggaggtccccgcggtcgtgcagcgtctgcggagaggctggggggagttcctcgccggtcccagcggtagggcttggcggccgcggagggaagc

SEQ ID NO: 12977 - DNA, 75 bp, Homo sapiens
  misc_feature 1..75: note = chr18:7568540-7568615
  misc_feature 1..75: note = hyper
  source 1..75: mol_type = genomic DNA
ggcaggtccccaggccctggccacggccctgcgccccgctgggctccccctccccaccctcgtccccctagcgga

SEQ ID NO: 12978 - DNA, 44 bp, Homo sapiens
  misc_feature 1..44: note = chr18:8608938-8608982
  misc_feature 1..44: note = hyper
  source 1..44: mol_type = genomic DNA
gcgttccagctacaccgagcgcgcgggggcgaaaacatgtgcat

SEQ ID NO: 12979 - DNA, 255 bp, Homo sapiens
  misc_feature 1..255: note = chr18:9709069-9709324
  misc_feature 1..255: note = hyper
  source 1..255: mol_type = genomic DNA
caaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattc

SEQ ID NO: 12980 - DNA, 30 bp, Homo sapiens
  misc_feature 1..30: note = chr18:9771739-9771769
  misc_feature 1..30: note = hyper
  source 1..30: mol_type = genomic DNA
gggtcagagaggattcgatggtggtgttct

SEQ ID NO: 12981 - DNA, 114 bp, Homo sapiens
  misc_feature 1..114: note = chr18:10455030-10455144
  misc_feature 1..114: note = hyper
  source 1..114: mol_type = genomic DNA
ttcacggtgagttcccgagggccactcgagcgctcccagccggcggaggcagcccgggcgccgcggagcccgcggaggcgtcgggtctggatcgcggcacggcctacactgtcc

SEQ ID NO: 12982 - DNA, 334 bp, Homo sapiens
  misc_feature 1..334: note = chr18:11148760-11149094
  misc_feature 1..334: note = hyper
  source 1..334: mol_type = genomic DNA
ctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaaagggggcaagaagggcgtgctgtgctcccgcctggctcccggggcgtcgtttgggggcggccggggagttttctacttggaagcccctctgaagccaccgcgtctcctttgcccggcctcgtctc

SEQ ID NO: 12983 - DNA, 128 bp, Homo sapiens
  misc_feature 1..128: note = chr18:11149115-11149243
  misc_feature 1..128: note = hyper
  source 1..128: mol_type = genomic DNA
cgctctggcctcggccccggctctcggagctgcccggcgggctccgggtctcgccctccagcccccaggcggcccgcggcggatccccgagaggcagcgcagctcagcccctgcgccccccagcttcg

SEQ ID NO: 12984 - DNA, 199 bp, Homo sapiens; identical to SEQ ID NO: 4519
  misc_feature 1..199: note = chr18:11149561-11149760
  misc_feature 1..199: note = hyper
  source 1..199: mol_type = genomic DNA

SEQ ID NO: 12985 - DNA, 52 bp, Homo sapiens; identical to SEQ ID NO: 4520
  misc_feature 1..52: note = chr18:11149779-11149831
  misc_feature 1..52: note = hyper
  source 1..52: mol_type = genomic DNA

SEQ ID NO: 12986 - DNA, 63 bp, Homo sapiens
  misc_feature 1..63: note = chr18:11751569-11751632
  misc_feature 1..63: note = hyper
  source 1..63: mol_type = genomic DNA
cgccaggagcagggacgcgtccgagccaacacggggcgcgcgcccagacgcactttcccggct

SEQ ID NO: 12987 - DNA, 252 bp, Homo sapiens; identical to SEQ ID NO: 4521
  misc_feature 1..252: note = chr18:11752127-11752379
  misc_feature 1..252: note = hyper
  source 1..252: mol_type = genomic DNA

SEQ ID NO: 12988 - skipped

SEQ ID NO: 12989 - DNA, 90 bp, Homo sapiens; identical to SEQ ID NO: 4523
  misc_feature 1..90: note = chr18:11752640-11752730
  misc_feature 1..90: note = hyper
  source 1..90: mol_type = genomic DNA

SEQ ID NO: 12990 - DNA, 123 bp, Homo sapiens
  misc_feature 1..123: note = chr18:11947268-11947391
  misc_feature 1..123: note = hyper
  source 1..123: mol_type = genomic DNA
tagactcaggccagccgctgggcctgggcctgtgtgtccctcaggcggcgacctttggcccacttcaggccggccgtatttaccagcttagaggcgccgcggcgttggcgagtcctttttcac

SEQ ID NO: 12991 - DNA, 35 bp, Homo sapiens
  misc_feature 1..35: note = chr18:12253812-12253847
  misc_feature 1..35: note = hyper
  source 1..35: mol_type = genomic DNA
ggcaggaagcccaggcgcctcggagaacctgaagg

SEQ ID NO: 12992 - DNA, 43 bp, Homo sapiens
  misc_feature 1..43: note = chr18:12254104-12254147
  misc_feature 1..43: note = hyper
  source 1..43: mol_type = genomic DNA
tgaccaaaagagacccggggagcatctgggcttccaaggtcct

SEQ ID NO: 12993 - DNA, 148 bp, Homo sapiens; identical to SEQ ID NO: 4524
  misc_feature 1..148: note = chr18:12254432-12254580
  misc_feature 1..148: note = hyper
  source 1..148: mol_type = genomic DNA

SEQ ID NO: 12994 - DNA, 324 bp, Homo sapiens; identical to SEQ ID NO: 1329
  misc_feature 1..324: note = chr18:12307602-12307926
  misc_feature 1..324: note = hyper
  source 1..324: mol_type = genomic DNA

SEQ ID NO: 12995 - DNA, 350 bp, Homo sapiens; identical to SEQ ID NO: 1330
  misc_feature 1..350: note = chr18:13868570-13868920
  misc_feature 1..350: note = hyper
  source 1..350: mol_type = genomic DNA

SEQ ID NO: 12996 - DNA, 76 bp, Homo sapiens
  misc_feature 1..76: note = chr18:13869161-13869237
  misc_feature 1..76: note = hyper
  source 1..76: mol_type = genomic DNA
agaggaccagagccccgaggccagtcgcccccctcccgcccatccgcccgcccgcccgccacgcagggctgctcta

SEQ ID NO: 12997 - DNA, 25 bp, Homo sapiens
  misc_feature 1..25: note = chr18:15198059-15198084
  misc_feature 1..25: note = hyper
  source 1..25: mol_type = genomic DNA
tagggggcgaaaagacgcaaaaagc

SEQ ID NO: 12998 - DNA, 24 bp, Homo sapiens
  misc_feature 1..24: note = chr18:15198144-15198168
  misc_feature 1..24: note = hyper
  source 1..24: mol_type = genomic DNA
ccggggcggcgggggcaaaaagca

SEQ ID NO: 12999 - DNA, 57 bp, Homo sapiens
  misc_feature 1..57: note = chr18:18821835-18821892
  misc_feature 1..57: note = hyper
  source 1..57: mol_type = genomic DNA
ccccctgtacacccccgcggggctgcgcgttcgtctgtgcggcggggtttgggaatg

SEQ ID NO: 13000 - DNA, 465 bp, Homo sapiens
  misc_feature 1..465: note = chr18:18822107-18822572
  misc_feature 1..465: note = hyper
  source 1..465: mol_type = genomic DNA
agcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacct

SEQ ID NO: 13001 - DNA, 104 bp, Homo sapiens
  misc_feature 1..104: note = chr18:18822829-18822933
  misc_feature 1..104: note = hyper
  source 1..104: mol_type = genomic DNA
gggcgacaggtagggcgccgcggaggtggcggggagaggatggatggagttcagcctgggaaagttgagaacgtccagaggtggctgggcgctcgctcggcgtc

SEQ ID NO: 13002 - DNA, 105 bp, Homo sapiens
  misc_feature 1..105: note = chr18:18823252-18823357
  misc_feature 1..105: note = hyper
  source 1..105: mol_type = genomic DNA
cgcgactcgtttgcccggaactgccgctgcctctaaccgaggctgcgggtcctggagaaactcctcagtcttgcccctttctccggtgaacgtgacggttccaag

SEQ ID NO: 13003 - DNA, 51 bp, Homo sapiens
  misc_feature 1..51: note = chr18:22928965-22929016
  misc_feature 1..51: note = hyper
  source 1..51: mol_type = genomic DNA
aatgctcagaagctgcgagtgaacaaaactgccaatcgtgcaaactttaat

SEQ ID NO: 13004 - DNA, 459 bp, Homo sapiens; identical to SEQ ID NO: 4527
  misc_feature 1..459: note = chr18:22929260-22929719
  misc_feature 1..459: note = hyper
  source 1..459: mol_type = genomic DNA

SEQ ID NO: 13005 - DNA, 357 bp, Homo sapiens; identical to SEQ ID NO: 4528
  misc_feature 1..357: note = chr18:22929926-22930283
  misc_feature 1..357: note = hyper
  source 1..357: mol_type = genomic DNA

SEQ ID NO: 13006 - DNA, 865 bp, Homo sapiens; identical to SEQ ID NO: 4529
  misc_feature 1..865: note = chr18:22930284-22931149
  misc_feature 1..865: note = hyper
  source 1..865: mol_type = genomic DNA

SEQ ID NO: 13007 - DNA, 54 bp, Homo sapiens
  misc_feature 1..54: note = chr18:24128025-24128079
  misc_feature 1..54: note = hyper
  source 1..54: mol_type = genomic DNA
cgtcggggtccagctcggagccgtccccgggcggcccaccgcgggcccggggcg

SEQ ID NO: 13008 - DNA, 138 bp, Homo sapiens
  misc_feature 1..138: note = chr18:24130809-24130947
  misc_feature 1..138: note = hyper
  source 1..138: mol_type = genomic DNA
ccctttgtcctgggacgctcccaggttttcgggccgcggtgcggagaactcaggtgggtgcccggcaagttacctaccaggggctgttcccccgcgaccctcgccataagcgcagggacccgggggccgcgctggctc

SEQ ID NO: 13009 - DNA, 30 bp, Homo sapiens
  misc_feature 1..30: note = chr18:24131157-24131187
  misc_feature 1..30: note = hyper
  source 1..30: mol_type = genomic DNA
acagctcccagttgacgtcaacttatttcc

SEQ ID NO: 13010 - DNA, 30 bp, Homo sapiens
  misc_feature 1..30: note = chr18:24764644-24764674
  misc_feature 1..30: note = hyper
  source 1..30: mol_type = genomic DNA
acaccctggaggacccgacagactggcagc

SEQ ID NO: 13011 - DNA, 53 bp, Homo sapiens
  misc_feature 1..53: note = chr18:25755399-25755452
  misc_feature 1..53: note = hyper
  source 1..53: mol_type = genomic DNA
caaagtgagagagcacgacccgggaggagagcgtggagccgggcagggacagg

SEQ ID NO: 13012 - DNA, 301 bp, Homo sapiens
  misc_feature 1..301: note = chr18:25756685-25756986
  misc_feature 1..301: note = hyper
  source 1..301: mol_type = genomic DNA
cagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 13013 - DNA, 164 bp, Homo sapiens
  misc_feature 1..164: note = chr18:25757274-25757438
  misc_feature 1..164: note = hyper
  source 1..164: mol_type = genomic DNA
aacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggc

SEQ ID NO: 13014 - DNA, 533 bp, Homo sapiens
  misc_feature 1..533: note = chr18:25757439-25757972
  misc_feature 1..533: note = hyper
  source 1..533: mol_type = genomic DNA
ctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgc

SEQ ID NO: 13015 - DNA, 13 bp, Homo sapiens
  misc_feature 1..13: note = chr18:25758128-25758141
  misc_feature 1..13: note = hyper
  source 1..13: mol_type = genomic DNA
cggggggtcgccg

SEQ ID NO: 13016 - DNA, 110 bp, Homo sapiens
  misc_feature 1..110: note = chr18:25758377-25758487
  misc_feature 1..110: note = hyper
  source 1..110: mol_type = genomic DNA
acagcaaactaaggacgcaggccaagctcatcctagctattgttgtctgaggcgctcgccgggagccacctgcgggcgggggagggcggaggccgcggctcctctctgga

SEQ ID NO: 13017 - DNA, 125 bp, Homo sapiens; identical to SEQ ID NO: 4530
  misc_feature 1..125: note = chr18:28620831-28620956
  misc_feature 1..125: note = hyper
  source 1..125: mol_type = genomic DNA

SEQ ID NO: 13018 - DNA, 135 bp, Homo sapiens; identical to SEQ ID NO: 4531
  misc_feature 1..135: note = chr18:28621033-28621168
  misc_feature 1..135: note = hyper
  source 1..135: mol_type = genomic DNA

SEQ ID NO: 13019 - DNA, 279 bp, Homo sapiens; identical to SEQ ID NO: 4532
  misc_feature 1..279: note = chr18:28621709-28621988
  misc_feature 1..279: note = hyper
  source 1..279: mol_type = genomic DNA

SEQ ID NO: 13020 - DNA, 242 bp, Homo sapiens
  misc_feature 1..242: note = chr18:28622475-28622717
  misc_feature 1..242: note = hyper
  source 1..242: mol_type = genomic DNA
ctttgtccccagctccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttc

SEQ ID NO: 13021 - DNA, 30 bp, Homo sapiens
  misc_feature 1..30: note = chr18:30349740-30349770
  misc_feature 1..30: note = hyper
  source 1..30: mol_type = genomic DNA
gggccgggatgagggcgaagcggaggcgct

SEQ ID NO: 13022 - DNA, 155 bp, Homo sapiens
  misc_feature 1..155: note = chr18:30350080-30350235
  misc_feature 1..155: note = hyper
  source 1..155: mol_type = genomic DNA
cagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaag

SEQ ID NO: 13023 - DNA, 63 bp, Homo sapiens; identical to SEQ ID NO: 4533
  misc_feature 1..63: note = chr18:31020448-31020511
  misc_feature 1..63: note = hyper
  source 1..63: mol_type = genomic DNA

SEQ ID NO: 13024 - DNA, 526 bp, Homo sapiens; identical to SEQ ID NO: 1331
  misc_feature 1..526: note = chr18:31739116-31739642
  misc_feature 1..526: note = hyper
  source 1..526: mol_type = genomic DNA

SEQ ID NO: 13025 - DNA, 41 bp, Homo sapiens
  misc_feature 1..41: note = chr18:31802052-31802093
  misc_feature 1..41: note = hyper
  source 1..41: mol_type = genomic DNA
tcttgtgaagaaaatcgacgctgctgcggctccccagcccc

SEQ ID NO: 13026 - DNA, 257 bp, Homo sapiens
  misc_feature 1..257: note = chr18:31802831-31803088
  misc_feature 1..257: note = hyper
  source 1..257: mol_type = genomic DNA
aaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactc

SEQ ID NO: 13027 - DNA, 127 bp, Homo sapiens
  misc_feature 1..127: note = chr18:31803369-31803496
  misc_feature 1..127: note = hyper
  source 1..127: mol_type = genomic DNA
gaggggaggagggtccggttgggcaccagcaatcaatgccccgtgctaccaagtctggtccattcgtaattgcaacggctgtctcggacgtttttcctgttcccttagcggtcggtctctttaatat

SEQ ID NO: 13028 - DNA, 76 bp, Homo sapiens
  misc_feature 1..76: note = chr18:32073450-32073526
  misc_feature 1..76: note = hyper
  source 1..76: mol_type = genomic DNA
agtgactgaagcgcccgtccattccaaggtgtgtgcacggcgttttcttctttgacagctccggagtgggggaggg

SEQ ID NO: 13029 - DNA, 79 bp, Homo sapiens
  misc_feature 1..79: note = chr18:32073746-32073825
  misc_feature 1..79: note = hyper
  source 1..79: mol_type = genomic DNA
agtcaagagtggaagcgggcggagagcgccggcgggggcagggattcgcctcaacgcccactcacggggttcccacctg

SEQ ID NO: 13030 - DNA, 205 bp, Homo sapiens
  misc_feature 1..205: note = chr18:34834309-34834514
  misc_feature 1..205: note = hyper
  source 1..205: mol_type = genomic DNA
gagggggcctggcagcgcgcgggcacagggtgccggcctggggagagagacgagtgcgaggggccgggagggaggcgccgccgagaaacttctccaccgccggcccggccgcccccctcgccaccgcaggtgcccggctgtcggaggaggcccagaggctgagccctcgcgggccctccgcccccactcccggcctctgcccgcc

SEQ ID NO: 13031 - DNA, 122 bp, Homo sapiens; identical to SEQ ID NO: 4535
  misc_feature 1..122: note = chr18:35065024-35065146
  misc_feature 1..122: note = hyper
  source 1..122: mol_type = genomic DNA

SEQ ID NO: 13032 - DNA, 135 bp, Homo sapiens; identical to SEQ ID NO: 4536
  misc_feature 1..135: note = chr18:35065516-35065651
  misc_feature 1..135: note = hyper
  source 1..135: mol_type = genomic DNA

SEQ ID NO: 13033 - DNA, 44 bp, Homo sapiens
  misc_feature 1..44: note = chr18:35104934-35104978
  misc_feature 1..44: note = hyper
  source 1..44: mol_type = genomic DNA
cgccctcggccctccctttcttctctctccgcctgccctcctcc

SEQ ID NO: 13034 - DNA, 117 bp, Homo sapiens
  misc_feature 1..117: note = chr18:35144820-35144937
  misc_feature 1..117: note = hyper
  source 1..117: mol_type = genomic DNA
tctctcccttttagacggctgcgctcctgctactctagcccggagcaaaggatgaggagaccacctcctttagtattttcagcaccacggcgatggacagcaccctcggtcctcggc

SEQ ID NO: 13035 - DNA, 334 bp, Homo sapiens
  misc_feature 1..334: note = chr18:35144968-35145302
  misc_feature 1..334: note = hyper
  source 1..334: mol_type = genomic DNA
cgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggag

SEQ ID NO: 13036 - DNA, 40 bp, Homo sapiens
  misc_feature 1..40: note = chr18:35145558-35145598
  misc_feature 1..40: note = hyper
  source 1..40: mol_type = genomic DNA
cgttgtcagcctgtccgtttgctaacgtggccatctttat

SEQ ID NO: 13037 - DNA, 75 bp, Homo sapiens
  misc_feature 1..75: note = chr18:35146102-35146177
  misc_feature 1..75: note = hyper
  source 1..75: mol_type = genomic DNA
acggcgggcggcggccgggggcagggcggcgtggggcggcggccaccgcgcctcccccgtcggcggccccgcgcc

SEQ ID NO: 13038 - DNA, 55 bp, Homo sapiens
  misc_feature 1..55: note = chr18:35146710-35146765
  misc_feature 1..55: note = hyper
  source 1..55: mol_type = genomic DNA
tttttttttcctcctcgcacccccaacctgccagagcagccccacatcttcctcc

SEQ ID NO: 13039 - skipped

SEQ ID NO: 13040 - DNA, 30 bp, Homo sapiens
  misc_feature 1..30: note = chr18:35147131-35147161
  misc_feature 1..30: note = hyper
  source 1..30: mol_type = genomic DNA
ataaagcccctgaatcgctatctgggttgc

SEQ ID NO: 13041 - DNA, 53 bp, Homo sapiens
  misc_feature 1..53: note = chr18:43913567-43913620
  misc_feature 1..53: note = hyper
  source 1..53: mol_type = genomic DNA
gcgccagcctccgagcgcacgtccccgagtgacccgtgcgcggtgtgcaggga

SEQ ID NO: 13042 - DNA, 228 bp, Homo sapiens
  misc_feature 1..228: note = chr18:43914398-43914626
  misc_feature 1..228: note = hyper
  source 1..228: mol_type = genomic DNA
cgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagat

SEQ ID NO: 13043 - DNA, 262 bp, Homo sapiens; identical to SEQ ID NO: 1332
  misc_feature 1..262: note = chr18:44336188-44336450
  misc_feature 1..262: note = hyper
  source 1..262: mol_type = genomic DNA

SEQ ID NO: 13044 - DNA, 164 bp, Homo sapiens; identical to SEQ ID NO: 1333
  misc_feature 1..164: note = chr18:44337012-44337176
  misc_feature 1..164: note = hyper
  source 1..164: mol_type = genomic DNA

SEQ ID NO: 13045 - DNA, 202 bp, Homo sapiens; identical to SEQ ID NO: 1334
  misc_feature 1..202: note = chr18:44337416-44337618
  misc_feature 1..202: note = hyper
  source 1..202: mol_type = genomic DNA

SEQ ID NO: 13046 - DNA, 193 bp, Homo sapiens; identical to SEQ ID NO: 1335
  misc_feature 1..193: note = chr18:44337649-44337842
  misc_feature 1..193: note = hyper
  source 1..193: mol_type = genomic DNA

SEQ ID NO: 13047 - DNA, 140 bp, Homo sapiens; identical to SEQ ID NO: 1336
  misc_feature 1..140: note = chr18:44772977-44773117
  misc_feature 1..140: note = hyper
  source 1..140: mol_type = genomic DNA

SEQ ID NO: 13048 - DNA, 501 bp, Homo sapiens; identical to SEQ ID NO: 1337
  misc_feature 1..501: note = chr18:44773466-44773967
  misc_feature 1..501: note = hyper
  source 1..501: mol_type = genomic DNA

SEQ ID NO: 13049 - DNA, 59 bp, Homo sapiens
  misc_feature 1..59: note = chr18:44774406-44774465
  misc_feature 1..59: note = hyper
  source 1..59: mol_type = genomic DNA
atgactgggtagctgcgcgggcctttggcccctgccccggcacccgcccccgcgcccgc

SEQ ID NO: 13050 - DNA, 94 bp, Homo sapiens
  misc_feature 1..94: note = chr18:44775481-44775575
  misc_feature 1..94: note = hyper
  source 1..94: mol_type = genomic DNA
tgtcgggctggaaggcgctcgacggcgacgccagcaggatgtcgttgggccctggcagcggactggaagccatctccgccgcagaaccccgggc

SEQ ID NO: 13051 - DNA, 50 bp, Homo sapiens
  misc_feature 1..50: note = chr18:44777700-44777750
  misc_feature 1..50: note = hyper
  source 1..50: mol_type = genomic DNA
cagcaagctgtgtgccggattggggcggccggttccggcaatacctggta

SEQ ID NO: 13052 - DNA, 277 bp, Homo sapiens; identical to SEQ ID NO: 4543
  misc_feature 1..277: note = chr18:44778049-44778326
  misc_feature 1..277: note = hyper
  source 1..277: mol_type = genomic DNA

SEQ ID NO: 13053 - DNA, 51 bp, Homo sapiens
  misc_feature 1..51: note = chr18:44780673-44780724
  misc_feature 1..51: note = hyper
  source 1..51: mol_type = genomic DNA
caatgctttcctcttcgagctgacatgcattttacacgtcaggactctcct

SEQ ID NO: 13054 - DNA, 38 bp, Homo sapiens
  misc_feature 1..38: note = chr18:44781003-44781041
  misc_feature 1..38: note = hyper
  source 1..38: mol_type = genomic DNA
gttgaagagaacccacgctcagccgggcctgggcccag

SEQ ID NO: 13055 - DNA, 179 bp, Homo sapiens
  misc_feature 1..179: note = chr18:44786934-44787113
  misc_feature 1..179: note = hyper
  source 1..179: mol_type = genomic DNA
tgagctagggagctgcgggctgcggaggttcaggggcaaaaatctggatgctgtcctaagctagggagccgctttccacagcgtctccaaaaagtctagtttgccttctctccctagctctcttcatatcccccccaaccccccgcccacaagtgacaccagaacgttgtaaccaaaaa

SEQ ID NO: 13056 - DNA, 68 bp, Homo sapiens; identical to SEQ ID NO: 4544
  misc_feature 1..68: note = chr18:44787746-44787814
  misc_feature 1..68: note = hyper
  source 1..68: mol_type = genomic DNA

SEQ ID NO: 13057 - DNA, 98 bp, Homo sapiens; identical to SEQ ID NO: 4545
  misc_feature 1..98: note = chr18:44789865-44789963
  misc_feature 1..98: note = hyper
  source 1..98: mol_type = genomic DNA

SEQ ID NO: 13058 - DNA, 157 bp, Homo sapiens
  misc_feature 1..157: note = chr18:45058076-45058233
  misc_feature 1..157: note = hyper
  source 1..157: mol_type = genomic DNA
aatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtc

SEQ ID NO: 13059 - DNA, 30 bp, Homo sapiens
  misc_feature 1..30: note = chr18:45663049-45663079
  misc_feature 1..30: note = hyper
  source 1..30: mol_type = genomic DNA
gcaatggggcagtggcgagagttgctctct

SEQ ID NO: 13060 - DNA, 30 bp, Homo sapiens
  misc_feature 1..30: note = chr18:47088076-47088106
  misc_feature 1..30: note = hyper
  source 1..30: mol_type = genomic DNA
cgcctccccagcggacgcagagtttcaggg

SEQ ID NO: 13061 - DNA, 42 bp, Homo sapiens
  misc_feature 1..42: note = chr18:47339612-47339654
  misc_feature 1..42: note = hyper
  source 1..42: mol_type = genomic DNA
aaattgcaccgaaatcgctgtcgctagcgccttacaagtaag

SEQ ID NO: 13062 - DNA, 76 bp, Homo sapiens; identical to SEQ ID NO: 4546
  misc_feature 1..76: note = chr18:49867303-49867379
  misc_feature 1..76: note = hyper
  source 1..76: mol_type = genomic DNA

SEQ ID NO: 13063 - DNA, 52 bp, Homo sapiens
  misc_feature 1..52: note = chr18:52989207-52989259
  misc_feature 1..52: note = hyper
  source 1..52: mol_type = genomic DNA
aaatcctaatgcatacgcgagatcgattcaacttttccgaggggtttttatt

SEQ ID NO: 13064 - DNA, 139 bp, Homo sapiens; identical to SEQ ID NO: 4547
  misc_feature 1..139: note = chr18:52989807-52989946
  misc_feature 1..139: note = hyper
  source 1..139: mol_type = genomic DNA

SEQ ID NO: 13065 - DNA, 30 bp, Homo sapiens
  misc_feature 1..30: note = chr18:53254709-53254739
  misc_feature 1..30: note = hyper
  source 1..30: mol_type = genomic DNA
caacaggaggtagagcgagaaatgaatgga

SEQ ID NO: 13066 - DNA, 874 bp, Homo sapiens
  misc_feature 1..874: note = chr18:53255143-53256017
  misc_feature 1..874: note = hyper
  source 1..874: mol_type = genomic DNA
gggagcgccgggcgccgggagcccgcggcgcgggaggcgcggagccgcgtgcggggccgccgagcccgaaccccgcgccgccgggcgcctccgccccgccgagccccgcaggcgccggtacctaccgcccgcgcgcgagaaggggctctccgtgcaccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaaggggggagggggaaacacgccgaggcgcacggaattgcaagttcagcaaagaaatgggtgggggggctccggcggggagacgcgacttgctccgggtcgggcaggctaggatgcatccccctcgcacccaccccgaggggaaaaaaaaaaaatctcaacacctcccccgcctcgccaaaaaatacaaacgaaaattcatcgagcacctcatttttcctcagatcgtcagttacaatctgaagcctgaacagttcagtttttgcccgttgcatccctcggaggcactttgaaatttattcgagtttacatcccctcacttctttctttctcttactctcgttccctctcactcacacatccacacacggcaaagcaagtttatactaggctgcaaatacacgtgatgcaaaaagactttgccaagaggaacaatatttttctttttcgtctataaatcaagccacattttcctggggagattttcgtttcggtagttttgcgttgggggcgaaatctgaattgc

SEQ ID NO: 13067 - DNA, 361 bp, Homo sapiens; identical to SEQ ID NO: 4548
  misc_feature 1..361: note = chr18:53256942-53257303
  misc_feature 1..361: note = hyper
  source 1..361: mol_type = genomic DNA

SEQ ID NO: 13068 - DNA, 609 bp, Homo sapiens; identical to SEQ ID NO: 1338
  misc_feature 1..609: note = chr18:53446866-53447475
  misc_feature 1..609: note = hyper
  source 1..609: mol_type = genomic DNA

SEQ ID NO: 13069 - DNA, 57 bp, Homo sapiens; identical to SEQ ID NO: 1339
  misc_feature 1..57: note = chr18:53447798-53447855
  misc_feature 1..57: note = hyper
  source 1..57: mol_type = genomic DNA

SEQ ID NO: 13070 - DNA, 30 bp, Homo sapiens
  misc_feature 1..30: note = chr18:54789055-54789085
  misc_feature 1..30: note = hyper
  source 1..30: mol_type = genomic DNA
agcgtggcctgagcccggtcagcggccggg

SEQ ID NO: 13071 - DNA, 102 bp, Homo sapiens; identical to SEQ ID NO: 4551
  misc_feature 1..102: note = chr18:55020597-55020699
  misc_feature 1..102: note = hyper
  source 1..102: mol_type = genomic DNA

SEQ ID NO: 13072 - DNA, 141 bp, Homo sapiens; identical to SEQ ID NO: 4552
  misc_feature 1..141: note = chr18:55020804-55020945
  misc_feature 1..141: note = hyper
  source 1..141: mol_type = genomic DNA

SEQ ID NO: 13073 - DNA, 277 bp, Homo sapiens; identical to SEQ ID NO: 4553
  misc_feature 1..277: note = chr18:55020965-55021242
  misc_feature 1..277: note = hyper
  source 1..277: mol_type = genomic DNA

SEQ ID NO: 13074 - DNA, 32 bp, Homo sapiens
  misc_feature 1..32: note = chr18:55105140-55105172
  misc_feature 1..32: note = hyper
  source 1..32: mol_type = genomic DNA
cgggcgctgattgtgcgcgcctggcgaccgcg

SEQ ID NO: 13075 - DNA, 102 bp, Homo sapiens
  misc_feature 1..102: note = chr18:55105728-55105830
  misc_feature 1..102: note = hyper
  source 1..102: mol_type = genomic DNA
cttgtggggtgcactcgaccaacgcccgacagggctggggaatgtgacaggcagcaggttcacccgggcttggggagggggagtttccgctttgacagcatt

SEQ ID NO: 13076 - DNA, 30 bp, Homo sapiens
  misc_feature 1..30: note = chr18:55106031-55106061
  misc_feature 1..30: note = hyper
  source 1..30: mol_type = genomic DNA
gatttgctgttggttcggggcaagataaag

SEQ ID NO: 13077 - DNA, 260 bp, Homo sapiens
  misc_feature 1..260: note = chr18:56887076-56887336
  misc_feature 1..260: note = hyper
  source 1..260: mol_type = genomic DNA
agctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagcccc

SEQ ID NO: 13078 - DNA, 46 bp, Homo sapiens
  misc_feature 1..46: note = chr18:56887753-56887799
  misc_feature 1..46: note = hyper
  source 1..46: mol_type = genomic DNA
ttgtgacctttctatcggcaaacaccttccccgttctcctaaaact

SEQ ID NO: 13079 - DNA, 30 bp, Homo sapiens
  misc_feature 1..30: note = chr18:56888148-56888178
  misc_feature 1..30: note = hyper
  source 1..30: mol_type = genomic DNA
agggtgcagcgctcccgccccgggtttcac

SEQ ID NO: 13080 - DNA, 133 bp, Homo sapiens; identical to SEQ ID NO: 4554
  misc_feature 1..133: note = chr18:56888490-56888623
  misc_feature 1..133: note = hyper
  source 1..133: mol_type = genomic DNA

SEQ ID NO: 13081 - DNA, 92 bp, Homo sapiens
  misc_feature 1..92: note = chr18:56931541-56931633
  misc_feature 1..92: note = hyper
  source 1..92: mol_type = genomic DNA
atcaaatgctgaagccgccaaggctctcgggtccgcacccagggtgccctcaccgtacgccgaccgtgtggggaacacgctctctggaagct

SEQ ID NO: 13082 - DNA, 30 bp, Homo sapiens
  misc_feature 1..30: note = chr18:56933063-56933093
  misc_feature 1..30: note = hyper
  source 1..30: mol_type = genomic DNA
gtgcttggagcagcacggtgccttttcttc

SEQ ID NO: 13083 - DNA, 363 bp, Homo sapiens; identical to SEQ ID NO: 4555
  misc_feature 1..363: note = chr18:56934956-56935319
  misc_feature 1..363: note = hyper
  source 1..363: mol_type = genomic DNA

SEQ ID NO: 13084 - DNA, 317 bp, Homo sapiens
  misc_feature 1..317: note = chr18:56936333-56936650
  misc_feature 1..317: note = hyper
  source 1..317: mol_type = genomic DNA
gcgggaacttgtccccgaagccgggcccgcacgggtaggagggcggcggcggcgcgagaggttgcaggccggggcccaacggcggggagttcaggaagggcggaggcggcggcggtggcgtgtagctggcaggcaggctctgcgccggcggcccgaagcccggcaggctctgcagcgccgtggcgcccccgcccggcagcggcggcccgagccaggactccagcggcagcgcgcccccagccggcccgccaccgctgcccgggcccgccccgaggggcgacagcgtcgcggagggcggggagcggctgaaggagagg

SEQ ID NO: 13085 - DNA, 154 bp, Homo sapiens; identical to SEQ ID NO: 1340
  misc_feature 1..154: note = chr18:56939498-56939652
  misc_feature 1..154: note = hyper
  source 1..154: mol_type = genomic DNA

SEQ ID NO: 13086 - DNA, 408 bp, Homo sapiens; identical to SEQ ID NO: 1341
  misc_feature 1..408: note = chr18:56939763-56940171
  misc_feature 1..408: note = hyper
  source 1..408: mol_type = genomic DNA

SEQ ID NO: 13087 - DNA, 680 bp, Homo sapiens; identical to SEQ ID NO: 1342
  misc_feature 1..680: note = chr18:56940565-56941245
  misc_feature 1..680: note = hyper
  source 1..680: mol_type = genomic DNA

SEQ ID NO: 13088 - DNA, 240 bp, Homo sapiens; identical to SEQ ID NO: 1343
  misc_feature 1..240: note = chr18:56941557-56941797
  misc_feature 1..240: note = hyper
  source 1..240: mol_type = genomic DNA

SEQ ID NO: 13089 - DNA, 37 bp, Homo sapiens
  misc_feature 1..37: note = chr18:57363706-57363743
  misc_feature 1..37: note = hyper
  source 1..37: mol_type = genomic DNA
caaagattcgcaccgcgcggcacgcacccagcaggtt

SEQ ID NO: 13090 - DNA, 479 bp, Homo sapiens
  misc_feature 1..479: note = chr18:57364448-57364927
  misc_feature 1..479: note = hyper
  source 1..479: mol_type = genomic DNA
gccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctc

SEQ ID NO: 13091 - DNA, 515 bp, Homo sapiens; identical to SEQ ID NO: 4560
  misc_feature 1..515: note = chr18:59000829-59001344
  misc_feature 1..515: note = hyper
  source 1..515: mol_type = genomic DNA

SEQ ID NO: 13092 - DNA, 208 bp, Homo sapiens; identical to SEQ ID NO: 4561
  misc_feature 1..208: note = chr18:59001497-59001705
  misc_feature 1..208: note = hyper
  source 1..208: mol_type = genomic DNA

SEQ ID NO: 13093 - DNA, 235 bp, Homo sapiens; identical to SEQ ID NO: 4562
  misc_feature 1..235: note = chr18:60263660-60263895
  misc_feature 1..235: note = hyper
  source 1..235: mol_type = genomic DNA

SEQ ID NO: 13094 - DNA, 140 bp, Homo sapiens
  misc_feature 1..140: note = chr18:60985592-60985732
  misc_feature 1..140: note = hyper
  source 1..140: mol_type = genomic DNA
cgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggc

SEQ ID NO: 13095 - DNA, 155 bp, Homo sapiens; identical to SEQ ID NO: 4563
  misc_feature 1..155: note = chr18:67067500-67067655
  misc_feature 1..155: note = hyper
  source 1..155: mol_type = genomic DNA

SEQ ID NO: 13096 - DNA, 30 bp, Homo sapiens
  misc_feature 1..30: note = chr18:67067914-67067944
  misc_feature 1..30: note = hyper
  source 1..30: mol_type = genomic DNA
gagccgggtggggagcgggcctcggggcgc

SEQ ID NO: 13097 - DNA, 48 bp, Homo sapiens
  misc_feature 1..48: note = chr18:67068735-67068783
  misc_feature 1..48: note = hyper
  source 1..48: mol_type = genomic DNA
tggggactccaggagcgcctgagtccccatcctcgagtgcaccgggct

SEQ ID NO: 13098 - DNA, 238 bp, Homo sapiens
  misc_feature 1..238: note = chr18:70209148-70209386
  misc_feature 1..238: note = hyper
  source 1..238: mol_type = genomic DNA
ctagggaggaggtgacggcgccgtccgccgacgggctggagtcgcacaccaccaggcacttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccggg

SEQ ID NO: 13099 - DNA, 72 bp, Homo sapiens
  misc_feature 1..72: note = chr18:70209493-70209565
  misc_feature 1..72: note = hyper
  source 1..72: mol_type = genomic DNA
gggggccttcgtccccggctctgacgttcaaggccagggtcgttctcagaagaaaggcgcctgtgaacctgt

SEQ ID NO: 13100 - DNA, 30 bp, Homo sapiens
  misc_feature 1..30: note = chr18:70209822-70209852
  misc_feature 1..30: note = hyper
  source 1..30: mol_type = genomic DNA
cgctaagacgggccccgagaccctcagaag

SEQ ID NO: 13101 - DNA, 50 bp, Homo sapiens
  misc_feature 1..50: note = chr18:70211036-70211086
  misc_feature 1..50: note = hyper
  source 1..50: mol_type = genomic DNA
cccctcgagctcccgcgctcagcgcgtccgcagcgcggctccctcgcggg

SEQ ID NO: 13102 - DNA, 34 bp, Homo sapiens
  misc_feature 1..34: note = chr18:70534282-70534316
  misc_feature 1..34: note = hyper
  source 1..34: mol_type = genomic DNA
gcaggttttgggatccggcgacggctgaccgcgc

SEQ ID NO: 13103 - DNA, 182 bp, Homo sapiens; identical to SEQ ID NO: 1344
  misc_feature 1..182: note = chr18:70535373-70535555
  misc_feature 1..182: note = hyper
  source 1..182: mol_type = genomic DNA

SEQ ID NO: 13104 - DNA, 80 bp, Homo sapiens; identical to SEQ ID NO: 1345
  misc_feature 1..80: note = chr18:70535575-70535655
  misc_feature 1..80: note = hyper
  source 1..80: mol_type = genomic DNA

SEQ ID NO: 13105 - DNA, 113 bp, Homo sapiens
  misc_feature 1..113: note = chr18:70535971-70536084
  misc_feature 1..113: note = hyper
  source 1..113: mol_type = genomic DNA
accccaaggcacacacggacccccgttcccccgcgccacttcctcctacaggctcgcgcggcgcgttaaagtctgggagacacgagttgcggggaaacagcaccggaagagcc

SEQ ID NO: 13106 - DNA, 838 bp, Homo sapiens
  misc_feature 1..838: note = chr18:70536187-70537025
  misc_feature 1..838: note = hyper
  source 1..838: mol_type = genomic DNA
cgccgcaacggcacctcctccctttcccggctccgtcccgccctccctcggcctctgcggacgcgacccacgcagaccacagccgagcccgccggaccccgggactacggaagccatcccgtccggccacccacacccgcgccgcggctggggcttgggttggggactgtggcggcgaagaagccggggtaggaagagctaatggcaatggcggggtcgccggggggcggggggtcagcagcagacgctgagctgtgaagactagggtggccccgaaaggccgaggaaaggagaaagggccatgagaagagtctggcgagcgctcgaggccggggggctgcctcccggctctggcccggcctccgcttcccggcacctgctgctggggcgcccacgtgcgcgcggggctgcgcggggcgttgggtgctcgtcgcagtcctgcccacgcctagcgcagcggctgtgagtgggtggaggtctcctgccagtaagttgggatgagggacgatgaggtgacccccaagtctggaagggattcagagtctcacacgcgcccccaagcctcctaccaccacaccaaagtgctggttcctcgatttccagggtggggtaaagtgaccgagcaaaggggatggtgtgtttgtgtgtgcgcgcgcatatacgcgcgcgcgtgttgtgcatccgtgtaatgaaagttgggtcatgggtcaacccgggagtagagcgagatggagacctaaagagagaaagctgagagaagggggaagacatggacagggtaagagagagagaaaggagagagagaagaaagggaaaagaggagcggggagagaaaaga

SEQ ID NO: 13107 - DNA, 33 bp, Homo sapiens
  misc_feature 1..33: note = chr18:70537332-70537365
  misc_feature 1..33: note = hyper
  source 1..33: mol_type = genomic DNA
gtggtgggcaatgttcgtcgtggagttgaggaa

SEQ ID NO: 13108 - DNA, 349 bp, Homo sapiens
  misc_feature 1..349: note = chr18:72123440-72123789
  misc_feature 1..349: note = hyper
  source 1..349: mol_type = genomic DNA
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagc

SEQ ID NO: 13109 - DNA, 48 bp, Homo sapiens
  misc_feature 1..48: note = chr18:72124237-72124285
  misc_feature 1..48: note = hyper
  source 1..48: mol_type = genomic DNA
cgggtgtgatcccccctccccggacgcgcggcgcggggcagagcggcg

SEQ ID NO: 13110 - DNA, 32 bp, Homo sapiens
  misc_feature 1..32: note = chr18:73167800-73167832
  misc_feature 1..32: note = hyper
  source 1..32: mol_type = genomic DNA
gcgcgcagcgggggccgcgtgatggatgggcc

SEQ ID NO: 13111 - DNA, 30 bp, Homo sapiens
  misc_feature 1..30: note = chr18:73628019-73628049
  misc_feature 1..30: note = hyper
  source 1..30: mol_type = genomic DNA
aggccagttaggccgcgaagctttgccaaa

SEQ ID NO: 13112 - DNA, 47 bp, Homo sapiens
  misc_feature 1..47: note = chr18:73628494-73628541
  misc_feature 1..47: note = hyper
  source 1..47: mol_type = genomic DNA
ggaggagcctgagggccaagagggccggcgcgcggtgggcgcggcct

SEQ ID NO: 13113 - DNA, 264 bp, Homo sapiens; identical to SEQ ID NO: 4566
  misc_feature 1..264: note = chr18:74961385-74961649
  misc_feature 1..264: note = hyper
  source 1..264: mol_type = genomic DNA

SEQ ID NO: 13114 - DNA, 72 bp, Homo sapiens
  misc_feature 1..72: note = chr18:74961884-74961956
  misc_feature 1..72: note = hyper
  source 1..72: mol_type = genomic DNA
gccctgtggacgactcggaatccctggaaaagccgggagggagtcggaggcgccagcccactggggaggtgg

SEQ ID NO: 13115 - DNA, 106 bp, Homo sapiens
  misc_feature 1..106: note = chr18:74962836-74962942
  misc_feature 1..106: note = hyper
  source 1..106: mol_type = genomic DNA
ccactacttcttcaccgtgtccatgctggtgagcatcttcaccctggccgcgatgtccgtggaccgctacgtggccatcgtgcactcgcggcgctcctcctccctc

SEQ ID NO: 13116 - DNA, 143 bp, Homo sapiens
  misc_feature 1..143: note = chr18:75362885-75363028
  misc_feature 1..143: note = hyper
  source 1..143: mol_type = genomic DNA
tgccggccatgccctcggctcctctcccgacacgcgccagcactgccccctgctggcctcccgggagcactgcccgctgccgcggcgggaggagacccgggaagaagccgggaccgcgagcagctggacgctttctccctggg

SEQ ID NO: 13117 - DNA, 245 bp, Homo sapiens
  misc_feature 1..245: note = chr18:75612186-75612431
  misc_feature 1..245: note = hyper
  source 1..245: mol_type = genomic DNA
ctgcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgc

SEQ ID NO: 13118 - DNA, 235 bp, Homo sapiens
  misc_feature 1..235: note = chr18:77153209-77153444
  misc_feature 1..235: note = hyper
  source 1..235: mol_type = genomic DNA
gtggcatctggcctgcggttcagtagggggaggaaagggtgggcgcacctgcccctggctggcgcacctgccaggtagccccacgcggcaccgcgtgtgccgagcgcccctgaggatggaaagccccacgcggggcaggtggcacccaccctccgaagacgggacgggatggagcgttgagcttcggggcagctccggcccggcccgcgctggagacgcccgcatctgccaggat

SEQ ID NO: 13119 - DNA, 119 bp, Homo sapiens
  misc_feature 1..119: note = chr18:77159847-77159966
  misc_feature 1..119: note = hyper
  source 1..119: mol_type = genomic DNA
tagcgttggcggcctcgggctgggacctccccactcccggggctccgcagggcgcgcacgtggcgctcgggggtcaccgttgcagccgctttcccgaggaggcccggattgaaaacttc

SEQ ID NO: 13120 - DNA, 78 bp, Homo sapiens; identical to SEQ ID NO: 1346
  misc_feature 1..78: note = chr18:77547970-77548048
  misc_feature 1..78: note = hyper
  source 1..78: mol_type = genomic DNA

SEQ ID NO: 13121 - DNA, 258 bp, Homo sapiens; identical to SEQ ID NO: 1347
  misc_feature 1..258: note = chr18:77548351-77548609
  misc_feature 1..258: note = hyper
  source 1..258: mol_type = genomic DNA

SEQ ID NO: 13122 - DNA, 415 bp, Homo sapiens; identical to SEQ ID NO: 1348
  misc_feature 1..415: note = chr18:77557982-77558397
  misc_feature 1..415: note = hyper
  source 1..415: mol_type = genomic DNA

SEQ ID NO: 13123 - DNA, 726 bp, Homo sapiens; identical to SEQ ID NO: 1349
  misc_feature 1..726: note = chr18:77558416-77559142
  misc_feature 1..726: note = hyper
  source 1..726: mol_type = genomic DNA

SEQ ID NO: 13124 - DNA, 40 bp, Homo sapiens
  misc_feature 1..40: note = chr19:591461-591501
  misc_feature 1..40: note = hyper
  source 1..40: mol_type = genomic DNA
gggcgtgcgcgtgtacgcccggggccggtgtgcaccggtg

SEQ ID NO: 13125 - DNA, 46 bp, Homo sapiens
  misc_feature 1..46: note = chr19:1401751-1401797
  misc_feature 1..46: note = hyper
  source 1..46: mol_type = genomic DNA
ggggactggaatccccgccttgccgcttacgcgccatagattcctc

SEQ ID NO: 13126 - DNA, 245 bp, Homo sapiens
  misc_feature 1..245: note = chr19:1450187-1450432
  misc_feature 1..245: note = hyper
  source 1..245: mol_type = genomic DNA
cccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtcctcggggaggagggcaggggcgcgacctccgcctcgcgtcgaggtttccatccctggctctcagcattgcccgtcagcacagactc

SEQ ID NO: 13127 - DNA, 34 bp, Homo sapiens
  misc_feature 1..34: note = chr19:1523753-1523787
  misc_feature 1..34: note = hyper
  source 1..34: mol_type = genomic DNA
gcccccaaccccccacgcgcgagagagcctcagt

SEQ ID NO: 13128 - DNA, 72 bp, Homo sapiens; identical to SEQ ID NO: 4571
  misc_feature 1..72: note = chr19:1524442-1524514
  misc_feature 1..72: note = hyper
  source 1..72: mol_type = genomic DNA

SEQ ID NO: 13129 - DNA, 30 bp, Homo sapiens
  misc_feature 1..30: note = chr19:1719137-1719167
  misc_feature 1..30: note = hyper
  source 1..30: mol_type = genomic DNA
tgccccccacccacgcgaggctgcagcccc

SEQ ID NO: 13130 - DNA, 39 bp, Homo sapiens
  misc_feature 1..39: note = chr19:1725654-1725693
  misc_feature 1..39: note = hyper
  source 1..39: mol_type = genomic DNA
ttcagtgcctggggccgcggcgatcgatgacagctgggc

SEQ ID NO: 13131 - DNA, 30 bp, Homo sapiens
  misc_feature 1..30: note = chr19:1750146-1750176
  misc_feature 1..30: note = hyper
  source 1..30: mol_type = genomic DNA
cgcattcattgccatcgtttagtaaaacct

SEQ ID NO: 13132 - DNA, 113 bp, Homo sapiens
  misc_feature 1..113: note = chr19:1753693-1753806
  misc_feature 1..113: note = hyper
  source 1..113: mol_type = genomic DNA
gcacagcgtggcccacgcgcaggcgggcgagctgctgagcccgggccacgcgcgctcggcggcggcgcagcaccgcggcctggtggcgcccgggcgcccgggcctggtggccg

SEQ ID NO: 13133 - DNA, 562 bp, Homo sapiens
  misc_feature 1..562: note = chr19:1754313-1754875
  misc_feature 1..562: note = hyper
  source 1..562: mol_type = genomic DNA
cgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggc

SEQ ID NO: 13134 - DNA, 250 bp, Homo sapiens
  misc_feature 1..250: note = chr19:1757376-1757626
  misc_feature 1..250: note = hyper
  source 1..250: mol_type = genomic DNA
gtctgggtttcctgtcgaggaagggagagttagaacagtcgccgtctcaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgcggggttcacgccgtcaaccttgcgcacctgtcgcgtc

SEQ ID NO: 13135 - DNA, 74 bp, Homo sapiens
  misc_feature 1..74: note = chr19:1757980-1758054
  misc_feature 1..74: note = hyper
  source 1..74: mol_type = genomic DNA
ccaaggagaactttgcgccccgggtctcccgtcgcgcttgcccggctcggggcgggccacgcgtttccgcaggt

SEQ ID NO: 13136 - DNA, 66 bp, Homo sapiens
  misc_feature 1..66: note = chr19:1762172-1762238
  misc_feature 1..66: note = hyper
  source 1..66: mol_type = genomic DNA
ccatctggagaccctcgtgctggctgctgggggtcctgcgtgccttccgcgcgcccccagctgcgc

SEQ ID NO: 13137 - DNA, 32 bp, Homo sapiens
  misc_feature 1..32: note = chr19:1762474-1762506
  misc_feature 1..32: note = hyper
  source 1..32: mol_type = genomic DNA
ccatcacccagcaaacgccgtcccgcagcacc

SEQ ID NO: 13138 - DNA, 169 bp, Homo sapiens
  misc_feature 1..169: note = chr19:1762627-1762796
  misc_feature 1..169: note = hyper
  source 1..169: mol_type = genomic DNA
ggcgccaggagacccgggacccgggaccacgcgcccgcggccttggagcctcagggtcactggtgcgggctccgcaggaaagcgcagcccccagcaggcacccaccatcccacccccgcatcccaccccaggggaaaccgcgccgcaccaggcgcgagtgttcttcttc

SEQ ID NO: 13139 - DNA, 30 bp, Homo sapiens
  misc_feature 1..30: note = chr19:1765699-1765729
  misc_feature 1..30: note = hyper
  source 1..30: mol_type = genomic DNA
ggctctgggtcactgcgtccacttgataaa

SEQ ID NO: 13140 - DNA, 39 bp, Homo sapiens
  misc_feature 1..39: note = chr19:1769737-1769776
  misc_feature 1..39: note = hyper
  source 1..39: mol_type = genomic DNA
cgcggtaaacagctccgactggatcgatctgggctgtga

SEQ ID NO: 13141 - DNA, 254 bp, Homo sapiens
  misc_feature 1..254: note = chr19:1776259-1776513
  misc_feature 1..254: note = hyper
  source 1..254: mol_type = genomic DNA
acctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttc

SEQ ID NO: 13142 - DNA, 345 bp, Homo sapiens
  misc_feature 1..345: note = chr19:1856999-1857344
  misc_feature 1..345: note = hyper
  source 1..345: mol_type = genomic DNA
ctgccgcacgtagctcggcggcggcggcggggacatccgcagccccagccggccccgctcacgtggtcccactcccgccggggccagggggcccgggccagggtcgcctctccggcctgggtgcctgccagccccgccccgcgcttggagactgaggcgcgcacatgcgcacgtgggtggcggggcagggggtgcacgggctacccacccacgctgcgctgggcgaagcgcctctgcgaaatgccaggccctgcctcgcacacaatccactcgcagggaggagggtggggtgaacttgtgggggcccagagcgcgctgctcctagccagccgggcccccaggtgc

SEQ ID NO: 13143 - DNA, 83 bp, Homo sapiens
  misc_feature 1..83: note = chr19:2251152-2251235
  misc_feature 1..83: note = hyper
  source 1..83: mol_type = genomic DNA
ctcacgcgcctggtgcgggcgctgcgggtccccccggcccgggcctccgcgccgcgcctggccctggatccggacgcgctggc

SEQ ID NO: 13144 - DNA, 105 bp, Homo sapiens
  misc_feature 1..105: note = chr19:2251610-2251715
  misc_feature 1..105: note = hyper
  source 1..105: mol_type = genomic DNA
gggtcgggcacagcgcagcgcgggggccaccgccgccgacgggccgtgcgcgctgcgcgagctcagcgtagacctccgcgccgagcgctccgtactcatccccga

SEQ ID NO: 13145 - DNA, 856 bp, Homo sapiens; identical to SEQ ID NO: 4572
  misc_feature 1..856: note = chr19:2252588-2253444
  misc_feature 1..856: note = hyper
  source 1..856: mol_type = genomic DNA

SEQ ID NO: 13146 - DNA, 266 bp, Homo sapiens; identical to SEQ ID NO: 4573
  misc_feature 1..266: note = chr19:2290006-2290272
  misc_feature 1..266: note = hyper
  source 1..266: mol_type = genomic DNA

SEQ ID NO: 13147 - DNA, 238 bp, Homo sapiens; identical to SEQ ID NO: 4574
  misc_feature 1..238: note = chr19:2290630-2290868
  misc_feature 1..238: note = hyper
  source 1..238: mol_type = genomic DNA

SEQ ID NO: 13148 - DNA, 179 bp, Homo sapiens
  misc_feature 1..179: note = chr19:2302772-2302951
  misc_feature 1..179: note = hyper
  source 1..179: mol_type = genomic DNA
gcaggggggccgggccggcggcagggacggcgttggcggtggtggacgggagtgggggtctgtcctgaacaggtgggggtggtccctgtgctggcccccgccatgcgatcgcaccccaggactctcctcctcttcctaagccccagcatgtgcctggtgccgcgcgggtgctggaggca

SEQ ID NO: 13149 - DNA, 15 bp, Homo sapiens
  misc_feature 1..15: note = chr19:3585992-3586007
  misc_feature 1..15: note = hyper
  source 1..15: mol_type = genomic DNA
ggggccccctttgca

SEQ ID NO: 13150 - DNA, 199 bp, Homo sapiens; identical to SEQ ID NO: 1350
  misc_feature 1..199: note = chr19:3785637-3785836
  misc_feature 1..199: note = hyper
  source 1..199: mol_type = genomic DNA

SEQ ID NO: 13151 - DNA, 357 bp, Homo sapiens; identical to SEQ ID NO: 1351
  misc_feature 1..357: note = chr19:3785864-3786221
  misc_feature 1..357: note = hyper
  source 1..357: mol_type = genomic DNA

SEQ ID NO: 13152 - DNA, 16 bp, Homo sapiens
  misc_feature 1..16: note = chr19:3786583-3786599
  misc_feature 1..16: note = hyper
  source 1..16: mol_type = genomic DNA
gcgcggcggggaccgg

SEQ ID NO: 13153 - DNA, 48 bp, Homo sapiens
  misc_feature 1..48: note = chr19:3822204-3822252
  misc_feature 1..48: note = hyper
  source 1..48: mol_type = genomic DNA
cacagaacagccgcacgcgcaccaggcacgaggcggggtgggatgtga

SEQ ID NO: 13154 - DNA, 48 bp, Homo sapiens
  misc_feature 1..48: note = chr19:3868851-3868899
  misc_feature 1..48: note = hyper
  source 1..48: mol_type = genomic DNA
ggctgggactggggccgggccgggcgcacgcggcgggagaaggggtag

SEQ ID NO: 13155 - DNA, 226 bp, Homo sapiens
  misc_feature 1..226: note = chr19:3880562-3880788
  misc_feature 1..226: note = hyper
  source 1..226: mol_type = genomic DNA
gccaatggggaggatcggattctggcagggggctgtgcttttccgtcaggccgccaccccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccac

SEQ ID NO: 13156 - DNA, 30 bp, Homo sapiens
  misc_feature 1..30: note = chr19:3881573-3881603
  misc_feature 1..30: note = hyper
  source 1..30: mol_type = genomic DNA
ggccgtccccaaatgcgaagccaggatctg

SEQ ID NO: 13157 - DNA, 167 bp, Homo sapiens
  misc_feature 1..167: note = chr19:3933513-3933680
  misc_feature 1..167: note = hyper
  source 1..167: mol_type = genomic DNA
aggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcat

SEQ ID NO: 13158 - DNA, 138 bp, Homo sapiens
  misc_feature 1..138: note = chr19:4198030-4198168
  misc_feature 1..138: note = hyper
  source 1..138: mol_type = genomic DNA
ggccgcgtggaggtgcgaggctgcggacgtcgcgggcccggaggcacctgcgcgcccttggccgactcggaggaggtggagatggacgcccgcgggtcccctggagatgcagccggcggcctgcgctggtgagggagc

SEQ ID NO: 13159 - DNA, 70 bp, Homo sapiens
  misc_feature 1..70: note = chr19:4304487-4304557
  misc_feature 1..70: note = hyper
  source 1..70: mol_type = genomic DNA
tatcaccaccaacaccgcccagtgagccccaggcgctggatgtgagggctctgggcgaggccagcgcgga

SEQ ID NO: 13160 - DNA, 48 bp, Homo sapiens
  misc_feature 1..48: note = chr19:5292738-5292786
  misc_feature 1..48: note = hyper
  source 1..48: mol_type = genomic DNA
tacctgccccctctgcggtcctgttgcctcctccgccttctgcgaagt

SEQ ID NO: 13161 - DNA, 71 bp, Homo sapiens
  misc_feature 1..71: note = chr19:5293067-5293138
  misc_feature 1..71: note = hyper
  source 1..71: mol_type = genomic DNA
ggagcctggagggggcgcgacaagagagacaaagcccggggcggcccgggcctcggggtggaagggggtcc

SEQ ID NO: 13162 - DNA, 27 bp, Homo sapiens
  misc_feature 1..27: note = chr19:5293155-5293182
  misc_feature 1..27: note = hyper
  source 1..27: mol_type = genomic DNA
cggctcggagatcgggcccaggccccg

SEQ ID NO: 13163 - DNA, 48 bp, Homo sapiens
  misc_feature 1..48: note = chr19:5294020-5294068
  misc_feature 1..48: note = hyper
  source 1..48: mol_type = genomic DNA
tccaccggaggggcccggaatgtagaagcccagcgggacctgggggtc

SEQ ID NO: 13164 - DNA, 30 bp, Homo sapiens
  misc_feature 1..30: note = chr19:5338746-5338776
  misc_feature 1..30: note = hyper
  source 1..30: mol_type = genomic DNA
tgcaaatggcagattcgaccaagtccctgg

SEQ ID NO: 13165 - DNA, 68 bp, Homo sapiens
  misc_feature 1..68: note = chr19:5339068-5339136
  misc_feature 1..68: note = hyper
  source 1..68: mol_type = genomic DNA
tccctgctgctcagccgggactccgacacctcggacacccgcttcactagccgcggctgccgggatgt

SEQ ID NO: 13166 - DNA, 94 bp, Homo sapiens
  misc_feature 1..94: note = chr19:5340523-5340617
  misc_feature 1..94: note = hyper
  source 1..94: mol_type = genomic DNA
cagccgagcatcctccgagcacaatggccgtgcaggcttccccggcacaaagccggcgcgctgcccactcggctgcctccgagaccccccttgg

SEQ ID NO: 13167 - DNA, 214 bp, Homo sapiens
  misc_feature 1..214: note = chr19:5437029-5437243
  misc_feature 1..214: note = hyper
  source 1..214: mol_type = genomic DNA
gactcctgcccccagcgacgcccagttcctcccataggagcaaaaaggacaaaagactcccccatgcctccagtagtcaaagacccccgagctgcccatcccagacactcgcgcaggtatggagcgcctactgtatgccagccccgagactcattggggatgcagcggtggcgacatcagccccgggtccctgtccccacggggctcccaggat

SEQ ID NO: 13168 - DNA, 33 bp, Homo sapiens
  misc_feature 1..33: note = chr19:5567596-5567629
  misc_feature 1..33: note = hyper
  source 1..33: mol_type = genomic DNA
ggcgcccgcctcccccgccgctctccaggggtc

SEQ ID NO: 13169 - DNA, 225 bp, Homo sapiens
  misc_feature 1..225: note = chr19:5828090-5828315
  misc_feature 1..225: note = hyper
  source 1..225: mol_type = genomic DNA
gacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactga

SEQ ID NO: 13170 - DNA, 141 bp, Homo sapiens; identical to SEQ ID NO: 1353
  misc_feature 1..141: note = chr19:6590370-6590511
  misc_feature 1..141: note = hyper
  source 1..141: mol_type = genomic DNA

SEQ ID NO: 13171 - DNA, 38 bp, Homo sapiens
  misc_feature 1..38: note = chr19:6590785-6590823
  misc_feature 1..38: note = hyper
  source 1..38: mol_type = genomic DNA
ctcattctgtcttttcggtcacgcgcctctctatgttt

SEQ ID NO: 13172 - DNA, 335 bp, Homo sapiens
  misc_feature 1..335: note = chr19:7794909-7795244
  misc_feature 1..335: note = hyper
  source 1..335: mol_type = genomic DNA
catccaggcccccaacgatcaccaggtgcgcgctggcatctgcgcagtgatcctgcgccgccgcccacgtcgtctttggcacagagaaaaagtagcaggagccctcgaaggacagccacgacgtggggcacggctcgcaggagtctgcggggtggcgagggtcagagaggtcgcgtgcttccaggggcaacgcaccgagaggatgcagtgggtaggggttcggccccgcgggctcaggggtggagacacagaaccaggccaaggtccaggagtgacagggtccgcttacgccctcacagcccgcccccgaccccccgtctcgctcactgttctgg

SEQ ID NO: 13173 - DNA, 127 bp, Homo sapiens
  misc_feature 1..127: note = chr19:7795565-7795692
  misc_feature 1..127: note = hyper
  source 1..127: mol_type = genomic DNA
ggtcagcactcaggacggggtcggggtcgggggacgcggccagggctcagggccggggtcgcgtcgggccctcaccgcgctcacgcagttcccgcagggcgctctcctgctccatcagcttcgcctg

SEQ ID NO: 13174 - skipped

SEQ ID NO: 13175 - DNA, 90 bp, Homo sapiens
  misc_feature 1..90: note = chr19:7852997-7853087
  misc_feature 1..90: note = hyper
  source 1..90: mol_type = genomic DNA
ggccgtttgcagtcacgcgtgtgcacatggcgtgcacgtatgtgtgcgagtccccacgcgtttgtctcccatcggcgtgtgtgcacatag

SEQ ID NO: 13176 - DNA, 110 bp, Homo sapiens
  misc_feature 1..110: note = chr19:7853361-7853471
  misc_feature 1..110: note = hyper
  source 1..110: mol_type = genomic DNA
ccctgagtctggccacggggtgtggaagggagtcccctgagtcctcccaagtgacccggcgggcatgcgttttgggatgggggtcgttccagcctcgaagcagacggcgg

SEQ ID NO: 13177 - DNA, 60 bp, Homo sapiens
  misc_feature 1..60: note = chr19:7853543-7853603
  misc_feature 1..60: note = hyper
  source 1..60: mol_type = genomic DNA
cgcaagggtggggtcttgtggccgggatgggaggggggccggaggcgaggcctgcggcga

SEQ ID NO: 13178 - DNA, 42 bp, Homo sapiens
  misc_feature 1..42: note = chr19:7927482-7927524
  misc_feature 1..42: note = hyper
  source 1..42: mol_type = genomic DNA
gccccgcccccaatccgcctctgccggcgtcctgcctcccga

SEQ ID NO: 13179 - DNA, 259 bp, Homo sapiens
  misc_feature 1..259: note = chr19:8115235-8115494
  misc_feature 1..259: note = hyper
  source 1..259: mol_type = genomic DNA
aagtctgggtaacaccgtcttggccgcggcccgcgggttgggaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctct

SEQ ID NO: 13180 - DNA, 118 bp, Homo sapiens; identical to SEQ ID NO: 1354
  misc_feature 1..118: note = chr19:9473938-9474056
  misc_feature 1..118: note = hyper
  source 1..118: mol_type = genomic DNA

SEQ ID NO: 13181 - DNA, 50 bp, Homo sapiens
  misc_feature 1..50: note = chr19:9517741-9517791
  misc_feature 1..50: note = hyper
  source 1..50: mol_type = genomic DNA
attcacttccgtttccgggagcgcacttccgtttccaggcatgagggcaa

SEQ ID NO: 13182 - DNA, 105 bp, Homo sapiens
  misc_feature 1..105: note = chr19:9608931-9609036
  misc_feature 1..105: note = hyper
  source 1..105: mol_type = genomic DNA
tttaaggcctcagaacgcttggacacttttgaagacgggaacacacggctgaaaacagccctcggacgcgcccatactgcacttcccacccggctcctctagggg

SEQ ID NO: 13183 - DNA, 40 bp, Homo sapiens; identical to SEQ ID NO: 4580
  misc_feature 1..40: note = chr19:9609379-9609419
  misc_feature 1..40: note = hyper
  source 1..40: mol_type = genomic DNA

SEQ ID NO: 13184 - DNA, 359 bp, Homo sapiens
  misc_feature 1..359: note = chr19:9903669-9904028
  misc_feature 1..359: note = hyper
  source 1..359: mol_type = genomic DNA
gtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatggagggagtctgttgggcgggacctcgaaatgcctctgctcgctttcctctgcattcatgcggcttgtacgaggatgcgctgtttcctggtggtttgttatacggcagtagataact

SEQ ID NO: 13185 - DNA, 295 bp, Homo sapiens
  misc_feature 1..295: note = chr19:10398157-10398452
  misc_feature 1..295: note = hyper
  source 1..295: mol_type = genomic DNA
tcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgc

SEQ ID NO: 13186 - DNA, 30 bp, Homo sapiens
  misc_feature 1..30: note = chr19:10400448-10400478
  misc_feature 1..30: note = hyper
  source 1..30: mol_type = genomic DNA
tcatgccggcctccacgtagaccccagggg

SEQ ID NO: 13187 - skipped

SEQ ID NO: 13188 - DNA, 133 bp, Homo sapiens; identical to SEQ ID NO: 4582
  misc_feature 1..133: note = chr19:10406278-10406411
  misc_feature 1..133: note = hyper
  source 1..133: mol_type = genomic DNA

SEQ ID NO: 13189 - DNA, 95 bp, Homo sapiens
  misc_feature 1..95: note = chr19:10406935-10407030
  misc_feature 1..95: note = hyper
  source 1..95: mol_type = genomic DNA
gtgcctgtgggagtgcggggggcggtgggagaagccccccggagcttggccaccctccgcgagggtctccaccccgcaggtccgtggctatgggt

SEQ ID NO: 13190 - skipped

SEQ ID NO: 13191 - DNA, 153 bp, Homo sapiens
  misc_feature 1..153: note = chr19:10531548-10531701
  misc_feature 1..153: note = hyper
  source 1..153: mol_type = genomic DNA
cctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccc

SEQ ID NO: 13192 - DNA, 203 bp, Homo sapiens
  misc_feature 1..203: note = chr19:10616329-10616532
  misc_feature 1..203: note = hyper
  source 1..203: mol_type = genomic DNA
atttgaaagattgaacgtcctggctcagggtctggaaggaatcacgtgtagggctacgttggagttaccccgctaccccaaatccttgttgcgtgtagatgcagttccagacagctcctcaggggggcggcctagatagtccgtgaacacgctgagtggccgaggttgtaaccagcgccttcctggcacgttgcagaaaacaa

SEQ ID NO: 13193 - skipped

SEQ ID NO: 13194 - DNA, 443 bp, Homo sapiens; identical to SEQ ID NO: 1356
  misc_feature 1..443: note = chr19:10624965-10625408
  misc_feature 1..443: note = hyper
  source 1..443: mol_type = genomic DNA

SEQ ID NO: 13195 - DNA, 30 bp, Homo sapiens
  misc_feature 1..30: note = chr19:10629493-10629523
  misc_feature 1..30: note = hyper
  source 1..30: mol_type = genomic DNA
agggggcactcaggccgggtcaggccccca

SEQ ID NO: 13196 - DNA, 72 bp, Homo sapiens
  misc_feature 1..72: note = chr19:10691925-10691997
  misc_feature 1..72: note = hyper
  source 1..72: mol_type = genomic DNA
tcccctaaatgcttacggccagtgagctcgaagagcacgcggtcattgaggcccagccgcagctctggcatt

SEQ ID NO: 13197 - DNA, 118 bp, Homo sapiens
  misc_feature 1..118: note = chr19:11529773-11529891
  misc_feature 1..118: note = hyper
  source 1..118: mol_type = genomic DNA
cactgggtcaagggccgcgagtccccaggaggggactccagggcaagttcagattgggagcagataccgtccgacgggcgggcgcttggagtttctggacctgcgggtcaccagggat

SEQ ID NO: 13198 - DNA, 100 bp, Homo sapiens
  misc_feature 1..100: note = chr19:11531503-11531603
  misc_feature 1..100: note = hyper
  source 1..100: mol_type = genomic DNA
taggacctccgagagcgacggtgcttcttgtgactttcgattaatttctgggaacggatcttgagtgatgcgcgggtcactacctcgttgtcctcctcct

SEQ ID NO: 13199 - DNA, 17 bp, Homo sapiens
  misc_feature 1..17: note = chr19:11532425-11532442
  misc_feature 1..17: note = hyper
  source 1..17: mol_type = genomic DNA
cacgaggcccagcaggt

SEQ ID NO: 13200 - DNA, 154 bp, Homo sapiens; identical to SEQ ID NO: 4585
  misc_feature 1..154: note = chr19:11591031-11591185
  misc_feature 1..154: note = hyper
  source 1..154: mol_type = genomic DNA

SEQ ID NO: 13201 - DNA, 585 bp, Homo sapiens; identical to SEQ ID NO: 4586
  misc_feature 1..585: note = chr19:11592710-11593295
  misc_feature 1..585: note = hyper
  source 1..585: mol_type = genomic DNA

SEQ ID NO: 13202 - DNA, 121 bp, Homo sapiens
  misc_feature 1..121: note = chr19:11689402-11689523
  misc_feature 1..121: note = hyper
  source 1..121: mol_type = genomic DNA
cctgcctgcctcctccgtgctgggcgccgccgcgacacgtcccgcggacattcaggagtcccttcagtccctgcgagcgcggacccgggagagagctctcattcaacgctgaggccactgg

SEQ ID NO: 13203 - DNA, 45 bp, Homo sapiens
  misc_feature 1..45: note = chr19:11909467-11909512
  misc_feature 1..45: note = hyper
  source 1..45: mol_type = genomic DNA
tgacgctgtcacctgcgctgtgacctgctccggagtcataaagag

SEQ ID NO: 13204 - DNA, 30 bp, Homo sapiens
  misc_feature 1..30: note = chr19:11909854-11909884
  misc_feature 1..30: note = hyper
  source 1..30: mol_type = genomic DNA
gggtcggatgtgtcccgcctttcttctgct

SEQ ID NO: 13205 - DNA, 30 bp, Homo sapiens
  misc_feature 1..30: note = chr19:11959427-11959457
  misc_feature 1..30: note = hyper
  source 1..30: mol_type = genomic DNA
ctgtcagtctggctccgcagggcctgatac

SEQ ID NO: 13206 - DNA, 97 bp, Homo sapiens; identical to SEQ ID NO: 4587
  misc_feature 1..97: note = chr19:11959663-11959760
  misc_feature 1..97: note = hyper
  source 1..97: mol_type = genomic DNA

SEQ ID NO: 13207 - DNA, 272 bp, Homo sapiens; identical to SEQ ID NO: 4588
  misc_feature 1..272: note = chr19:11959761-11960033
  misc_feature 1..272: note = hyper
  source 1..272: mol_type = genomic DNA

SEQ ID NO: 13208 - DNA, 314 bp, Homo sapiens
  misc_feature 1..314: note = chr19:11998761-11999075
  misc_feature 1..314: note = hyper
  source 1..314: mol_type = genomic DNA
gtgtagagaggaccccgggacatctgaaagccaggaaatggtgcgtgtctggggccgggtgtcgtgagacgggggaggggctgcctggaccgaccggaaccgactgtggcgagaccctggctttcctgcgggcgactttgggatctgggaccgagtcctcctggagccgctcggccctcggtcccctcgactgctcggtgtggctgggccggtagccgggacaccaggcgtcctgtctcgtctctgcgcggcgactgcggttccagagccctctatgggcagctccgcgcccgcagccacgcgtctacccagat

SEQ ID NO: 13209 - DNA, 62 bp, Homo sapiens
  misc_feature 1..62: note = chr19:12075756-12075818
  misc_feature 1..62: note = hyper
  source 1..62: mol_type = genomic DNA
ctcagaagtgaggggcggggcctagcattccatccaatcagaggtgccggggcagggccctg

SEQ ID NO: 13210 - DNA, 117 bp, Homo sapiens
  misc_feature 1..117: note = chr19:12076262-12076379
  misc_feature 1..117: note = hyper
  source 1..117: mol_type = genomic DNA
ctctctgggcagttccgcgcccgcagccccgcgtctccccagattatgcggaagccacgagagggtcatgggggaaatcctgactcgtgtgtagggttcgtgcgtgggaggagcagt

SEQ ID NO: 13211 - DNA, 160 bp, Homo sapiens
  misc_feature 1..160: note = chr19:12146813-12146973
  misc_feature 1..160: note = hyper
  source 1..160: mol_type = genomic DNA
gctcacaatagggttcgggctcctatgacagactaatgcctctgctgatctgacaggaagcatatctctggcgataatgcccgctggctcgcccgccagccgctcacctcctgctgtgcggactggttccttacaggccatggaccgggggttggggacc

SEQ ID NO: 13212 - DNA, 16 bp, Homo sapiens
  misc_feature 1..16: note = chr19:12163328-12163344
  misc_feature 1..16: note = hyper
  source 1..16: mol_type = genomic DNA
cacaatctggggagac

SEQ ID NO: 13213 - DNA, 458 bp, Homo sapiens
  misc_feature 1..458: note = chr19:12175474-12175932
  misc_feature 1..458: note = hyper
  source 1..458: mol_type = genomic DNA
ccacccaatcagagtcgccggggtggggcccggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctggggcccgagccccgctggcgcagctcggccttcggtccattcggccgccgggtgcggctgggccggcagccgggacccctgggcgccctgtctcgtcgccgcgcggcgactgcggccccag

SEQ ID NO: 13214 - DNA, 336 bp, Homo sapiens; identical to SEQ ID NO: 1357
  misc_feature 1..336: note = chr19:12203013-12203349
  misc_feature 1..336: note = hyper
  source 1..336: mol_type = genomic DNA

SEQ ID NO: 13215 - DNA, 343 bp, Homo sapiens; identical to SEQ ID NO: 1358
  misc_feature 1..343: note = chr19:12203350-12203693
  misc_feature 1..343: note = hyper
  source 1..343: mol_type = genomic DNA

SEQ ID NO: 13216 - DNA, 289 bp, Homo sapiens; identical to SEQ ID NO: 4591
  misc_feature 1..289: note = chr19:12267019-12267308
  misc_feature 1..289: note = hyper
  source 1..289: mol_type = genomic DNA

SEQ ID NO: 13217 - DNA, 342 bp, Homo sapiens; identical to SEQ ID NO: 4592
  misc_feature 1..342: note = chr19:12267309-12267651
  misc_feature 1..342: note = hyper
  source 1..342: mol_type = genomic DNA

SEQ ID NO: 13218 - DNA, 15 bp, Homo sapiens
  misc_feature 1..15: note = chr19:12306229-12306244
  misc_feature 1..15: note = hyper
  source 1..15: mol_type = genomic DNA
cgtgtctccccagat

SEQ ID NO: 13219 - DNA, 244 bp, Homo sapiens
  misc_feature 1..244: note = chr19:12750866-12751110
  misc_feature 1..244: note = hyper
  source 1..244: mol_type = genomic DNA
tactccgctcacctgcgacggcagcagccagtccccacgggcggaggggacctcatgcgacattcagcccgcgagattctcagagactgctcgcccgcaacacgcagtaacgatctcaggagagcccatgatggggcggcgcgtgtcgtagccgagaagactctgtcatcgccggcgacctcctggaactctctcttgcggtttgcagccagatcacttcccatacacgcggcagccaagctca

SEQ ID NO: 13220 - DNA, 147 bp, Homo sapiens
  misc_feature 1..147: note = chr19:12936457-12936604
  misc_feature 1..147: note = hyper
  source 1..147: mol_type = genomic DNA
gggtgtcctgaggggcggggctgggggaagggtcgctcccccaactcagggccacgcgtccgctaggggccgctgccgcttccactgccactcccgctgcccgcagcgtccaggatggaggtgcgagggctgcgggaacgccgggag

SEQ ID NO: 13221 - DNA, 36 bp, Homo sapiens
  misc_feature 1..36: note = chr19:12952093-12952129
  misc_feature 1..36: note = hyper
  source 1..36: mol_type = genomic DNA
gtggggctccctttgcggcaggtcgaaagcgcgtgc

SEQ ID NO: 13222 - skipped

SEQ ID NO: 13223 - DNA, 261 bp, Homo sapiens; identical to SEQ ID NO: 1359
  misc_feature 1..261: note = chr19:13616696-13616957
  misc_feature 1..261: note = hyper
  source 1..261: mol_type = genomic DNA

SEQ ID NO: 13224 - DNA, 307 bp, Homo sapiens; identical to SEQ ID NO: 1360
  misc_feature 1..307: note = chr19:13617158-13617465
  misc_feature 1..307: note = hyper
  source 1..307: mol_type = genomic DNA

SEQ ID NO: 13225 - DNA, 29 bp, Homo sapiens
  misc_feature 1..29: note = chr19:13617489-13617518
  misc_feature 1..29: note = hyper
  source 1..29: mol_type = genomic DNA
cggtttgcaaaggacgccccccccgggac

SEQ ID NO: 13226 - DNA, 30 bp, Homo sapiens
  misc_feature 1..30: note = chr19:13617846-13617876
  misc_feature 1..30: note = hyper
  source 1..30: mol_type = genomic DNA
aaggagtcttcacaccgcagggtccaggtt

SEQ ID NO: 13227 - DNA, 107 bp, Homo sapiens
  misc_feature 1..107: note = chr19:13618303-13618410
  misc_feature 1..107: note = hyper
  source 1..107: mol_type = genomic DNA
cgacacatgagggcccgcgaccaatcgtggaggctcgtggaggcgcgggggtaccgggctcagcggagtttgtgggggagagaggggagcgtcgcatggttgggagg

SEQ ID NO: 13228 - DNA, 340 bp, Homo sapiens
  misc_feature 1..340: note = chr19:14320312-14320652
  misc_feature 1..340: note = hyper
  source 1..340: mol_type = genomic DNA
aggaggcaaagagtgcggaggggctggggggcgcgtaaagagccctggcgcccctcaggccttcggctgcgcagccgcagtggaggccgcgccagcaaccgggctccgggaaccaaggcgtccgcgcgcgcacgcagactcgcccgcgcgccgcgtgccccgcgctgcccaggtcggtacccgcgcttcggacaccctgctcccagggcgctcctcgcttccagcctcccactttgcgccttgggctccccatgagccccgctcctgagacaccccacgctctgtgtattccgtcccacgggacctccacgcccacggtgccacgcgcctcgagtacccc

SEQ ID NO: 13229 - DNA, 135 bp, Homo sapiens
  misc_feature 1..135: note = chr19:14583381-14583516
  misc_feature 1..135: note = hyper
  source 1..135: mol_type = genomic DNA
ctgaggccgctgtgccgggagctgcgcagcgagctggcctcccaggcgctcggtgttaggcccagccccgcggggccgcccttggctccggccctcgggggcaagaggcgaagcagttggcgcagcacggcctgg

SEQ ID NO: 13230 - DNA, 107 bp, Homo sapiens
  misc_feature 1..107: note = chr19:14583613-14583720
  misc_feature 1..107: note = hyper
  source 1..107: mol_type = genomic DNA
cgccgacggccagcgccaccaacacctgcgggggaagccggtgtgagctatagagcaggcgcgggcgcaggggggcgcagggatggtgggggcgtggctggaaggta

SEQ ID NO: 13231 - DNA, 173 bp, Homo sapiens; identical to SEQ ID NO: 4597
  misc_feature 1..173: note = chr19:14584240-14584413
  misc_feature 1..173: note = hyper
  source 1..173: mol_type = genomic DNA

SEQ ID NO: 13232 - DNA, 26 bp, Homo sapiens
  misc_feature 1..26: note = chr19:14584536-14584562
  misc_feature 1..26: note = hyper
  source 1..26: mol_type = genomic DNA
cgccagccgcccgggggacccaggcc

SEQ ID NO: 13233 - DNA, 15 bp, Homo sapiens
  misc_feature 1..15: note = chr19:14886822-14886837
  misc_feature 1..15: note = hyper
  source 1..15: mol_type = genomic DNA
cgggcgcccctccca

SEQ ID NO: 13234 - DNA, 477 bp, Homo sapiens; identical to SEQ ID NO: 4599
  misc_feature 1..477: note = chr19:15090075-15090552
  misc_feature 1..477: note = hyper
  source 1..477: mol_type = genomic DNA

SEQ ID NO: 13235 - DNA, 66 bp, Homo sapiens
  misc_feature 1..66: note = chr19:15090784-15090850
  misc_feature 1..66: note = hyper
  source 1..66: mol_type = genomic DNA
ccccagcatccctggcggagcgcggggaacaggccctggcaccgcgggacccgctccagcagcctc

SEQ ID NO: 13236 - DNA, 33 bp, Homo sapiens
  misc_feature 1..33: note = chr19:15121861-15121894
  misc_feature 1..33: note = hyper
  source 1..33: mol_type = genomic DNA
ggagatgatcaaaggcggcggcaccttggagaa

SEQ ID NO: 13237 - DNA, 370 bp, Homo sapiens
  misc_feature 1..370: note = chr19:15288513-15288883
  misc_feature 1..370: note = hyper
  source 1..370: mol_type = genomic DNA
ctgggctgttgcactcgcggtcgcagcgctggtccccgcgcttggcctggcaggcggcgcgcgggcaccgcggctcctccgagacctcgggtgccgcggcgggcgcctcgcagcgcggcccggtccagccctgcgcgcaagcgcagcggaagaagggcgcgagcggcgcggggcggcaggagcccccgtggagacagggggcggccgcgcagctggcgttgctggcccccggcggcgaccccgggaagctgcggcaggagggtcccgacaaccctggggggcaggcgcagcgcggcccgcggggcgtctgctggcatgggacgcccaccgggcactgcagctcccggcaggagcgcgccacccgctcgca

SEQ ID NO: 13238 - DNA, 72 bp, Homo sapiens
  misc_feature 1..72: note = chr19:15333743-15333815
  misc_feature 1..72: note = hyper
  source 1..72: mol_type = genomic DNA
ttcctcccagtctcacggaaatgctaaatcatcccggcgtgggaggcttctgtgggtcggggcgcagctttg

SEQ ID NO: 13239 - DNA, 34 bp, Homo sapiens
  misc_feature 1..34: note = chr19:15334731-15334765
  misc_feature 1..34: note = hyper
  source 1..34: mol_type = genomic DNA
ctgggggtccctgctcggtcgggacagtgggacc

SEQ ID NO: 13240 - DNA, 693 bp, Homo sapiens
  misc_feature 1..693: note = chr19:15342587-15343280
  misc_feature 1..693: note = hyper
  source 1..693: mol_type = genomic DNA
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcgaccccacgcgaccccgcagccccgatagcgcccccgtgcgatcaccttgaggttcaggaaaccgtgctcacccagcgaggggtcgctcaggcaggcgggggacgcgctccgacggcgcccgcagcagccgcgccggggccggcacagcacgtgcgtgagcgctatgcagccgtagaccgccgcggccaccagcgccaccgagaacaccaggctccacatgaaggcgcgcagcagcttcagcgacaggcgcgacggcgccagcagcgcggtcaccaccagctccggcatgtcgccgcgctccgggaccacggcggcgctgccggccaggggcacctgcagcagcggcgaagcggtgtcagggctcaggggcccatcgcccttggcctggggcccctccgtgccgtcgggatttgtgggacgcgctgaaggaagaggcgggcggctccgacagaaaacagccagagcgcaccactcacctgagtgccaggtaaacacctgggcgcgacagggacaggaaacaagggtagggtgcggaggctggggagg

SEQ ID NO: 13241 - DNA, 151 bp, Homo sapiens
  misc_feature 1..151: note = chr19:15343980-15344131
  misc_feature 1..151: note = hyper
  source 1..151: mol_type = genomic DNA
caatgggcaatgagacggagggcggggccgggacctaatatggcgggtcaggagggtctggaagacgaagaagagggacaggcaatgccaggtctaggactaggagggaggcgcgggcggtattagcggctggaggaggcttcgggaggcc

SEQ ID NO: 13242 - DNA, 208 bp, Homo sapiens
  misc_feature 1..208: note = chr19:15619208-15619416
  misc_feature 1..208: note = hyper
  source 1..208: mol_type = genomic DNA
ttttctagggggcagcgctggagtccccgcccagaaccctgcgggagcccggggcgggatgtccgggggcggacccctcggcacggccgggcggggttaaagggttgggccgtgggacggcgcggtcagatcccaggtagtggcgccggtggatccggatcgagggcaggaggctgagacccgcgggtgagtgcgcgcgtggtgaggg

SEQ ID NO: 13243 - DNA, 237 bp, Homo sapiens
  misc_feature 1..237: note = chr19:15695292-15695529
  misc_feature 1..237: note = hyper
  source 1..237: mol_type = genomic DNA
cccagacgaggttcccggcgcgatggggccgggatgggggtcctgggcacagtcagagtccccaccccctcccccgggaactgcatcggccagacgttcgccatggctgagatgaaggtggtcctggcgctcacgctgctgcgcttccgcgtcctgccggaccacgcggagccccgcaggaagctggagctgatcgtgcgcgcggaggatggactttggctacgggtggagcccctg

SEQ ID NO: 13244 - DNA, 138 bp, Homo sapiens; identical to SEQ ID NO: 1362
  misc_feature 1..138: note = chr19:17007251-17007389
  misc_feature 1..138: note = hyper
  source 1..138: mol_type = genomic DNA

SEQ ID NO: 13245 - DNA, 347 bp, Homo sapiens; identical to SEQ ID NO: 1363
  misc_feature 1..347: note = chr19:17007446-17007793
  misc_feature 1..347: note = hyper
  source 1..347: mol_type = genomic DNA

SEQ ID NO: 13246 - DNA, 44 bp, Homo sapiens; identical to SEQ ID NO: 4602
  misc_feature 1..44: note = chr19:17008475-17008519
  misc_feature 1..44: note = hyper
  source 1..44: mol_type = genomic DNA

SEQ ID NO: 13247 - DNA, 114 bp, Homo sapiens; identical to SEQ ID NO: 4603
  misc_feature 1..114: note = chr19:17008585-17008699
  misc_feature 1..114: note = hyper
  source 1..114: mol_type = genomic DNA

SEQ ID NO: 13248 - DNA, 276 bp, Homo sapiens
  misc_feature 1..276: note = chr19:17137083-17137359
  misc_feature 1..276: note = hyper
  source 1..276: mol_type = genomic DNA
cccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactca

SEQ ID NO: 13249 - DNA, 18 bp, Homo sapiens
  misc_feature 1..18: note = chr19:17137395-17137413
  misc_feature 1..18: note = hyper
  source 1..18: mol_type = genomic DNA
cgccgacagcagcaggag

SEQ ID NO: 13250 - DNA, 169 bp, Homo sapiens
  misc_feature 1..169: note = chr19:17392904-17393073
  misc_feature 1..169: note = hyper
  source 1..169: mol_type = genomic DNA
tttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatc

SEQ ID NO: 13251 - DNA, 398 bp, Homo sapiens; identical to SEQ ID NO: 4604
  misc_feature 1..398: note = chr19:17501241-17501639
  misc_feature 1..398: note = hyper
  source 1..398: mol_type = genomic DNA

SEQ ID NO: 13252 - DNA, 131 bp, Homo sapiens
  misc_feature 1..131: note = chr19:17717050-17717181
  misc_feature 1..131: note = hyper
  source 1..131: mol_type = genomic DNA
cacgcagctgcagcacggccagccccaccgtgcggtcctcgcgcgcgaagcagtagtccttgacgcacacctgcagctcatagcactcgggacccgcgtcggcgctcagcgtgctgcgtggggaggggcgg

SEQ ID NO: 13253 - DNA, 104 bp, Homo sapiens
  misc_feature 1..104: note = chr19:17717404-17717508
  misc_feature 1..104: note = hyper
  source 1..104: mol_type = genomic DNA
ccaccgaaaaatgaccgcatagttttacatccagctcccgcccctcagacaccgccctgcaaggccatgctcccaccctgagatacccgcgcctgtgccctctg

SEQ ID NO: 13254 - DNA, 296 bp, Homo sapiens
  misc_feature 1..296: note = chr19:17958515-17958811
  misc_feature 1..296: note = hyper
  source 1..296: mol_type = genomic DNA
tgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgaga

SEQ ID NO: 13255 - DNA, 149 bp, Homo sapiens
  misc_feature 1..149: note = chr19:17983002-17983151
  misc_feature 1..149: note = hyper
  source 1..149: mol_type = genomic DNA
gcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccgggga

SEQ ID NO: 13256 - DNA, 192 bp, Homo sapiens
  misc_feature 1..192: note = chr19:17983474-17983666
  misc_feature 1..192: note = hyper
  source 1..192: mol_type = genomic DNA
gcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcc

SEQ ID NO: 13257 - DNA, 41 bp, Homo sapiens
  misc_feature 1..41: note = chr19:18077737-18077778
  misc_feature 1..41: note = hyper
  source 1..41: mol_type = genomic DNA
gcaagagggggagttcgaagaccagccgcatgccggggggt

SEQ ID NO: 13258 - DNA, 39 bp, Homo sapiens
  misc_feature 1..39: note = chr19:18078233-18078272
  misc_feature 1..39: note = hyper
  source 1..39: mol_type = genomic DNA
aagagggagggtctccgtgcggtccggagcctaggagac

SEQ ID NO: 13259 - DNA, 371 bp, Homo sapiens
  misc_feature 1..371: note = chr19:18343439-18343810
  misc_feature 1..371: note = hyper
  source 1..371: mol_type = genomic DNA
atacccaagcatgaacgtacaggagcaccccaaacacatctggtcaccccagtctcacgcgcgcgcgcgcacacacacacacactctttcagtcccaaccgcacgtgggcacacccggtcacacagacccacaagccatgatgacaccagcaccctcagctccacccctacgtagaaatagctttttccttccaggcgccagcctcaaccaagcagcagagacccccgccccctggagaagcaaggaccctcccccactcccgccaggccccgcgcgcccctcccccgcgctgcaggaggcccctgccccggccacctaccgcctgcaggaggaaacgggccaggagagccgcgacttcctgagctccggc

SEQ ID NO: 13260 - DNA, 84 bp, Homo sapiens
  misc_feature 1..84: note = chr19:18343879-18343963
  misc_feature 1..84: note = hyper
  source 1..84: mol_type = genomic DNA
cggatggggcgccggggttgccgccacaggtgcttcggggctctggtcatgctgtggcggccgcgagagcgactcaacctgctg

SEQ ID NO: 13261 - DNA, 29 bp, Homo sapiens
  misc_feature 1..29: note = chr19:18714552-18714581
  misc_feature 1..29: note = hyper
  source 1..29: mol_type = genomic DNA
ggggcaaacttggctcgagggctctgtct

SEQ ID NO: 13262 - DNA, 11 bp, Homo sapiens
  misc_feature 1..11: note = chr19:18715071-18715082
  misc_feature 1..11: note = hyper
  source 1..11: mol_type = genomic DNA
gcgggggacac

SEQ ID NO: 13263 - skipped

SEQ ID NO: 13264 - DNA, 112 bp, Homo sapiens
  misc_feature 1..112: note = chr19:18899103-18899215
  misc_feature 1..112: note = hyper
  source 1..112: mol_type = genomic DNA
agttgggcacagtcacgcagttgtcctgggggcgggcacagaaggtgtgaggggcgcggtcatgaagtcccgccctccctcctgcccaagcccgccccgctccgcccccacc

SEQ ID NO: 13265 - DNA, 30 bp, Homo sapiens
  misc_feature 1..30: note = chr19:18900810-18900840
  misc_feature 1..30: note = hyper
  source 1..30: mol_type = genomic DNA
gcgcgcgccgctctccgtctggatgcaggc

SEQ ID NO: 13266 - DNA, 606 bp, Homo sapiens; identical to SEQ ID NO: 4605
  misc_feature 1..606: note = chr19:18901603-18902209
  misc_feature 1..606: note = hyper
  source 1..606: mol_type = genomic DNA

SEQ ID NO: 13267 - DNA, 30 bp, Homo sapiens
  misc_feature 1..30: note = chr19:19006120-19006150
  misc_feature 1..30: note = hyper
  source 1..30: mol_type = genomic DNA
cgctccgggccggggcgcagcccgcatggc

SEQ ID NO: 13268 - DNA, 131 bp, Homo sapiens
  misc_feature 1..131: note = chr19:19006691-19006822
  misc_feature 1..131: note = hyper
  source 1..131: mol_type = genomic DNA
ccagcagcagcagctcgggcggcgccaggtgcgcgtgctcagccaggccgcgacgcgccagcccccagccgcagtccgtgcagccccgcgccgccgccagcgcgctgccccagccgcgctgcactagctgc

SEQ ID NO: 13269 - DNA, 50 bp, Homo sapiens
  misc_feature 1..50: note = chr19:19322879-19322929
  misc_feature 1..50: note = hyper
  source 1..50: mol_type = genomic DNA
gatccgtgagggggccgtgttgcgggagaagacttcgggattagagacag

SEQ ID NO: 13270 - DNA, 54 bp, Homo sapiens
  misc_feature 1..54: note = chr19:19649100-19649154
  misc_feature 1..54: note = hyper
  source 1..54: mol_type = genomic DNA
agttggacccgagcacgccgcggagcccggaccctccctcggacgctctgcccc

SEQ ID NO: 13271 - DNA, 336 bp, Homo sapiens; identical to SEQ ID NO: 4606
  misc_feature 1..336: note = chr19:19651512-19651848
  misc_feature 1..336: note = hyper
  source 1..336: mol_type = genomic DNA

SEQ ID NO: 13272 - DNA, 50 bp, Homo sapiens; identical to SEQ ID NO: 4607
  misc_feature 1..50: note = chr19:19651990-19652040
  misc_feature 1..50: note = hyper
  source 1..50: mol_type = genomic DNA

SEQ ID NO: 13273 - DNA, 30 bp, Homo sapiens
  misc_feature 1..30: note = chr19:19932203-19932233
  misc_feature 1..30: note = hyper
  source 1..30: mol_type = genomic DNA
aaagacaggacaccccggggacccgctgtc

SEQ ID NO: 13274 - DNA, 29 bp, Homo sapiens
  misc_feature 1..29: note = chr19:19932565-19932594
  misc_feature 1..29: note = hyper
  source 1..29: mol_type = genomic DNA
gccaaagccggaagccggaaaccgtcctg

SEQ ID NO: 13275 - DNA, 120 bp, Homo sapiens
  misc_feature 1..120: note = chr19:20012036-20012156
  misc_feature 1..120: note = hyper
  source 1..120: mol_type = genomic DNA
ggttcccttcagccataagatggcggctgcgcttatagcgcagcccccaggcgtcctgtctcttcactgtgcggtgactgtgccctggcttggagccctcgctgggcagctgcgcacccg

SEQ ID NO: 13276 - DNA, 408 bp, Homo sapiens
  misc_feature 1..408: note = chr19:20149780-20150188
  misc_feature 1..408: note = hyper
  source 1..408: mol_type = genomic DNA
aagactgaggacccccgggatcacagcacttcccacgcacaaaccacacacggggtctggactctgccctgaggacgcttccattgtccccgcagtcggggcagacgcaagaacgcgcgcggctcttcccagggtgggctccgggcgggaagcgggagaacggaacgggatgcccgcccagggtcccggctgctggcccacctcgcatcctgtgcccggaggtgatcgacggccgagctgtgcctgccggggactccagtccgcagactccggagctgacagctgggaggccccagtcccgtcactgccggttccggccggtttcaaccagccctgcccccacctcgggatgcgcggcctggcacactcaccatttttcggcttccgggatgtcgtggagtcttagct

SEQ ID NO: 13277 - DNA, 148 bp, Homo sapiens
  misc_feature 1..148: note = chr19:20162757-20162905
  misc_feature 1..148: note = hyper
  source 1..148: mol_type = genomic DNA
ggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagc

SEQ ID NO: 13278 - DNA, 388 bp, Homo sapiens
  misc_feature 1..388: note = chr19:20162906-20163294
  misc_feature 1..388: note = hyper
  source 1..388: mol_type = genomic DNA
cgcacagggatcagggactgtgcgcatcactggaagaagcggcagaacggcgcgcgcctcgctgagctttctgggagatgtagtctcatggcaactcccagccttttggccacaaggctacgggacctacaatcccagcctgtaccaggatcgggagcagttcgcagcactagaggaaggggcagggcggtgcgcgccgcgcctgatatgctgggagctgtagtctcttcacggtttttagccaatgagtaggtagcttcagaactacaatcccagtatgcatgggggcggtgcgtagtcctggaggtaggggctgagaggtgtggacttaccggtgtccaaagcattgctagcagccaattccatgccgccccgttgccagggagag

SEQ ID NO: 13279 - DNA, 30 bp, Homo sapiens
  misc_feature 1..30: note = chr19:20188913-20188943
  misc_feature 1..30: note = hyper
  source 1..30: mol_type = genomic DNA
cagctgagggacccccggaagcctagaaat

SEQ ID NO: 13280 - DNA, 300 bp, Homo sapiens; identical to SEQ ID NO: 4608
  misc_feature 1..300: note = chr19:22018420-22018720
  misc_feature 1..300: note = hyper
  source 1..300: mol_type = genomic DNA

SEQ ID NO: 13281 - DNA, 58 bp, Homo sapiens; identical to SEQ ID NO: 4609
  misc_feature 1..58: note = chr19:22018900-22018958
  misc_feature 1..58: note = hyper
  source 1..58: mol_type = genomic DNA

SEQ ID NO: 13282 - DNA, 61 bp, Homo sapiens; identical to SEQ ID NO: 4610
  misc_feature 1..61: note = chr19:22018959-22019020
  misc_feature 1..61: note = hyper
  source 1..61: mol_type = genomic DNA

SEQ ID NO: 13283 - DNA, 28 bp, Homo sapiens
  misc_feature 1..28: note = chr19:22019080-22019108
  misc_feature 1..28: note = hyper
  source 1..28: mol_type = genomic DNA
aaggtcctgcccccgcaaaccctgaatg

SEQ ID NO: 13284 - DNA, 39 bp, Homo sapiens; identical to SEQ ID NO: 4612
  misc_feature 1..39: note = chr19:22034379-22034418
  misc_feature 1..39: note = hyper
  source 1..39: mol_type = genomic DNA

SEQ ID NO: 13285 - skipped

SEQ ID NO: 13286 - DNA, 592 bp, Homo sapiens; identical to SEQ ID NO: 4614
  misc_feature 1..592: note = chr19:22034446-22035038
  misc_feature 1..592: note = hyper
  source 1..592: mol_type = genomic DNA

SEQ ID NO: 13287 - DNA, 404 bp, Homo sapiens
  misc_feature 1..404: note = chr19:22715206-22715610
  misc_feature 1..404: note = hyper
  source 1..404: mol_type = genomic DNA
gtggggttggggccacgtcagctagattgcggcttaccactggggaacaattcctgtcggccaccgcgcaactgtgcgactgaccagaggaggcgtaaccagggcctactacagcgcagaatagggggcgtggccgccatcctccaagtccattggtcgatgagaaagatgacagagaaaggaggcgaggccaggcagcagcgcgtccaggtgggtgtgaggcgtcacaaggaaagctgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagag

SEQ ID NO: 13288 - skipped

SEQ ID NO: 13289 - DNA, 67 bp, Homo sapiens
  misc_feature 1..67: note = chr19:23254158-23254225
  misc_feature 1..67: note = hyper
  source 1..67: mol_type = genomic DNA
ttcagctgaaggctgcgggccttcccgagctccgcccagctcacagcggggacggtccctccctcgg

SEQ ID NO: 13290 - DNA, 256 bp, Homo sapiens; identical to SEQ ID NO: 1364
  misc_feature 1..256: note = chr19:23257752-23258008
  misc_feature 1..256: note = hyper
  source 1..256: mol_type = genomic DNA

SEQ ID NO: 13291 - DNA, 287 bp, Homo sapiens; identical to SEQ ID NO: 1365
  misc_feature 1..287: note = chr19:23258305-23258592
  misc_feature 1..287: note = hyper
  source 1..287: mol_type = genomic DNA

SEQ ID NO: 13292 - DNA, 79 bp, Homo sapiens; identical to SEQ ID NO: 1366
  misc_feature 1..79: note = chr19:23258652-23258731
  misc_feature 1..79: note = hyper
  source 1..79: mol_type = genomic DNA

SEQ ID NO: 13293 - DNA, 218 bp, Homo sapiens; identical to SEQ ID NO: 4618
  misc_feature 1..218: note = chr19:23299712-23299930
  misc_feature 1..218: note = hyper
  source 1..218: mol_type = genomic DNA

SEQ ID NO: 13294 - DNA, 16 bp, Homo sapiens
  misc_feature 1..16: note = chr19:23300338-23300354
  misc_feature 1..16: note = hyper
  source 1..16: mol_type = genomic DNA
gcgttcccaattcctc

SEQ ID NO: 13295 - DNA, 30 bp, Homo sapiens
  misc_feature 1..30: note = chr19:23386702-23386732
  misc_feature 1..30: note = hyper
  source 1..30: mol_type = genomic DNA
aggccggagtctgcccggcccagcccctcc

SEQ ID NO: 13296 - DNA, 38 bp, Homo sapiens
  misc_feature 1..38: note = chr19:23598448-23598486
  misc_feature 1..38: note = hyper
  source 1..38: mol_type = genomic DNA
aatctgggaaacactcggggctgcgtgcagagctgccc

SEQ ID NO: 13297 - DNA, 30 bp, Homo sapiens
  misc_feature 1..30: note = chr19:23598726-23598756
  misc_feature 1..30: note = hyper
  source 1..30: mol_type = genomic DNA
ttagctgtctgtgcacgtcccaggacctgc

SEQ ID NO: 13298 - DNA, 86 bp, Homo sapiens
  misc_feature 1..86: note = chr19:23654103-23654189
  misc_feature 1..86: note = hyper
  source 1..86: mol_type = genomic DNA
cgcatcgaggatgtgacccattccctggccaagggtgtgggtggggaacggcaaccgatctcactgcctggcggggcagcttcctt

SEQ ID NO: 13299 - DNA, 391 bp, Homo sapiens; identical to SEQ ID NO: 1367
  misc_feature 1..391: note = chr19:30015572-30015963
  misc_feature 1..391: note = hyper
  source 1..391: mol_type = genomic DNA

SEQ ID NO: 13300 - DNA, 724 bp, Homo sapiens; identical to SEQ ID NO: 1368
  misc_feature 1..724: note = chr19:30016024-30016748
  misc_feature 1..724: note = hyper
  source 1..724: mol_type = genomic DNA

SEQ ID NO: 13301 - DNA, 59 bp, Homo sapiens; identical to SEQ ID NO: 1369
  misc_feature 1..59: note = chr19:30017451-30017510
  misc_feature 1..59: note = hyper
  source 1..59: mol_type = genomic DNA

SEQ ID NO: 13302 - DNA, 145 bp, Homo sapiens; identical to SEQ ID NO: 1370
  misc_feature 1..145: note = chr19:30017577-30017722
  misc_feature 1..145: note = hyper
  source 1..145: mol_type = genomic DNA

SEQ ID NO: 13303 - DNA, 967 bp, Homo sapiens; identical to SEQ ID NO: 1371
  misc_feature 1..967: note = chr19:30017765-30018732
  misc_feature 1..967: note = hyper
  source 1..967: mol_type = genomic DNA

SEQ ID NO: 13304 - DNA, 416 bp, Homo sapiens; identical to SEQ ID NO: 1372
  misc_feature 1..416: note = chr19:30019113-30019529
  misc_feature 1..416: note = hyper
  source 1..416: mol_type = genomic DNA

SEQ ID NO: 13305 - DNA, 81 bp, Homo sapiens; identical to SEQ ID NO: 1373
  misc_feature 1..81: note = chr19:30019530-30019611
  misc_feature 1..81: note = hyper
  source 1..81: mol_type = genomic DNA

SEQ ID NO: 13306 - DNA, 252 bp, Homo sapiens; identical to SEQ ID NO: 1374
  misc_feature 1..252: note = chr19:30019660-30019912
  misc_feature 1..252: note = hyper
  source 1..252: mol_type = genomic DNA

SEQ ID NO: 13307 - DNA, 153 bp, Homo sapiens; identical to SEQ ID NO: 4627
  misc_feature 1..153: note = chr19:30020190-30020343
  misc_feature 1..153: note = hyper
  source 1..153: mol_type = genomic DNA

SEQ ID NO: 13308 - DNA, 103 bp, Homo sapiens
  misc_feature 1..103: note = chr19:30021252-30021355
  misc_feature 1..103: note = hyper
  source 1..103: mol_type = genomic DNA
cgccgggacgccccggggggctccggacccaggacccgccccctgggcgcatttgcatatgcatactccttcctagttaggtcgggagcgccccccccagggc

SEQ ID NO: 13309 - DNA, 339 bp, Homo sapiens
  misc_feature 1..339: note = chr19:30215072-30215411
  misc_feature 1..339: note = hyper
  source 1..339: mol_type = genomic DNA
tgccagggggagctgcgcggggcaggcccggggtaccagaggcccttgctttagcggcggccctgcgtgtgccagaggcttgcagagtgatctgagcacgccaagagattgctgtcaagtaagctcctccacaaatctgcagaaacctcaaagattacagcgctcgcacggcaggagcgcagcggcttcccatacgccggcagacaatggggcggaggaaggaaggggacggtggcctggggacccccgcgcccgcagcacgtgcaccgagcctggagcgcccgctttacagatcttgtcgctccacccctaaaacaaaggccccggggccccatctgt

SEQ ID NO: 13310 - DNA, 135 bp, Homo sapiens; identical to SEQ ID NO: 4628
  misc_feature 1..135: note = chr19:30713458-30713593
  misc_feature 1..135: note = hyper
  source 1..135: mol_type = genomic DNA

SEQ ID NO: 13311 - DNA, 123 bp, Homo sapiens; identical to SEQ ID NO: 4629
  misc_feature 1..123: note = chr19:30713685-30713808
  misc_feature 1..123: note = hyper
  source 1..123: mol_type = genomic DNA

SEQ ID NO: 13312 - DNA, 476 bp, Homo sapiens; identical to SEQ ID NO: 4630
  misc_feature 1..476: note = chr19:30715393-30715869
  misc_feature 1..476: note = hyper
  source 1..476: mol_type = genomic DNA

SEQ ID NO: 13313 - DNA, 457 bp, Homo sapiens; identical to SEQ ID NO: 1375
  misc_feature 1..457: note = chr19:30716313-30716770
  misc_feature 1..457: note = hyper
  source 1..457: mol_type = genomic DNA

SEQ ID NO: 13314 - DNA, 779 bp, Homo sapiens; identical to SEQ ID NO: 1376
  misc_feature 1..779: note = chr19:30716952-30717731
  misc_feature 1..779: note = hyper
  source 1..779: mol_type = genomic DNA

SEQ ID NO: 13315 - DNA, 833 bp, Homo sapiens
  misc_feature 1..833: note = chr19:30717942-30718775
  misc_feature 1..833: note = hyper
  source 1..833: mol_type = genomic DNA
aaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcg

SEQ ID NO: 13316 - DNA, 756 bp, Homo sapiens; identical to SEQ ID NO: 1377
  misc_feature 1..756: note = chr19:30719283-30720039
  misc_feature 1..756: note = hyper
  source 1..756: mol_type = genomic DNA

SEQ ID NO: 13317 - DNA, 330 bp, Homo sapiens; identical to SEQ ID NO: 4634
  misc_feature 1..330: note = chr19:30865695-30866025
  misc_feature 1..330: note = hyper
  source 1..330: mol_type = genomic DNA

SEQ ID NO: 13318 - DNA, 91 bp, Homo sapiens
  misc_feature 1..91: note = chr19:31839837-31839928
  misc_feature 1..91: note = hyper
  source 1..91: mol_type = genomic DNA
cggctcagcgcgctccgcgagcggctccccaaatgggtgcgagagggaagagggcagagcgcggcggggcgtccggggggcgcccggtacc

SEQ ID NO: 13319 - DNA, 102 bp, Homo sapiens
  misc_feature 1..102: note = chr19:31839941-31840043
  misc_feature 1..102: note = hyper
  source 1..102: mol_type = genomic DNA
cgcacccaaacaggagagcggcgcccggagttactcagtgcgggcagaagagcggggcgaggagcggggtcgcgcccgctggaggcgcggggcgagcggagg

SEQ ID NO: 13320 - DNA, 30 bp, Homo sapiens
  misc_feature 1..30: note = chr19:31840866-31840896
  misc_feature 1..30: note = hyper
  source 1..30: mol_type = genomic DNA
ccgcccctccgcctccgccccgtgcgcaca

SEQ ID NO: 13321 - DNA, 37 bp, Homo sapiens
  misc_feature 1..37: note = chr19:31841109-31841146
  misc_feature 1..37: note = hyper
  source 1..37: mol_type = genomic DNA
cagggaggaggcgggcgcgggccggggcgggtggggg

SEQ ID NO: 13322 - DNA, 30 bp, Homo sapiens
  misc_feature 1..30: note = chr19:31841471-31841501
  misc_feature 1..30: note = hyper
  source 1..30: mol_type = genomic DNA
ccgcgcccggcctgccggggctgctggact

SEQ ID NO: 13323 - DNA, 122 bp, Homo sapiens
  misc_feature 1..122: note = chr19:31842359-31842481
  misc_feature 1..122: note = hyper
  source 1..122: mol_type = genomic DNA
gcggggcagggagtccgaggcgggctgcggcggggctctcgggctggcggactcgggggctgaggcgccgtgcgcgttgggtgcccgcggccgcagaggccagaaccgctactcctccaggc

SEQ ID NO: 13324 - DNA, 146 bp, Homo sapiens; identical to SEQ ID NO: 4635
  misc_feature 1..146: note = chr19:32715595-32715741
  misc_feature 1..146: note = hyper
  source 1..146: mol_type = genomic DNA

SEQ ID NO: 13325 - DNA, 360 bp, Homo sapiens; identical to SEQ ID NO: 4636
  misc_feature 1..360: note = chr19:33166988-33167348
  misc_feature 1..360: note = hyper
  source 1..360: mol_type = genomic DNA

SEQ ID NO: 13326 - DNA, 296 bp, Homo sapiens
  misc_feature 1..296: note = chr19:34112434-34112730
  misc_feature 1..296: note = hyper
  source 1..296: mol_type = genomic DNA
gctgtggtcaaggcccgccccggtgacgcctggtccttttcccgggttggcgccgcgtgcgacccaccgaggcagtggcagcactggccgcggtctggagcctagcgtcaggccggagtccggctctcctgaaccgggagaccggcgcagccccagccacgaccgctcccacccccgcggccgccggaccgcgcccagcagcgactctttctgagagcgctgccagaggggccgcgggagccgcagagcgcgcgtgggcgcggcgcccgcgagcccccgggagggccgagtgcatc

SEQ ID NO: 13327 - DNA, 15 bp, Homo sapiens
  misc_feature 1..15: note = chr19:34113288-34113303
  misc_feature 1..15: note = hyper
  source 1..15: mol_type = genomic DNA
ggccccggactgcac

SEQ ID NO: 13328 - DNA, 33 bp, Homo sapiens
  misc_feature 1..33: note = chr19:34113879-34113912
  misc_feature 1..33: note = hyper
  source 1..33: mol_type = genomic DNA
cgagccgagctctgacggcggctgcaactccgg

SEQ ID NO: 13329 - DNA, 66 bp, Homo sapiens
  misc_feature 1..66: note = chr19:34288609-34288675
  misc_feature 1..66: note = hyper
  source 1..66: mol_type = genomic DNA
ccggcggcccccacccgcgactgcagaaagataagcttcaagttttcgctccgtatctcaaatgtg

SEQ ID NO: 13330 - DNA, 41 bp, Homo sapiens
  misc_feature 1..41: note = chr19:34973656-34973697
  misc_feature 1..41: note = hyper
  source 1..41: mol_type = genomic DNA
gggtgcagcagtgcacggggttgggacgaggaaggtgcatc

SEQ ID NO: 13331 - DNA, 30 bp, Homo sapiens
  misc_feature 1..30: note = chr19:35068705-35068735
  misc_feature 1..30: note = hyper
  source 1..30: mol_type = genomic DNA
tccccgcccctgccccgcccccagcccctc

SEQ ID NO: 13332 - DNA, 151 bp, Homo sapiens
  misc_feature 1..151: note = chr19:35263633-35263784
  misc_feature 1..151: note = hyper
  source 1..151: mol_type = genomic DNA
agaagcacagagtcccggcatccgccgtattacagcggatgggtgcatgcgggcggtgacccgagctcgcgcgggctgcggaaccctccactcaccaacgccggcgccgccatgggcccagggggctgggtgaggccgtgagagtcggcga

SEQ ID NO: 13333 - DNA, 191 bp, Homo sapiens
  misc_feature 1..191: note = chr19:35396250-35396441
  misc_feature 1..191: note = hyper
  source 1..191: mol_type = genomic DNA
cgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtg

SEQ ID NO: 13334 - DNA, 126 bp, Homo sapiens
  misc_feature 1..126: note = chr19:35531737-35531863
  misc_feature 1..126: note = hyper
  source 1..126: mol_type = genomic DNA
tggaggaaatgggtgcggtggaggtgggtttggctgggcacagcgggcacgtgtgggtaagcgggtggggccggttgtgcgggtggcctatctggggcaagcagccgaggccgactgtgtccggcg

SEQ ID NO: 13335 - DNA, 507 bp, Homo sapiens; identical to SEQ ID NO: 4637
  misc_feature 1..507: note = chr19:36048580-36049087
  misc_feature 1..507: note = hyper
  source 1..507: mol_type = genomic DNA

SEQ ID NO: 13336 - DNA, 146 bp, Homo sapiens
  misc_feature 1..146: note = chr19:36335058-36335204
  misc_feature 1..146: note = hyper
  source 1..146: mol_type = genomic DNA
gcagctgatagaggccgtcgtccgcgcgggtcacattccacagatgcagagccccgctggacaggatgcgatgccgggggccgcccgctggggaaggccagaataagggacctggcaggacctcccatccccgggacccctcccca

SEQ ID NO: 13337 - DNA, 53 bp, Homo sapiens
  misc_feature 1..53: note = chr19:36337032-36337085
  misc_feature 1..53: note = hyper
  source 1..53: mol_type = genomic DNA
cgctgccgagatgcacgcgccgcgactcctgcggcagccgcgactcggtcacg

SEQ ID NO: 13338 - DNA, 30 bp, Homo sapiens
  misc_feature 1..30: note = chr19:36347846-36347876
  misc_feature 1..30: note = hyper
  source 1..30: mol_type = genomic DNA
gagcgtcagaggctgcggatgagcagactt

SEQ ID NO: 13339 - DNA, 43 bp, Homo sapiens
  misc_feature 1..43: note = chr19:36351905-36351948
  misc_feature 1..43: note = hyper
  source 1..43: mol_type = genomic DNA
cgggtaacctggacccgccgcggtggcgcgcaggtacagccct

SEQ ID NO: 13340 - DNA, 30 bp, Homo sapiens
  misc_feature 1..30: note = chr19:36361080-36361110
  misc_feature 1..30: note = hyper
  source 1..30: mol_type = genomic DNA
aagacaaatttataacgggaagggagagtt

SEQ ID NO: 13341 - DNA, 174 bp, Homo sapiens; identical to SEQ ID NO: 4638
  misc_feature 1..174: note = chr19:36450122-36450296
  misc_feature 1..174: note = hyper
  source 1..174: mol_type = genomic DNA

SEQ ID NO: 13342 - DNA, 15 bp, Homo sapiens
  misc_feature 1..15: note = chr19:36450544-36450559
  misc_feature 1..15: note = hyper
  source 1..15: mol_type = genomic DNA
cgccccagggtcgct

SEQ ID NO: 13343 - DNA, 73 bp, Homo sapiens; identical to SEQ ID NO: 4640
  misc_feature 1..73: note = chr19:36523333-36523406
  misc_feature 1..73: note = hyper
  source 1..73: mol_type = genomic DNA

SEQ ID NO: 13344 - DNA, 93 bp, Homo sapiens
  misc_feature 1..93: note = chr19:36523623-36523716
  misc_feature 1..93: note = hyper
  source 1..93: mol_type = genomic DNA
acctcgggcagacagcgctggggaccaaagtggagactggggagactgtgggagcaatggggtgtcggtgtcaggggacgtgatgggggaggc

SEQ ID NO: 13345 - DNA, 84 bp, Homo sapiens; identical to SEQ ID NO: 4641
  misc_feature 1..84: note = chr19:36736319-36736403
  misc_feature 1..84: note = hyper
  source 1..84: mol_type = genomic DNA

SEQ ID NO: 13346 - DNA, 225 bp, Homo sapiens; identical to SEQ ID NO: 4642
  misc_feature 1..225: note = chr19:36822242-36822467
  misc_feature 1..225: note = hyper
  source 1..225: mol_type = genomic DNA

SEQ ID NO: 13347 - DNA, 146 bp, Homo sapiens; identical to SEQ ID NO: 4643
  misc_feature 1..146: note = chr19:36822557-36822703
  misc_feature 1..146: note = hyper
  source 1..146: mol_type = genomic DNA

SEQ ID NO: 13348 - DNA, 280 bp, Homo sapiens; identical to SEQ ID NO: 1378
  misc_feature 1..280: note = chr19:36909069-36909349
  misc_feature 1..280: note = hyper
  source 1..280: mol_type = genomic DNA

SEQ ID NO: 13349 - DNA, 244 bp, Homo sapiens; identical to SEQ ID NO: 1379
  misc_feature 1..244: note = chr19:36909623-36909867
  misc_feature 1..244: note = hyper
  source 1..244: mol_type = genomic DNA

SEQ ID NO: 13350 - DNA, 15 bp, Homo sapiens
  misc_feature 1..15: note = chr19:36912335-36912350
  misc_feature 1..15: note = hyper
  source 1..15: mol_type = genomic DNA
ggcaccaggggacgc

SEQ ID NO: 13351 - DNA, 15 bp, Homo sapiens
  misc_feature 1..15: note = chr19:36912480-36912495
  misc_feature 1..15: note = hyper
  source 1..15: mol_type = genomic DNA
cgagacaagccggtg

SEQ ID NO: 13352 - DNA, 33 bp, Homo sapiens; identical to SEQ ID NO: 4646
  misc_feature 1..33: note = chr19:37096487-37096520
  misc_feature 1..33: note = hyper
  source 1..33: mol_type = genomic DNA

SEQ ID NO: 13353 - DNA, 560 bp, Homo sapiens
  misc_feature 1..560: note = chr19:37157617-37158177
  misc_feature 1..560: note = hyper
  source 1..560: mol_type = genomic DNA
gtccaagctctgattcggattccaagcgaagccacacgcccagctcttccttctccaccggcccgggacatccttacctgcctctacccggagaccattcctgcgaggctcctaccggaagtagctgtggacagcagtgtcctctgggaaatgcagtccgaggggagagcgcctggggtggagcgggtgtgttccgccgggctccgggatgcacttgcgcagtttcacccgaggctggagtgacgccaacctgttaatgttcgttttcggattctggacttcgggttccgctgaggacggatttcggaataggcacagtggctgccccgaacccctcaaggcggcctccgcgggctgtggctgaagataattttcggcgggcgcggactaacccggcttccctttgtggagttgtggtgagaaaggtgttttgttgtgcgcgtgtccgaaggtgactccggaggagaaggtggatatgaactgacggtgagggtgtagcgcgtgagatttgtatgtgaaacgatttaaaaaaaaattttttttttggccgggcgcggtgg

SEQ ID NO: 13354 - DNA, 66 bp, Homo sapiens
  misc_feature 1..66: note = chr19:37263373-37263439
  misc_feature 1..66: note = hyper
  source 1..66: mol_type = genomic DNA
acccaccccgggacacgcagtccaaccacacagtcaccggttcttcacatccgcacgcacaacgag

SEQ ID NO: 13355 - DNA, 37 bp, Homo sapiens
  misc_feature 1..37: note = chr19:37263751-37263788
  misc_feature 1..37: note = hyper
  source 1..37: mol_type = genomic DNA
cgcgagacgtggcgtcggcctgcgggatcctctggga

SEQ ID NO: 13356 - DNA, 171 bp, Homo sapiens; identical to SEQ ID NO: 1380
  misc_feature 1..171: note = chr19:37264222-37264393
  misc_feature 1..171: note = hyper
  source 1..171: mol_type = genomic DNA

SEQ ID NO: 13357 - DNA, 25 bp, Homo sapiens
  misc_feature 1..25: note = chr19:37287936-37287961
  misc_feature 1..25: note = hyper
  source 1..25: mol_type = genomic DNA
tttgttttttgaaaccgagtttcgc

SEQ ID NO: 13358 - DNA, 224 bp, Homo sapiens; identical to SEQ ID NO: 1382
  misc_feature 1..224: note = chr19:37288201-37288425
  misc_feature 1..224: note = hyper
  source 1..224: mol_type = genomic DNA

SEQ ID NO: 13359 - DNA, 99 bp, Homo sapiens; identical to SEQ ID NO: 1383
  misc_feature 1..99: note = chr19:37288606-37288705
  misc_feature 1..99: note = hyper
  source 1..99: mol_type = genomic DNA

SEQ ID NO: 13360 - DNA, 59 bp, Homo sapiens; identical to SEQ ID NO: 1384
  misc_feature 1..59: note = chr19:37288706-37288765
  misc_feature 1..59: note = hyper
  source 1..59: mol_type = genomic DNA

SEQ ID NO: 13361 - DNA, 112 bp, Homo sapiens
  misc_feature 1..112: note = chr19:37329256-37329368
  misc_feature 1..112: note = hyper
  source 1..112: mol_type = genomic DNA
gatggtggaaggttccgcgatctttctattaaccctaaagggacagagggctgacaggaagttgcccggggaacggtgcactctgggaaatgtagtccggagcctgggccgt

SEQ ID NO: 13362 - DNA, 32 bp, Homo sapiens
  misc_feature 1..32: note = chr19:37342101-37342133
  misc_feature 1..32: note = hyper
  source 1..32: mol_type = genomic DNA
gtgaggttcctggaccgcggttgtgactgtat

SEQ ID NO: 13363 - DNA, 108 bp, Homo sapiens; identical to SEQ ID NO: 4652
  misc_feature 1..108: note = chr19:37406765-37406873
  misc_feature 1..108: note = hyper
  source 1..108: mol_type = genomic DNA

SEQ ID NO: 13364 - DNA, 71 bp, Homo sapiens; identical to SEQ ID NO: 1385
  misc_feature 1..71: note = chr19:37407081-37407152
  misc_feature 1..71: note = hyper
  source 1..71: mol_type = genomic DNA

SEQ ID NO: 13365 - DNA, 221 bp, Homo sapiens; identical to SEQ ID NO: 1386
  misc_feature 1..221: note = chr19:37407153-37407374
  misc_feature 1..221: note = hyper
  source 1..221: mol_type = genomic DNA

SEQ ID NO: 13366 - DNA, 68 bp, Homo sapiens; identical to SEQ ID NO: 1387
  misc_feature 1..68: note = chr19:37407375-37407443
  misc_feature 1..68: note = hyper
  source 1..68: mol_type = genomic DNA

SEQ ID NO: 13367 - DNA, 271 bp, Homo sapiens
  misc_feature 1..271: note = chr19:37464095-37464366
  misc_feature 1..271: note = hyper
  source 1..271: mol_type = genomic DNA
gtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggat

SEQ ID NO: 13368 - DNA, 61 bp, Homo sapiens
  misc_feature 1..61: note = chr19:37464666-37464727
  misc_feature 1..61: note = hyper
  source 1..61: mol_type = genomic DNA
cgtgtgccgggtcatcgaccccatctttgggaggcctgggagggggcgggacaccctcgct

SEQ ID NO: 13369 - DNA, 809 bp, Homo sapiens
  misc_feature 1..809: note = chr19:37957671-37958480
  misc_feature 1..809: note = hyper
  source 1..809: mol_type = genomic DNA
tcccactgtcatgcacgtttgcacgcaggttcatactgaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccgaccccacctgcaaaaaggcacttccttcttacagtcggctggagctgcaggttcgcaaggtccgtgaaggaagcccggctcagtgtgttt

SEQ ID NO: 13370 - DNA, 572 bp, Homo sapiens
  misc_feature 1..572: note = chr19:37959933-37960505
  misc_feature 1..572: note = hyper
  source 1..572: mol_type = genomic DNA
gggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccac

SEQ ID NO: 13371 - DNA, 153 bp, Homo sapiens; identical to SEQ ID NO: 4656
  misc_feature 1..153: note = chr19:37997838-37997991
  misc_feature 1..153: note = hyper
  source 1..153: mol_type = genomic DNA

SEQ ID NO: 13372 - DNA, 117 bp, Homo sapiens; identical to SEQ ID NO: 4657
  misc_feature 1..117: note = chr19:37997992-37998109
  misc_feature 1..117: note = hyper
  source 1..117: mol_type = genomic DNA

SEQ ID NO: 13373 - DNA, 201 bp, Homo sapiens; identical to SEQ ID NO: 4658
  misc_feature 1..201: note = chr19:38042365-38042566
  misc_feature 1..201: note = hyper
  source 1..201: mol_type = genomic DNA

SEQ ID NO: 13374 - DNA, 35 bp, Homo sapiens
  misc_feature 1..35: note = chr19:38146647-38146682
  misc_feature 1..35: note = hyper
  source 1..35: mol_type = genomic DNA
ttttcatttggttctcggctcggagacaggcggag

SEQ ID NO: 13375 - DNA, 209 bp, Homo sapiens
  misc_feature 1..209: note = chr19:38147011-38147220
  misc_feature 1..209: note = hyper
  source 1..209: mol_type = genomic DNA
cccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcgg

SEQ ID NO: 13376 - DNA, 129 bp, Homo sapiens
  misc_feature 1..129: note = chr19:38182831-38182960
  misc_feature 1..129: note = hyper
  source 1..129: mol_type = genomic DNA
gcgggcactcactctcgctcacactacaatcagatcctccatgcggctttcatatactctgtcacactcgcagccagaatcccctcggatggactcttgcaaacctccagccccatcccgggatccgtg

SEQ ID NO: 13377 - DNA, 33 bp, Homo sapiens
  misc_feature 1..33: note = chr19:38183111-38183144
  misc_feature 1..33: note = hyper
  source 1..33: mol_type = genomic DNA
cgctcccacgtctccgggcgcagcttgtgccag

SEQ ID NO: 13378 - DNA, 34 bp, Homo sapiens; identical to SEQ ID NO: 4659
  misc_feature 1..34: note = chr19:38183440-38183474
  misc_feature 1..34: note = hyper
  source 1..34: mol_type = genomic DNA

SEQ ID NO: 13379 - DNA, 83 bp, Homo sapiens
  misc_feature 1..83: note = chr19:38210615-38210698
  misc_feature 1..83: note = hyper
  source 1..83: mol_type = genomic DNA
gcgcctcccacccaccgctcgagccccggagacttctgggagtggccgccttgcctcgagtgcgcatgcgcagatcggccact

SEQ ID NO: 13380 - DNA, 73 bp, Homo sapiens
  misc_feature 1..73: note = chr19:38308247-38308320
  misc_feature 1..73: note = hyper
  source 1..73: mol_type = genomic DNA
tggggctgctggaggcgttcagagcgcggaggccccaggcgcgggccgggctctctcccgcctcctcaggccc

SEQ ID NO: 13381 - DNA, 30 bp, Homo sapiens
  misc_feature 1..30: note = chr19:38701199-38701229
  misc_feature 1..30: note = hyper
  source 1..30: mol_type = genomic DNA
ccaccttatcgccaccgctgatttgcccca

SEQ ID NO: 13382 - DNA, 500 bp, Homo sapiens
  misc_feature 1..500: note = chr19:38701550-38702050
  misc_feature 1..500: note = hyper
  source 1..500: mol_type = genomic DNA
taggggctggctggtcgcctcacccccaacaaggcccgtcgacccccggtcctccttcttggtgatgccccaaaccagacgggagaacgaggcagtcgtgggcagaggggtcaggcccagtttaatacacagaacaagttaattcacagcagaggcaggcaatagaggagactcggtgacaagtgagggggcactcctggattaggggacatccccccaaaacccaccacctcccccacctgcagtctcagtttcccttttttaaaacccgaacaacaaacacacacaaccacaagaaacaaccacgccccctcactcccccaaaatggccagcgaggggggcgggggccgccaggcctggcggggcgggaggagggagagaaaaggagtccgtggcggagtctgtgcttctcattccagcaggcgctgggcgggggcccacccggccccaccaccgccacccaccagccacggcaggcacggggcgggcacaggctggg

SEQ ID NO: 13383 - DNA, 290 bp, Homo sapiens
  misc_feature 1..290: note = chr19:38746788-38747078
  misc_feature 1..290: note = hyper
  source 1..290: mol_type = genomic DNA
tacagctcctccaggcgcccgtcgatccacttctccacgtccagccgccgctgcagctcccgccggtcatacttgacggtgacgcgcgcgtgccgcttctgcagccccccgggactgccccctggcccgcgggcccgcgatggagactgcagcttgctcagcacgcgcttgcccagccgctgagctgccatcgcgctgctggacccagcctggccccgcgctgtgcgccttcgcctcgcgccccgggtgcttcttacgggccagggcggggctagccgggggcgggggct

SEQ ID NO: 13384 - DNA, 95 bp, Homo sapiens
  misc_feature 1..95: note = chr19:38747106-38747201
  misc_feature 1..95: note = hyper
  source 1..95: mol_type = genomic DNA
cggccgcctcaggcctcagtttccccgtctgcagtgcgagagtaggccgctgcgtcggcttgaggcacgcagtcgtgcgaagttgaggtatgggc

SEQ ID NO: 13385 - DNA, 190 bp, Homo sapiens
  misc_feature 1..190: note = chr19:38747202-38747392
  misc_feature 1..190: note = hyper
  source 1..190: mol_type = genomic DNA
gggacccagagtcccgggcgggtccctgcatcgggggctcccgggccgggatcctgtggggcgggggcctgggacagacactcgggacccggcctgtctgcgccctctggcggtggcggggtggggggctgttggtgcgggagcgcctgcgccgctgtcgctgtagaaggtcgagcggtcacttgttcct

SEQ ID NO: 13386 - DNA, 36 bp, Homo sapiens
  misc_feature 1..36: note = chr19:38877852-38877888
  misc_feature 1..36: note = hyper
  source 1..36: mol_type = genomic DNA
cttttcgggagcccccgcccgcggatggctccgact

SEQ ID NO: 13387 - DNA, 39 bp, Homo sapiens
  misc_feature 1..39: note = chr19:38924397-38924436
  misc_feature 1..39: note = hyper
  source 1..39: mol_type = genomic DNA
ccctcccgcccagcccgcagccccctccctctgttcccc

SEQ ID NO: 13388 - DNA, 95 bp, Homo sapiens
  misc_feature 1..95: note = chr19:38924437-38924532
  misc_feature 1..95: note = hyper
  source 1..95: mol_type = genomic DNA
acctcagaccctgggcttccgacctcgacatcatgggtgacgcagaaggcgaagacgaggtccagttcctgcggacggtgcgtatctctgggtta

SEQ ID NO: 13389 - DNA, 55 bp, Homo sapiens
  misc_feature 1..55: note = chr19:39282953-39283008
  misc_feature 1..55: note = hyper
  source 1..55: mol_type = genomic DNA
caccctcggggcagacgcgatggcagcggccccggctctgcggaacagctgggag

SEQ ID NO: 13390 - DNA, 39 bp, Homo sapiens
  misc_feature 1..39: note = chr19:39466291-39466330
  misc_feature 1..39: note = hyper
  source 1..39: mol_type = genomic DNA
agtcgaggggctccccgtgatcggcgtggcccagggggc

SEQ ID NO: 13391 - DNA, 42 bp, Homo sapiens
  misc_feature 1..42: note = chr19:39589777-39589819
  misc_feature 1..42: note = hyper
  source 1..42: mol_type = genomic DNA
tgtgggtgaggcatccgcaggggcgcgcgcagggacggtggg

SEQ ID NO: 13392 - DNA, 28 bp, Homo sapiens
  misc_feature 1..28: note = chr19:39687619-39687647
  misc_feature 1..28: note = hyper
  source 1..28: mol_type = genomic DNA
gggatggaggaggtgcgtgagggacacg

SEQ ID NO: 13393 - DNA, 204 bp, Homo sapiens
  misc_feature 1..204: note = chr19:39687755-39687959
  misc_feature 1..204: note = hyper
  source 1..204: mol_type = genomic DNA
cgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaag

SEQ ID NO: 13394 - DNA, 347 bp, Homo sapiens; identical to SEQ ID NO: 1388
  misc_feature 1..347: note = chr19:39754886-39755233
  misc_feature 1..347: note = hyper
  source 1..347: mol_type = genomic DNA

SEQ ID NO: 13395 - DNA, 156 bp, Homo sapiens; identical to SEQ ID NO: 1389
  misc_feature 1..156: note = chr19:39755264-39755420
  misc_feature 1..156: note = hyper
  source 1..156: mol_type = genomic DNA

SEQ ID NO: 13396 - DNA, 366 bp, Homo sapiens
  misc_feature 1..366: note = chr19:39989752-39990118
  misc_feature 1..366: note = hyper
  source 1..366: mol_type = genomic DNA
gtcctggggaaggagcgtggggcggacgggaagcctgggtcctcccggccgcctcaccctgcgcccgtctccgtcccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctgtaag

SEQ ID NO: 13397 - DNA, 223 bp, Homo sapiens; identical to SEQ ID NO: 4662
  misc_feature 1..223: note = chr19:39993434-39993657
  misc_feature 1..223: note = hyper
  source 1..223: mol_type = genomic DNA

SEQ ID NO: 13398 - DNA, 32 bp, Homo sapiens; identical to SEQ ID NO: 4663
  misc_feature 1..32: note = chr19:39997701-39997733
  misc_feature 1..32: note = hyper
  source 1..32: mol_type = genomic DNA

SEQ ID NO: 13399 - DNA, 238 bp, Homo sapiens; identical to SEQ ID NO: 4664
  misc_feature 1..238: note = chr19:39997748-39997986
  misc_feature 1..238: note = hyper
  source 1..238: mol_type = genomic DNA

SEQ ID NO: 13400 - DNA, 54 bp, Homo sapiens
  misc_feature 1..54: note = chr19:40005850-40005904
  misc_feature 1..54: note = hyper
  source 1..54: mol_type = genomic DNA
ccatgaataaccaggcgcggaccccagccccctcctcggcgcggacttcaacct

SEQ ID NO: 13401 - DNA, 63 bp, Homo sapiens
  misc_feature 1..63: note = chr19:40006576-40006639
  misc_feature 1..63: note = hyper
  source 1..63: mol_type = genomic DNA
ccttacagaattgtacggaaaccttcccctcctccagcgagaacttcgcgctggacaagaggg

SEQ ID NO: 13402 - DNA, 279 bp, Homo sapiens; identical to SEQ ID NO: 4665
  misc_feature 1..279: note = chr19:40724000-40724279
  misc_feature 1..279: note = hyper
  source 1..279: mol_type = genomic DNA

SEQ ID NO: 13403 - DNA, 84 bp, Homo sapiens
  misc_feature 1..84: note = chr19:41018532-41018616
  misc_feature 1..84: note = hyper
  source 1..84: mol_type = genomic DNA
caggtcatctgcaaccgcgtgaaccacgtgcacggctgcctggcggagctgcaggagcaggcagcgcggcgacgcgcggagctg

SEQ ID NO: 13404 - DNA, 333 bp, Homo sapiens
  misc_feature 1..333: note = chr19:41025379-41025712
  misc_feature 1..333: note = hyper
  source 1..333: mol_type = genomic DNA
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactg

SEQ ID NO: 13405 - DNA, 278 bp, Homo sapiens
  misc_feature 1..278: note = chr19:41059971-41060249
  misc_feature 1..278: note = hyper
  source 1..278: mol_type = genomic DNA
ccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtgga

SEQ ID NO: 13406 - DNA, 111 bp, Homo sapiens; identical to SEQ ID NO: 4666
  misc_feature 1..111: note = chr19:41073569-41073680
  misc_feature 1..111: note = hyper
  source 1..111: mol_type = genomic DNA

SEQ ID NO: 13407 - skipped

SEQ ID NO: 13408 - DNA, 59 bp, Homo sapiens
  misc_feature 1..59: note = chr19:41354396-41354455
  misc_feature 1..59: note = hyper
  source 1..59: mol_type = genomic DNA
ccagggctggaagtgcgggcgcctttccccacctagtccccatccccaggcagaacgcg

SEQ ID NO: 13409 - DNA, 162 bp, Homo sapiens
  misc_feature 1..162: note = chr19:41354575-41354737
  misc_feature 1..162: note = hyper
  source 1..162: mol_type = genomic DNA
cgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaag

SEQ ID NO: 13410 - DNA, 53 bp, Homo sapiens
  misc_feature 1..53: note = chr19:41596078-41596131
  misc_feature 1..53: note = hyper
  source 1..53: mol_type = genomic DNA
cgacgccctccggggcacgcacggtgagtaggggaccccgagtgcgagggcgg

SEQ ID NO: 13411 - DNA, 173 bp, Homo sapiens
  misc_feature 1..173: note = chr19:41641726-41641899
  misc_feature 1..173: note = hyper
  source 1..173: mol_type = genomic DNA
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgt

SEQ ID NO: 13412 - DNA, 459 bp, Homo sapiens
  misc_feature 1..459: note = chr19:42028283-42028742
  misc_feature 1..459: note = hyper
  source 1..459: mol_type = genomic DNA
tctaaaacaaaccaacgaggctgccaacctgtgagatagttggtccacttgtacaaaaccccctccatgcttcagagccccacaccgctcatcctcccggcccggcgccggccgcggtgatggggtaggcgcggggcctggggcagcctttcccggcccgcccgggccccctccgccggcacgaagccgctttctgcctgcgcgcgccgcagggacgtggcggcccttagaggccgggacagcgggcgcagcgtggagcttgggggccgcgaggcgcgggctcagacatccccgggtaagcctcggcggcggcggccgcgacaacggcaaaaatgcgactgcgaccgcgaccggtctcgtgctcgcgcttccgcggcccggctgctccctccggcgccccggcgctgcctcttcctcgcctgccttccttccccctgggctccccgtttgtttttcgac

SEQ ID NO: 13413 - DNA, 30 bp, Homo sapiens
  misc_feature 1..30: note = chr19:42574121-42574151
  misc_feature 1..30: note = hyper
  source 1..30: mol_type = genomic DNA
ggtggaagagaaaggcggaggagggtgggg

SEQ ID NO: 13414 - DNA, 133 bp, Homo sapiens
  misc_feature 1..133: note = chr19:42636456-42636589
  misc_feature 1..133: note = hyper
  source 1..133: mol_type = genomic DNA
ggggcaggcagggcccgcagagcaaacctaaatgtgctgcctgtcctctgagcagtggcacaggcaccagcccccttacctggagcccccatgctggagtgaaccatgctgcccgccccgccagggctggggg

SEQ ID NO: 13415 - DNA, 19 bp, Homo sapiens
  misc_feature 1..19: note = chr19:42828316-42828335
  misc_feature 1..19: note = hyper
  source 1..19: mol_type = genomic DNA
cgtgcgtccacacctgggg

SEQ ID NO: 13416 - DNA, 68 bp, Homo sapiens
  misc_feature 1..68: note = chr19:42906129-42906197
  misc_feature 1..68: note = hyper
  source 1..68: mol_type = genomic DNA
aggtcctccaccacgcgcagcgtcaccggctggcccaggttgcgcagtcgccgcgcgagcatgaccga

SEQ ID NO: 13417 - DNA, 64 bp, Homo sapiens
  misc_feature 1..64: note = chr19:42928276-42928340
  misc_feature 1..64: note = hyper
  source 1..64: mol_type = genomic DNA
ctagttctcctattgcgcttttcctgggggatctttctccctctgtctccgccccctaatccat

SEQ ID NO: 13418 - DNA, 30 bp, Homo sapiens
  misc_feature 1..30: note = chr19:44203678-44203708
  misc_feature 1..30: note = hyper
  source 1..30: mol_type = genomic DNA
accctgtctccgtctcggcaggcggccgga

SEQ ID NO: 13419 - DNA, 41 bp, Homo sapiens
  misc_feature 1..41: note = chr19:44324840-44324881
  misc_feature 1..41: note = hyper
  source 1..41: mol_type = genomic DNA
tgggaattgtagtcccgggccggaaacgcaggagacgccag

SEQ ID NO: 13420 - DNA, 16 bp, Homo sapiens
  misc_feature 1..16: note = chr19:44405908-44405924
  misc_feature 1..16: note = hyper
  source 1..16: mol_type = genomic DNA
tgatttctgtggagac

SEQ ID NO: 13421 - DNA, 141 bp, Homo sapiens
  misc_feature 1..141: note = chr19:44405925-44406066
  misc_feature 1..141: note = hyper
  source 1..141: mol_type = genomic DNA
atctactcaccacgtaggggctacagcagctcggacaccggaaaaagatctagagctcgagggtgaccctagcgcggtgacttctgggaaatgtagtccacccggaataaccatgtccacggcgcccgccattctgtagcc

SEQ ID NO: 13422 - DNA, 414 bp, Homo sapiens
  misc_feature 1..414: note = chr19:44711532-44711946
  misc_feature 1..414: note = hyper
  source 1..414: mol_type = genomic DNA
gaagctcaggttactcggaagtatttccgctccaaggagcggaactatggccggtttcccctggggcattctgggaagtgtagtcaggggcccgcgtagcctggggcacttccgcttttggatggcggagctagggaattgtgggaagtgatccggggtttctctttagttgctgggaagttttttcgctctaggagggcgaaaacaagtgtttggatccgctgggaccctccaagttttctcagcctcgtcagggagcaagcggggccctggccctcgtctggaggaaggctagagaagctgtggccagctgggaggctggagttgggagcagtttgtgttctttcctctcggctgagcctcacgtttggagcagttcttgcgtccccgggttgggagcgtcctggatcggtt

SEQ ID NO: 13423 - DNA, 30 bp, Homo sapiens
  misc_feature 1..30: note = chr19:44905499-44905529
  misc_feature 1..30: note = hyper
  source 1..30: mol_type = genomic DNA
ggctgctccccaaaccgagcccacgctcga

SEQ ID NO: 13424 - DNA, 30 bp, Homo sapiens
  misc_feature 1..30: note = chr19:44952282-44952312
  misc_feature 1..30: note = hyper
  source 1..30: mol_type = genomic DNA
ccacaagtgggtgggcggctaccctgagaa

SEQ ID NO: 13425 - DNA, 33 bp, Homo sapiens
  misc_feature 1..33: note = chr19:44952519-44952552
  misc_feature 1..33: note = hyper
  source 1..33: mol_type = genomic DNA
tgggcttcgaccctccgccgcacgttgtccctt

SEQ ID NO: 13426 - DNA, 32 bp, Homo sapiens
  misc_feature 1..32: note = chr19:45655399-45655431
  misc_feature 1..32: note = hyper
  source 1..32: mol_type = genomic DNA
cggcttgagcgcgctgacggctcggatgagac

SEQ ID NO: 13427 - DNA, 616 bp, Homo sapiens; identical to SEQ ID NO: 1390
  misc_feature 1..616: note = chr19:45655778-45656394
  misc_feature 1..616: note = hyper
  source 1..616: mol_type = genomic DNA

SEQ ID NO: 13428 - DNA, 61 bp, Homo sapiens; identical to SEQ ID NO: 4668
  misc_feature 1..61: note = chr19:45656682-45656743
  misc_feature 1..61: note = hyper
  source 1..61: mol_type = genomic DNA

SEQ ID NO: 13429 - DNA, 166 bp, Homo sapiens; identical to SEQ ID NO: 4669
  misc_feature 1..166: note = chr19:45656790-45656956
  misc_feature 1..166: note = hyper
  source 1..166: mol_type = genomic DNA

SEQ ID NO: 13430 - DNA, 41 bp, Homo sapiens
  misc_feature 1..41: note = chr19:45657177-45657218
  misc_feature 1..41: note = hyper
  source 1..41: mol_type = genomic DNA
taaagagctggaagccggtgcagaagcgggggcgtggagag

SEQ ID NO: 13431 - DNA, 30 bp, Homo sapiens
  misc_feature 1..30: note = chr19:45755404-45755434
  misc_feature 1..30: note = hyper
  source 1..30: mol_type = genomic DNA
tctgcccctccaggacgcacccagggcgcc

SEQ ID NO: 13432 - DNA, 361 bp, Homo sapiens; identical to SEQ ID NO: 1391
  misc_feature 1..361: note = chr19:45888864-45889225
  misc_feature 1..361: note = hyper
  source 1..361: mol_type = genomic DNA

SEQ ID NO: 13433 - DNA, 82 bp, Homo sapiens; identical to SEQ ID NO: 1392
  misc_feature 1..82: note = chr19:45889315-45889397
  misc_feature 1..82: note = hyper
  source 1..82: mol_type = genomic DNA

SEQ ID NO: 13434 - DNA, 178 bp, Homo sapiens
  misc_feature 1..178: note = chr19:46001719-46001897
  misc_feature 1..178: note = hyper
  source 1..178: mol_type = genomic DNA
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgca

SEQ ID NO: 13435 - DNA, 256 bp, Homo sapiens
  misc_feature 1..256: note = chr19:46002097-46002353
  misc_feature 1..256: note = hyper
  source 1..256: mol_type = genomic DNA
tccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacg

SEQ ID NO: 13436 - DNA, 54 bp, Homo sapiens
  misc_feature 1..54: note = chr19:46105244-46105298
  misc_feature 1..54: note = hyper
  source 1..54: mol_type = genomic DNA
gactgaggcagcccccgagggggcggggaggagcggtctcgccacgagcagggc

SEQ ID NO: 13437 - DNA, 173 bp, Homo sapiens
  misc_feature 1..173: note = chr19:46379903-46380076
  misc_feature 1..173: note = hyper
  source 1..173: mol_type = genomic DNA
gctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtct

SEQ ID NO: 13438 - DNA, 93 bp, Homo sapiens
  misc_feature 1..93: note = chr19:46476967-46477060
  misc_feature 1..93: note = hyper
  source 1..93: mol_type = genomic DNA
gcaggatggcagggccgaggggggtctccgatagggccgggaaagaactgagaggtggggtctctcctgggaccacagaggctggggactgga

SEQ ID NO: 13439 - DNA, 110 bp, Homo sapiens
  misc_feature 1..110: note = chr19:46519300-46519410
  misc_feature 1..110: note = hyper
  source 1..110: mol_type = genomic DNA
tgtggtctcaggaggcggactccgccggtgcagccgcccccgacgcgggaggaccgggcctcatcgtcccgggagcgctccgcgtcgcgaggccgcggcgccgcgcgctc

SEQ ID NO: 13440 - DNA, 61 bp, Homo sapiens
  misc_feature 1..61: note = chr19:46907548-46907609
  misc_feature 1..61: note = hyper
  source 1..61: mol_type = genomic DNA
cccctggagggagtgcgcccaggaagtggggaggagcgtttgagatcgaaggagtggccgc

SEQ ID NO: 13441 - DNA, 197 bp, Homo sapiens; identical to SEQ ID NO: 4672
  misc_feature 1..197: note = chr19:46916791-46916988
  misc_feature 1..197: note = hyper
  source 1..197: mol_type = genomic DNA

SEQ ID NO: 13442 - DNA, 83 bp, Homo sapiens
  misc_feature 1..83: note = chr19:46930064-46930147
  misc_feature 1..83: note = hyper
  source 1..83: mol_type = genomic DNA
tggtctccatagcaacggtcggacgcgctgctaggttctggctctgactgcgcctgcgcggctggtcccgcggggtctcccga

SEQ ID NO: 13443 - DNA, 84 bp, Homo sapiens
  misc_feature 1..84: note = chr19:46932252-46932336
  misc_feature 1..84: note = hyper
  source 1..84: mol_type = genomic DNA
tcctctgccattggccgactggccgcattgaaatcaagagtctgagggggtcattcggaggtgaggggtcggccaccagccctc

SEQ ID NO: 13444 - DNA, 41 bp, Homo sapiens
  misc_feature 1..41: note = chr19:46974568-46974609
  misc_feature 1..41: note = hyper
  source 1..41: mol_type = genomic DNA
ctccgcctgcccagccgggacttacttggcagatcagcctc

SEQ ID NO: 13445 - skipped

SEQ ID NO: 13446 - DNA, 107 bp, Homo sapiens
  misc_feature 1..107: note = chr19:46993281-46993388
  misc_feature 1..107: note = hyper
  source 1..107: mol_type = genomic DNA
cgccacgcccacctgcccccatgccgcataggtccccacagccaccgctcagggccctctgcaggggctgctgctgctgcaagcccacggggcgctggggggagttt

SEQ ID NO: 13447 - DNA, 36 bp, Homo sapiens
  misc_feature 1..36: note = chr19:46996615-46996651
  misc_feature 1..36: note = hyper
  source 1..36: mol_type = genomic DNA
cgtcgggatcgctggcgcccccggcctgcgagggcc

SEQ ID NO: 13448 - skipped

SEQ ID NO: 13449 - DNA, 145 bp, Homo sapiens
  misc_feature 1..145: note = chr19:47523113-47523258
  misc_feature 1..145: note = hyper
  source 1..145: mol_type = genomic DNA
ctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggtag

SEQ ID NO: 13450 - DNA, 37 bp, Homo sapiens
  misc_feature 1..37: note = chr19:47523631-47523668
  misc_feature 1..37: note = hyper
  source 1..37: mol_type = genomic DNA
tccggggctggggctcgcgcgccggggtcttcaggga

SEQ ID NO: 13451 - DNA, 30 bp, Homo sapiens
  misc_feature 1..30: note = chr19:47921726-47921756
  misc_feature 1..30: note = hyper
  source 1..30: mol_type = genomic DNA
cctgtcttctatccccgttcccatccccag

SEQ ID NO: 13452 - DNA, 289 bp, Homo sapiens
  misc_feature 1..289: note = chr19:47933200-47933489
  misc_feature 1..289: note = hyper
  source 1..289: mol_type = genomic DNA
agccaggggagggggcggagaagggaggccgagtcccaggagaggaggccgagtctggggggaaaaggagaccagggtccaagagcaggtgcagccgagtccctagccccgggcgggcggtggggacgagtctctgcgcgaggccctagaagccccggatgtggcagtacgcctccaggctggcgaagaggatgtacaggagccagaggcccaggaagagcgcggtggtggcgagcttgggtccgcgcgggccgcccagctcgccgccgatgtgcggccggcgccggta

SEQ ID NO: 13453 - DNA, 30 bp, Homo sapiens
  misc_feature 1..30: note = chr19:47933730-47933760
  misc_feature 1..30: note = hyper
  source 1..30: mol_type = genomic DNA
cagagacatacaggtcggaggggctttgcg

SEQ ID NO: 13454 - skipped

SEQ ID NO: 13455 - DNA, 118 bp, Homo sapiens
  misc_feature 1..118: note = chr19:48076481-48076599
  misc_feature 1..118: note = hyper
  source 1..118: mol_type = genomic DNA
gcgcgtacgtgaccgcgggccgcctcacgcctcccagagcggcctcgcgcgtgcctcctggccgcgcgctctcggctgcttctccgaggggcggggcttgccgcgggcgggaaaggag

SEQ ID NO: 13456 - DNA, 185 bp, Homo sapiens
  misc_feature 1..185: note = chr19:48901882-48902067
  misc_feature 1..185: note = hyper
  source 1..185: mol_type = genomic DNA
cagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgc

SEQ ID NO: 13457 - DNA, 78 bp, Homo sapiens; identical to SEQ ID NO: 1393
  misc_feature 1..78: note = chr19:48918201-48918279
  misc_feature 1..78: note = hyper
  source 1..78: mol_type = genomic DNA

SEQ ID NO: 13458 - DNA, 30 bp, Homo sapiens
  misc_feature 1..30: note = chr19:48994837-48994867
  misc_feature 1..30: note = hyper
  source 1..30: mol_type = genomic DNA
tcacgtcccatttaccgcatcccccaaaag

SEQ ID NO: 13459 - DNA, 195 bp, Homo sapiens
  misc_feature 1..195: note = chr19:49127373-49127568
  misc_feature 1..195: note = hyper
  source 1..195: mol_type = genomic DNA
ccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggt

SEQ ID NO: 13460 - DNA, 118 bp, Homo sapiens
  misc_feature 1..118: note = chr19:49399231-49399349
  misc_feature 1..118: note = hyper
  source 1..118: mol_type = genomic DNA
gccgctggattgttgcgggctccgcacgtaaagaatctcgcgccaggctctcgtaatgagaccgcgccccgccccggacccctagaccccgtctccgcaatcccgggtttggggtggg

SEQ ID NO: 13461 - DNA, 77 bp, Homo sapiens
  misc_feature 1..77: note = chr19:49924485-49924562
  misc_feature 1..77: note = hyper
  source 1..77: mol_type = genomic DNA
ttaaaccaatgagagcgcggtccgcacgaacggcgccccaggcgcgctgatctagccctctgcggaccaccgggttg

SEQ ID NO: 13462 - DNA, 186 bp, Homo sapiens; identical to SEQ ID NO: 4674
  misc_feature 1..186: note = chr19:49925774-49925960
  misc_feature 1..186: note = hyper
  source 1..186: mol_type = genomic DNA

SEQ ID NO: 13463 - DNA, 375 bp, Homo sapiens
  misc_feature 1..375: note = chr19:49935736-49936111
  misc_feature 1..375: note = hyper
  source 1..375: mol_type = genomic DNA
aggctgtcctagagccggcccaggccccgccccactcacctccgcagttcatcaacttgcgcacgttggtggtggacatgatgcggcggctccgcaggaagtccgcgatctggccgccgatgggcacgatgatggtcatgaccaggtggggcagcgcggacaccaggcctacctgcgggaacaggtgtacagggacactagggttcggggccgccggctcggcgtctctgcccggtccgtgcaccaccggctcctccctgcctcgggatcgccgccagttccctcccgccgacccctccgcgcccccctgccctctcctcctgggctctaccttgctgatctcgaagccgaacacttcttcgaagtaggcgggct

SEQ ID NO: 13464 - DNA, 41 bp, Homo sapiens
  misc_feature 1..41: note = chr19:49936853-49936894
  misc_feature 1..41: note = hyper
  source 1..41: mol_type = genomic DNA
tagcccctctctttgcgttccagtcccgtctcctctagagt

SEQ ID NO: 13465 - DNA, 296 bp, Homo sapiens
  misc_feature 1..296: note = chr19:50194182-50194478
  misc_feature 1..296: note = hyper
  source 1..296: mol_type = genomic DNA
aggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagagaggaatcggggtttctgggtgacggtgatctcggggtgggcaggactccaaaggcccgtcgacccggtggtggactcct

SEQ ID NO: 13466 - DNA, 37 bp, Homo sapiens
  misc_feature 1..37: note = chr19:50194774-50194811
  misc_feature 1..37: note = hyper
  source 1..37: mol_type = genomic DNA
ggcggggggaggggacgctgagcggatgaatttatag

SEQ ID NO: 13467 - DNA, 59 bp, Homo sapiens
  misc_feature 1..59: note = chr19:50316361-50316420
  misc_feature 1..59: note = hyper
  source 1..59: mol_type = genomic DNA
atttaggactcccaccgcggtccctcacgtggggactgtcagtgcgggtcttggagcat

SEQ ID NO: 13468 - DNA, 290 bp, Homo sapiens; identical to SEQ ID NO: 4675
  misc_feature 1..290: note = chr19:50554012-50554302
  misc_feature 1..290: note = hyper
  source 1..290: mol_type = genomic DNA

SEQ ID NO: 13469 - DNA, 55 bp, Homo sapiens
  misc_feature 1..55: note = chr19:50815996-50816051
  misc_feature 1..55: note = hyper
  source 1..55: mol_type = genomic DNA
tttccccgcctccttcggctttcgtgaaggtcaggggaaacgggggggcttgtta

SEQ ID NO: 13470 - DNA, 53 bp, Homo sapiens
  misc_feature 1..53: note = chr19:50816431-50816484
  misc_feature 1..53: note = hyper
  source 1..53: mol_type = genomic DNA
aaatgattttccacccgcgagcgtgacgcggtgaggaccgctggggaaggggg

SEQ ID NO: 13471 - DNA, 179 bp, Homo sapiens
  misc_feature 1..179: note = chr19:50818424-50818603
  misc_feature 1..179: note = hyper
  source 1..179: mol_type = genomic DNA
agagacacaaaaggacggatgacaagagacagatggacagagatggaccaaggagatggagagagaaagtgaacaaatcggggagtcagtcaacatcgatgagaaagggggagacatcggggaggggggagagactccggattaggaggcaggttggtgcccaccgagcctcccccgcc

SEQ ID NO: 13472 - DNA, 30 bp, Homo sapiens
  misc_feature 1..30: note = chr19:50819128-50819158
  misc_feature 1..30: note = hyper
  source 1..30: mol_type = genomic DNA
agggttctgcacccccgcagggagctctgt

SEQ ID NO: 13473 - DNA, 35 bp, Homo sapiens
  misc_feature 1..35: note = chr19:50836356-50836391
  misc_feature 1..35: note = hyper
  source 1..35: mol_type = genomic DNA
ggatcccaagtcccccgtctccaaaactaggattc

SEQ ID NO: 13474 - DNA, 13 bp, Homo sapiens
  misc_feature 1..13: note = chr19:50836392-50836405
  misc_feature 1..13: note = hyper
  source 1..13: mol_type = genomic DNA
ggctgtcttaccg

SEQ ID NO: 13475 - DNA, 51 bp, Homo sapiens
  misc_feature 1..51: note = chr19:51111640-51111691
  misc_feature 1..51: note = hyper
  source 1..51: mol_type = genomic DNA
tatataattggatgccggaaatttggatcttttctacgtttcgcatttctg

SEQ ID NO: 13476 - DNA, 48 bp, Homo sapiens
  misc_feature 1..48: note = chr19:51142710-51142758
  misc_feature 1..48: note = hyper
  source 1..48: mol_type = genomic DNA
gctggggtcccaagacgcttcaggggaggggaacgatgtccgggactt

SEQ ID NO: 13477 - DNA, 15 bp, Homo sapiens
  misc_feature 1..15: note = chr19:51142834-51142849
  misc_feature 1..15: note = hyper
  source 1..15: mol_type = genomic DNA
cgaggggtgggatac

SEQ ID NO: 13478 - DNA, 30 bp, Homo sapiens
  misc_feature 1..30: note = chr19:51161225-51161255
  misc_feature 1..30: note = hyper
  source 1..30: mol_type = genomic DNA
tctctctccgacacccgcagcccgaggagg

SEQ ID NO: 13479 - DNA, 331 bp, Homo sapiens
  misc_feature 1..331: note = chr19:51161720-51162051
  misc_feature 1..331: note = hyper
  source 1..331: mol_type = genomic DNA
gttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagag

SEQ ID NO: 13480 - DNA, 26 bp, Homo sapiens
  misc_feature 1..26: note = chr19:51162427-51162453
  misc_feature 1..26: note = hyper
  source 1..26: mol_type = genomic DNA
gcaccgccccgcgggctggggccacc

SEQ ID NO: 13481 - DNA, 15 bp, Homo sapiens
  misc_feature 1..15: note = chr19:51170723-51170738
  misc_feature 1..15: note = hyper
  source 1..15: mol_type = genomic DNA
cagttttcaaggaac

SEQ ID NO: 13482 - DNA, 131 bp, Homo sapiens
  misc_feature 1..131: note = chr19:51171145-51171276
  misc_feature 1..131: note = hyper
  source 1..131: mol_type = genomic DNA
cagggccagccccagcggggaggcgggatccagggccttgccggtcagcgggtgcaccaggggtcgcgggggcaggaagctggtgaaggcgctgctgcccccgccacccccgtaggctcggctaccggccc

SEQ ID NO: 13483 - DNA, 258 bp, Homo sapiens
  misc_feature 1..258: note = chr19:51197503-51197761
  misc_feature 1..258: note = hyper
  source 1..258: mol_type = genomic DNA
agccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcg

SEQ ID NO: 13484 - DNA, 60 bp, Homo sapiens
  misc_feature 1..60: note = chr19:51198175-51198235
  misc_feature 1..60: note = hyper
  source 1..60: mol_type = genomic DNA
cgctgcgccgccggggccccagggctggccagctggaggacagcgcggggggcggctgcg

SEQ ID NO: 13485 - DNA, 355 bp, Homo sapiens
  misc_feature 1..355: note = chr19:51198793-51199148
  misc_feature 1..355: note = hyper
  source 1..355: mol_type = genomic DNA
cctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggc

SEQ ID NO: 13486 - DNA, 206 bp, Homo sapiens; identical to SEQ ID NO: 4677
  misc_feature 1..206: note = chr19:51227602-51227808
  misc_feature 1..206: note = hyper
  source 1..206: mol_type = genomic DNA

SEQ ID NO: 13487 - DNA, 21 bp, Homo sapiens
  misc_feature 1..21: note = chr19:51228248-51228269
  misc_feature 1..21: note = hyper
  source 1..21: mol_type = genomic DNA
gcctccttctctacccggccc

SEQ ID NO: 13488 - DNA, 271 bp, Homo sapiens; identical to SEQ ID NO: 4679
  misc_feature 1..271: note = chr19:51228368-51228639
  misc_feature 1..271: note = hyper
  source 1..271: mol_type = genomic DNA

SEQ ID NO: 13489 - DNA, 91 bp, Homo sapiens; identical to SEQ ID NO: 4680
  misc_feature 1..91: note = chr19:51228702-51228793
  misc_feature 1..91: note = hyper
  source 1..91: mol_type = genomic DNA

SEQ ID NO: 13490 - DNA, 49 bp, Homo sapiens
  misc_feature 1..49: note = chr19:51412508-51412557
  misc_feature 1..49: note = hyper
  source 1..49: mol_type = genomic DNA
tctggaaacagtgtgcggctgacagcacccactgcggatgcaccaggac

SEQ ID NO: 13491 - DNA, 44 bp, Homo sapiens
  misc_feature 1..44: note = chr19:51520138-51520182
  misc_feature 1..44: note = hyper
  source 1..44: mol_type = genomic DNA
ctcaaggagaatcagcgggagaggagtgacgggcccagaaatgc

SEQ ID NO: 13492 - DNA, 114 bp, Homo sapiens; identical to SEQ ID NO: 1394
  misc_feature 1..114: note = chr19:51830889-51831003
  misc_feature 1..114: note = hyper
  source 1..114: mol_type = genomic DNA

SEQ ID NO: 13493 - DNA, 270 bp, Homo sapiens; identical to SEQ ID NO: 1395
  misc_feature 1..270: note = chr19:51831120-51831390
  misc_feature 1..270: note = hyper
  source 1..270: mol_type = genomic DNA

SEQ ID NO: 13494 - DNA, 30 bp, Homo sapiens
  misc_feature 1..30: note = chr19:52074302-52074332
  misc_feature 1..30: note = hyper
  source 1..30: mol_type = genomic DNA
gccctttgacgatggcggcctccaatatca

SEQ ID NO: 13495 - DNA, 89 bp, Homo sapiens
  misc_feature 1..89: note = chr19:52207371-52207460
  misc_feature 1..89: note = hyper
  source 1..89: mol_type = genomic DNA
cgggacgttctcctgcgtgatcaagcaagaccagcgccccctggcccggctctacttctttcttaacggtggggcggggcgcggccgcg

SEQ ID NO: 13496 - DNA, 105 bp, Homo sapiens
  misc_feature 1..105: note = chr19:52222448-52222553
  misc_feature 1..105: note = hyper
  source 1..105: mol_type = genomic DNA
ctctactcacctgcacgtagtccaccgaatctccgagcgccttgaaggctgtgtacatgacctcgcgcttgccgccccagcgctgcgccacgcacacgcacctgc

SEQ ID NO: 13497 - DNA, 179 bp, Homo sapiens
  misc_feature 1..179: note = chr19:52531480-52531659
  misc_feature 1..179: note = hyper
  source 1..179: mol_type = genomic DNA
agaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttc

SEQ ID NO: 13498 - DNA, 67 bp, Homo sapiens
  misc_feature 1..67: note = chr19:52839463-52839530
  misc_feature 1..67: note = hyper
  source 1..67: mol_type = genomic DNA
ccgctctctatgctgcgcgcgcgcagttttttgcagacccggaagcggatcgcgtgggtagaaggtc

SEQ ID NO: 13499 - DNA, 30 bp, Homo sapiens
  misc_feature 1..30: note = chr19:52839996-52840026
  misc_feature 1..30: note = hyper
  source 1..30: mol_type = genomic DNA
ttttcctccttgatccgggccttcctactc

SEQ ID NO: 13500 - DNA, 25 bp, Homo sapiens
  misc_feature 1..25: note = chr19:52872905-52872930
  misc_feature 1..25: note = hyper
  source 1..25: mol_type = genomic DNA
cctcagcatccgggtagctaggacc

SEQ ID NO: 13501 - DNA, 70 bp, Homo sapiens
  misc_feature 1..70: note = chr19:52873135-52873205
  misc_feature 1..70: note = hyper
  source 1..70: mol_type = genomic DNA
acccgggcctggcctcgcctcgcctctcagctgcgcgcgcagtttcctggagacccggaagcagattacg

SEQ ID NO: 13502 - DNA, 34 bp, Homo sapiens
  misc_feature 1..34: note = chr19:52900940-52900974
  misc_feature 1..34: note = hyper
  source 1..34: mol_type = genomic DNA
aaccctgaaaacaagcgcagccagtcaagcgaac

SEQ ID NO: 13503 - DNA, 27 bp, Homo sapiens
  misc_feature 1..27: note = chr19:52900975-52901002
  misc_feature 1..27: note = hyper
  source 1..27: mol_type = genomic DNA
gaagcgcaggcccggcccaggctttgt

SEQ ID NO: 13504 - DNA, 252 bp, Homo sapiens
  misc_feature 1..252: note = chr19:52956606-52956858
  misc_feature 1..252: note = hyper
  source 1..252: mol_type = genomic DNA
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgcagtttcctgaagacccggaagccgatcgcgtggggagccggtcttggagcagc

SEQ ID NO: 13505 - DNA, 333 bp, Homo sapiens; identical to SEQ ID NO: 4683
  misc_feature 1..333: note = chr19:53073440-53073773
  misc_feature 1..333: note = hyper
  source 1..333: mol_type = genomic DNA

SEQ ID NO: 13506 - DNA, 46 bp, Homo sapiens; identical to SEQ ID NO: 4684
  misc_feature 1..46: note = chr19:53073819-53073865
  misc_feature 1..46: note = hyper
  source 1..46: mol_type = genomic DNA

SEQ ID NO: 13507 - DNA, 172 bp, Homo sapiens; identical to SEQ ID NO: 4685
  misc_feature 1..172: note = chr19:53073866-53074038
  misc_feature 1..172: note = hyper
  source 1..172: mol_type = genomic DNA

SEQ ID NO: 13508 - DNA, 201 bp, Homo sapiens
  misc_feature 1..201: note = chr19:53141418-53141619
  misc_feature 1..201: note = hyper
  source 1..201: mol_type = genomic DNA
tatccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtg

SEQ ID NO: 13509 - DNA, 59 bp, Homo sapiens
  misc_feature 1..59: note = chr19:53193364-53193423
  misc_feature 1..59: note = hyper
  source 1..59: mol_type = genomic DNA
ggcgggaatccacttcgcgggtgaggacgttaaaaagcgcggggcgggaggagtctgaa

SEQ ID NO: 13510 - DNA, 82 bp, Homo sapiens
  misc_feature 1..82: note = chr19:53194281-53194363
  misc_feature 1..82: note = hyper
  source 1..82: mol_type = genomic DNA
taggagcaggaagatcgctgagccctggggtccaggccagcctgggcgacaaagtaacaccccctcccgcaaggccaccttc

SEQ ID NO: 13511 - DNA, 264 bp, Homo sapiens
  misc_feature 1..264: note = chr19:53400445-53400709
  misc_feature 1..264: note = hyper
  source 1..264: mol_type = genomic DNA
gagggaggtggggagcgacggagccttcggacaggggtggcgtctgcaggatcttaggaccaggcagaggacgcggcctcccgggaaccggggttgaggcgcggcgctcctgaagccgccgagagcgacggtgggaggcgcctagggctggaatccagctcgcgggtgaggacttgaaacagcgcgaggcgggaggacaggtcaggaagggttttgagaaggaaaattccgcgataggaggtgtctgcacgaccccactgcaga

SEQ ID NO: 13512 - DNA, 20 bp, Homo sapiens
  misc_feature 1..20: note = chr19:53497275-53497295
  misc_feature 1..20: note = hyper
  source 1..20: mol_type = genomic DNA
ggatgcgggatggagtgctc

SEQ ID NO: 13513 - DNA, 30 bp, Homo sapiens
  misc_feature 1..30: note = chr19:53561529-53561559
  misc_feature 1..30: note = hyper
  source 1..30: mol_type = genomic DNA
ggactggtctcagagcgagttttacccaca

SEQ ID NO: 13514 - DNA, 103 bp, Homo sapiens
  misc_feature 1..103: note = chr19:53635501-53635604
  misc_feature 1..103: note = hyper
  source 1..103: mol_type = genomic DNA
cacacattcacaggacggtttggggtaagacgcctgcatcctggaggagcgcattttccacggggtggaggagggcaggcaagaacatcgggtgtcacaggac

SEQ ID NO: 13515 - DNA, 54 bp, Homo sapiens
  misc_feature 1..54: note = chr19:53635906-53635960
  misc_feature 1..54: note = hyper
  source 1..54: mol_type = genomic DNA
gaagaagcaaaaggccggggacggggagcagcctcaaagcgacttcaacccaaa

SEQ ID NO: 13516 - DNA, 208 bp, Homo sapiens
  misc_feature 1..208: note = chr19:53661683-53661891
  misc_feature 1..208: note = hyper
  source 1..208: mol_type = genomic DNA
ggactttaaaaagcccggggcgggaggaggggtcaggaaagggttttaagcgggaggaagacgcgaaaggccggggacagggagaagcctcagagctacttcaacccaaagagaagcgactccgaacccacaccgcgagtcagctggggtggagggcgcggtgcggggatcttaaggtctgtagctgccgggcgcagtggctcacgct

SEQ ID NO: 13517 - DNA, 482 bp, Homo sapiens; identical to SEQ ID NO: 4686
  misc_feature 1..482: note = chr19:53696167-53696649
  misc_feature 1..482: note = hyper
  source 1..482: mol_type = genomic DNA

SEQ ID NO: 13518 - DNA, 13 bp, Homo sapiens
  misc_feature 1..13: note = chr19:53696650-53696663
  misc_feature 1..13: note = hyper
  source 1..13: mol_type = genomic DNA
gtggggaaaggcc

SEQ ID NO: 13519 - DNA, 35 bp, Homo sapiens
  misc_feature 1..35: note = chr19:53700349-53700384
  misc_feature 1..35: note = hyper
  source 1..35: mol_type = genomic DNA
ctgtagacccggaagcggatcgcggggagtgaagg

SEQ ID NO: 13520 - DNA, 31 bp, Homo sapiens
  misc_feature 1..31: note = chr19:53700646-53700677
  misc_feature 1..31: note = hyper
  source 1..31: mol_type = genomic DNA
cctaaaatcctttaccgatttttcttcccgc

SEQ ID NO: 13521 - DNA, 30 bp, Homo sapiens
  misc_feature 1..30: note = chr19:53757742-53757772
  misc_feature 1..30: note = hyper
  source 1..30: mol_type = genomic DNA
ggtgtgtatccaccccgagtgagggcttta

SEQ ID NO: 13522 - DNA, 46 bp, Homo sapiens
  misc_feature 1..46: note = chr19:53758129-53758175
  misc_feature 1..46: note = hyper
  source 1..46: mol_type = genomic DNA
aggaacctgcgcgtacgcgagtgcactggggcggcgcaaggggcaa

SEQ ID NO: 13523 - DNA, 142 bp, Homo sapiens; identical to SEQ ID NO: 4688
  misc_feature 1..142: note = chr19:53970501-53970643
  misc_feature 1..142: note = hyper
  source 1..142: mol_type = genomic DNA

SEQ ID NO: 13524 - DNA, 261 bp, Homo sapiens; identical to SEQ ID NO: 4689
  misc_feature 1..261: note = chr19:53970763-53971024
  misc_feature 1..261: note = hyper
  source 1..261: mol_type = genomic DNA

SEQ ID NO: 13525 - DNA, 101 bp, Homo sapiens
  misc_feature 1..101: note = chr19:53971344-53971445
  misc_feature 1..101: note = hyper
  source 1..101: mol_type = genomic DNA
caaggggtggattctcgcccacttcggccggtggagcgcagaaccgcggccccagtcccgggaaggccgcgtcctctgtctggtcccgggatcctgcagac

SEQ ID NO: 13526 - DNA, 439 bp, Homo sapiens
  misc_feature 1..439: note = chr19:54024116-54024555
  misc_feature 1..439: note = hyper
  source 1..439: mol_type = genomic DNA
aactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggag

SEQ ID NO: 13527 - DNA, 66 bp, Homo sapiens
  misc_feature 1..66: note = chr19:54024818-54024884
  misc_feature 1..66: note = hyper
  source 1..66: mol_type = genomic DNA
catctgtaggggtgacgcagccgggctgtgtctctgcacctccgttctgtgcgaggtcaatgctgg

SEQ ID NO: 13528 - DNA, 93 bp, Homo sapiens
  misc_feature 1..93: note = chr19:54409951-54410044
  misc_feature 1..93: note = hyper
  source 1..93: mol_type = genomic DNA
ctcccacagtgtggccgcagcggcgagaactttgacaagttcttcacgcgggcggcgccagcgctgacccctccagaccgcctagtcctggcc

SEQ ID NO: 13529 - DNA, 101 bp, Homo sapiens
  misc_feature 1..101: note = chr19:54410263-54410364
  misc_feature 1..101: note = hyper
  source 1..101: mol_type = genomic DNA
ttccagctctgcccccgcgggttctagacgcccctcccaagcgttcctggccttctgaactccatacagcctctacagccgtcccgcgttcaagacttgag

SEQ ID NO: 13530 - DNA, 132 bp, Homo sapiens
  misc_feature 1..132: note = chr19:54411454-54411586
  misc_feature 1..132: note = hyper
  source 1..132: mol_type = genomic DNA
gagtctggggagtgccggggaccgtgcagatggactacatttccccgcaggcctcgcggcagacccttcccccaagtgcggctccttgccgccagggctgatgggaaatgtagtctccggtcagggccagac

SEQ ID NO: 13531 - DNA, 153 bp, Homo sapiens; identical to SEQ ID NO: 4690
  misc_feature 1..153: note = chr19:54412839-54412992
  misc_feature 1..153: note = hyper
  source 1..153: mol_type = genomic DNA

SEQ ID NO: 13532 - DNA, 74 bp, Homo sapiens
  misc_feature 1..74: note = chr19:54413489-54413563
  misc_feature 1..74: note = hyper
  source 1..74: mol_type = genomic DNA
gagcccacagggctgcgaggggaccaggcagctcgcggtcaaacccctgagccgccaggcgggggatgggagga

SEQ ID NO: 13533 - DNA, 30 bp, Homo sapiens
  misc_feature 1..30: note = chr19:54463032-54463062
  misc_feature 1..30: note = hyper
  source 1..30: mol_type = genomic DNA
cgacgtcccctcctccgtgcatcggagagt

SEQ ID NO: 13534 - DNA, 391 bp, Homo sapiens
  misc_feature 1..391: note = chr19:54466163-54466554
  misc_feature 1..391: note = hyper
  source 1..391: mol_type = genomic DNA
tcttctcctctaatgcgagatctcgctccttgccctccaccagccgccgaccatggccgcgctctgaccccctccccggccgcagcctcctcctcgccgcccccctccccagccccgccggccccgggccccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaa

SEQ ID NO: 13535 - DNA, 51 bp, Homo sapiens
  misc_feature 1..51: note = chr19:54481352-54481403
  misc_feature 1..51: note = hyper
  source 1..51: mol_type = genomic DNA
caaccctgaagtatccgcccccaccactgccctccccgctcctccagggtt

SEQ ID NO: 13536 - DNA, 197 bp, Homo sapiens; identical to SEQ ID NO: 1396
  misc_feature 1..197: note = chr19:54481771-54481968
  misc_feature 1..197: note = hyper
  source 1..197: mol_type = genomic DNA

SEQ ID NO: 13537 - DNA, 229 bp, Homo sapiens
  misc_feature 1..229: note = chr19:54482817-54483046
  misc_feature 1..229: note = hyper
  source 1..229: mol_type = genomic DNA
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggc

SEQ ID NO: 13538 - DNA, 77 bp, Homo sapiens; identical to SEQ ID NO: 1397
  misc_feature 1..77: note = chr19:54483391-54483468
  misc_feature 1..77: note = hyper
  source 1..77: mol_type = genomic DNA

SEQ ID NO: 13539 - DNA, 94 bp, Homo sapiens; identical to SEQ ID NO: 4693
  misc_feature 1..94: note = chr19:54485553-54485647
  misc_feature 1..94: note = hyper
  source 1..94: mol_type = genomic DNA

SEQ ID NO: 13540 - DNA, 325 bp, Homo sapiens; identical to SEQ ID NO: 4694
  misc_feature 1..325: note = chr19:54485672-54485997
  misc_feature 1..325: note = hyper
  source 1..325: mol_type = genomic DNA

SEQ ID NO: 13541 - DNA, 93 bp, Homo sapiens
  misc_feature 1..93: note = chr19:55684842-55684935
  misc_feature 1..93: note = hyper
  source 1..93: mol_type = genomic DNA
gggtgggagtcagggcgcaggcagcagcctcactcggtccgggggccgcagcgagtgccactgggcaatgggccgccgcgggttggccagcat

SEQ ID NO: 13542 - DNA, 97 bp, Homo sapiens
  misc_feature 1..97: note = chr19:55690949-55691046
  misc_feature 1..97: note = hyper
  source 1..97: mol_type = genomic DNA
ccgcgaggtggggagcgggcagcctgtggtccgagcgcccacagccgactgctccctccgcacctggtcctgggagctgagacgcaggttccctctt

SEQ ID NO: 13543 - DNA, 40 bp, Homo sapiens
  misc_feature 1..40: note = chr19:55953904-55953944
  misc_feature 1..40: note = hyper
  source 1..40: mol_type = genomic DNA
gtgccacagcagaagcggtaggagccggtgctgcagttga

SEQ ID NO: 13544 - DNA, 42 bp, Homo sapiens
  misc_feature 1..42: note = chr19:55954477-55954519
  misc_feature 1..42: note = hyper
  source 1..42: mol_type = genomic DNA
ggagagtaatggaaacgcgcccgggcacggctgggggagaga

SEQ ID NO: 13545 - DNA, 32 bp, Homo sapiens
  misc_feature 1..32: note = chr19:55963152-55963184
  misc_feature 1..32: note = hyper
  source 1..32: mol_type = genomic DNA
agcctcagttccctgcgcgcctccatttccct

SEQ ID NO: 13546 - DNA, 121 bp, Homo sapiens
  misc_feature 1..121: note = chr19:55963603-55963724
  misc_feature 1..121: note = hyper
  source 1..121: mol_type = genomic DNA
tgggggccaggggaccggaccttctgggaggggtctgggctcccagggtcggcggtgggggctccgattgcccaacgcggggcgggctgactgacagctctgacgccggtgtctctgagga

SEQ ID NO: 13547 - DNA, 131 bp, Homo sapiens; identical to SEQ ID NO: 4695
  misc_feature 1..131: note = chr19:56728658-56728789
  misc_feature 1..131: note = hyper
  source 1..131: mol_type = genomic DNA

SEQ ID NO: 13548 - DNA, 53 bp, Homo sapiens; identical to SEQ ID NO: 1398
  misc_feature 1..53: note = chr19:56879501-56879554
  misc_feature 1..53: note = hyper
  source 1..53: mol_type = genomic DNA

SEQ ID NO: 13549 - DNA, 90 bp, Homo sapiens; identical to SEQ ID NO: 1399
  misc_feature 1..90: note = chr19:56879555-56879645
  misc_feature 1..90: note = hyper
  source 1..90: mol_type = genomic DNA

SEQ ID NO: 13550 - DNA, 322 bp, Homo sapiens; identical to SEQ ID NO: 1400
  misc_feature 1..322: note = chr19:56879646-56879968
  misc_feature 1..322: note = hyper
  source 1..322: mol_type = genomic DNA

SEQ ID NO: 13551 - DNA, 193 bp, Homo sapiens; identical to SEQ ID NO: 1401
  misc_feature 1..193: note = chr19:56904511-56904704
  misc_feature 1..193: note = hyper
  source 1..193: mol_type = genomic DNA

SEQ ID NO: 13552 - DNA, 274 bp, Homo sapiens; identical to SEQ ID NO: 1402
  misc_feature 1..274: note = chr19:56904723-56904997
  misc_feature 1..274: note = hyper
  source 1..274: mol_type = genomic DNA

SEQ ID NO: 13553 - DNA, 50 bp, Homo sapiens; identical to SEQ ID NO: 1403
  misc_feature 1..50: note = chr19:56904998-56905048
  misc_feature 1..50: note = hyper
  source 1..50: mol_type = genomic DNA

SEQ ID NO: 13554 - DNA, 482 bp, Homo sapiens
  misc_feature 1..482: note = chr19:56915168-56915650
  misc_feature 1..482: note = hyper
  source 1..482: mol_type = genomic DNA
gcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 13555 - DNA, 242 bp, Homo sapiens
  misc_feature 1..242: note = chr19:56915651-56915893
  misc_feature 1..242: note = hyper
  source 1..242: mol_type = genomic DNA
ccgcgccggccccggactccatttcccagcggcccctgcggcctgccctagggctgcggcgcctttgtgagcgcggccgccggccaggatcgagccctggcccgggccctggcccagccccggcctccaaggaccgcgccgaaggaggtgcccactggagggaggaggcggtgaggagcgcgggatggagctgacgccgggagcggccatgccaccatgtgtgggaccgtgtgtgacagtgt

SEQ ID NO: 13556 - DNA, 107 bp, Homo sapiens; identical to SEQ ID NO: 4702
  misc_feature 1..107: note = chr19:56988557-56988664
  misc_feature 1..107: note = hyper
  source 1..107: mol_type = genomic DNA

SEQ ID NO: 13557 - DNA, 47 bp, Homo sapiens
  misc_feature 1..47: note = chr19:57018744-57018791
  misc_feature 1..47: note = hyper
  source 1..47: mol_type = genomic DNA
gccagagtcacaacacggtcggggttcctcgtcgctgtcttattcca

SEQ ID NO: 13558 - DNA, 282 bp, Homo sapiens
  misc_feature 1..282: note = chr19:57019202-57019484
  misc_feature 1..282: note = hyper
  source 1..282: mol_type = genomic DNA
aggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcg

SEQ ID NO: 13559 - DNA, 58 bp, Homo sapiens
  misc_feature 1..58: note = chr19:57079102-57079160
  misc_feature 1..58: note = hyper
  source 1..58: mol_type = genomic DNA
gcgaatctgcgcctgcgtgcatggcccggcggcgtgcggaaggcggtgtgtgttggaa

SEQ ID NO: 13560 - DNA, 30 bp, Homo sapiens
  misc_feature 1..30: note = chr19:57149347-57149377
  misc_feature 1..30: note = hyper
  source 1..30: mol_type = genomic DNA
agggctttccccaggcggatgggttctttg

SEQ ID NO: 13561 - DNA, 460 bp, Homo sapiens
  misc_feature 1..460: note = chr19:57154254-57154714
  misc_feature 1..460: note = hyper
  source 1..460: mol_type = genomic DNA
ccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggca

SEQ ID NO: 13562 - DNA, 183 bp, Homo sapiens; identical to SEQ ID NO: 1404
  misc_feature 1..183: note = chr19:57182944-57183127
  misc_feature 1..183: note = hyper
  source 1..183: mol_type = genomic DNA

SEQ ID NO: 13563 - DNA, 87 bp, Homo sapiens
  misc_feature 1..87: note = chr19:57610741-57610828
  misc_feature 1..87: note = hyper
  source 1..87: mol_type = genomic DNA
gccatggaccgccatcgccgctggacgtcagggccgccaggcccagcgagatgtcacctcctctgaggagccttccaggatcgcacc

SEQ ID NO: 13564 - DNA, 227 bp, Homo sapiens; identical to SEQ ID NO: 4704
  misc_feature 1..227: note = chr19:57617489-57617716
  misc_feature 1..227: note = hyper
  source 1..227: mol_type = genomic DNA

SEQ ID NO: 13565 - DNA, 85 bp, Homo sapiens
  misc_feature 1..85: note = chr19:57618082-57618167
  misc_feature 1..85: note = hyper
  source 1..85: mol_type = genomic DNA
ttcaaggtctgtcaccgtagggggcgggggggcgcgtggagccgctgggggttcggcccaccccgcgaaccgagctcccggccct

SEQ ID NO: 13566 - DNA, 62 bp, Homo sapiens
  misc_feature 1..62: note = chr19:57683265-57683327
  misc_feature 1..62: note = hyper
  source 1..62: mol_type = genomic DNA
caggcaagggaaatgcgtccccgggccggggggcgcgagcgggggtccggggccgcgagctg

SEQ ID NO: 13567 - DNA, 94 bp, Homo sapiens
  misc_feature 1..94: note = chr19:57683592-57683686
  misc_feature 1..94: note = hyper
  source 1..94: mol_type = genomic DNA
ggggcgcgccgggctcgtcctctccgcggcgctcagtggcagcagggagggccggtgagatgccagagcaaggtagggtcctgtatttggggac

SEQ ID NO: 13568 - DNA, 58 bp, Homo sapiens
  misc_feature 1..58: note = chr19:57683805-57683863
  misc_feature 1..58: note = hyper
  source 1..58: mol_type = genomic DNA
cggttgatgtcaggcagtgctgggaggcgttgctctccgggttcgcttctctcctgtt

SEQ ID NO: 13569 - DNA, 181 bp, Homo sapiens
  misc_feature 1..181: note = chr19:57862457-57862638
  misc_feature 1..181: note = hyper
  source 1..181: mol_type = genomic DNA
acatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgac

SEQ ID NO: 13570 - DNA, 238 bp, Homo sapiens
  misc_feature 1..238: note = chr19:57862639-57862877
  misc_feature 1..238: note = hyper
  source 1..238: mol_type = genomic DNA
tatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtcctt

SEQ ID NO: 13571 - DNA, 15 bp, Homo sapiens
  misc_feature 1..15: note = chr19:57989033-57989048
  misc_feature 1..15: note = hyper
  source 1..15: mol_type = genomic DNA
aacactagtaagcgg

SEQ ID NO: 13572 - DNA, 275 bp, Homo sapiens
  misc_feature 1..275: note = chr19:58011070-58011345
  misc_feature 1..275: note = hyper
  source 1..275: mol_type = genomic DNA
atctccatcatctaccgtctccaatctccatctccgaagttatgcccacttcctcgaagtttggagccacgcgaactacactgcccagaaggcgccgcgccgtgagccgcgatgcttggccaatgaaaagaggtctacccgagagtgcgacgcgcaatgggcgggacttccggcgtctcccctcggcggttgctttcgctgccctcaagagaactcagcttgccggaagctggttgttcgctgcggcgaccagctccggaaagcgcggtggggac

SEQ ID NO: 13573 - DNA, 160 bp, Homo sapiens
  misc_feature 1..160: note = chr19:58011346-58011506
  misc_feature 1..160: note = hyper
  source 1..160: mol_type = genomic DNA
cgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctc

SEQ ID NO: 13574 - DNA, 200 bp, Homo sapiens; identical to SEQ ID NO: 4705
  misc_feature 1..200: note = chr19:58038923-58039123
  misc_feature 1..200: note = hyper
  source 1..200: mol_type = genomic DNA

SEQ ID NO: 13575 - DNA, 480 bp, Homo sapiens; identical to SEQ ID NO: 1405
  misc_feature 1..480: note = chr19:58094988-58095468
  misc_feature 1..480: note = hyper
  source 1..480: mol_type = genomic DNA

SEQ ID NO: 13576 - DNA, 308 bp, Homo sapiens; identical to SEQ ID NO: 1406
  misc_feature 1..308: note = chr19:58095469-58095777
  misc_feature 1..308: note = hyper
  source 1..308: mol_type = genomic DNA

SEQ ID NO: 13577 - DNA, 268 bp, Homo sapiens
  misc_feature 1..268: note = chr19:58111564-58111832
  misc_feature 1..268: note = hyper
  source 1..268: mol_type = genomic DNA
gggttttctgcagcccggaccgcactgtccggcacagtgaggcgctggtgctggatctcgtttctggtagtgtggcagggagcgggagagcgacacggtcagggggctgcgcgggcaacagcttggagctgcgcctgagccgggaggctggggagacccaggccggcctcacgcgtgcaggtagcagagggtggggcagcgccgcgctgcattggccccactgagtttcaccagcacactgagggccacagcgcgtaggacagaagag

SEQ ID NO: 13578 - DNA, 590 bp, Homo sapiens
  misc_feature 1..590: note = chr19:58125422-58126012
  misc_feature 1..590: note = hyper
  source 1..590: mol_type = genomic DNA
tttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggca

SEQ ID NO: 13579 - DNA, 140 bp, Homo sapiens
  misc_feature 1..140: note = chr19:58175834-58175974
  misc_feature 1..140: note = hyper
  source 1..140: mol_type = genomic DNA
aggagtcggcgcggtcgtgcggccgtggaggacagcgagacccggggctgcggctgcaggccgaggggcccctgggacagtgagaagcagcggcgggagctagtcacggggcagggagcgctcagcggtaaagacggctt

SEQ ID NO: 13580 - DNA, 467 bp, Homo sapiens; identical to SEQ ID NO: 1407
  misc_feature 1..467: note = chr19:58219926-58220393
  misc_feature 1..467: note = hyper
  source 1..467: mol_type = genomic DNA

SEQ ID NO: 13581 - DNA, 217 bp, Homo sapiens; identical to SEQ ID NO: 1408
  misc_feature 1..217: note = chr19:58220515-58220732
  misc_feature 1..217: note = hyper
  source 1..217: mol_type = genomic DNA

SEQ ID NO: 13582 - DNA, 413 bp, Homo sapiens; identical to SEQ ID NO: 1409
  misc_feature 1..413: note = chr19:58238326-58238739
  misc_feature 1..413: note = hyper
  source 1..413: mol_type = genomic DNA

SEQ ID NO: 13583 - DNA, 25 bp, Homo sapiens
  misc_feature 1..25: note = chr19:58238987-58239012
  misc_feature 1..25: note = hyper
  source 1..25: mol_type = genomic DNA
gctacaaggaggagccggaagtccc

SEQ ID NO: 13584 - DNA, 188 bp, Homo sapiens; identical to SEQ ID NO: 1411
  misc_feature 1..188: note = chr19:58239013-58239201
  misc_feature 1..188: note = hyper
  source 1..188: mol_type = genomic DNA

SEQ ID NO: 13585 - DNA, 239 bp, Homo sapiens
  misc_feature 1..239: note = chr19:58281000-58281239
  misc_feature 1..239: note = hyper
  source 1..239: mol_type = genomic DNA
tcaagccaggacttccggcgtcctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcc

SEQ ID NO: 13586 - DNA, 123 bp, Homo sapiens
  misc_feature 1..123: note = chr19:58400052-58400175
  misc_feature 1..123: note = hyper
  source 1..123: mol_type = genomic DNA
agagccgtgaacaggcgctgctacctcgctgcttttgggtgacgatgaggtgacctgaggacacagaaggccccacaattacctgagcggagagcctcagcgtagccgcggcagccatcgaac

SEQ ID NO: 13587 - DNA, 112 bp, Homo sapiens; identical to SEQ ID NO: 1412
  misc_feature 1..112: note = chr19:58400406-58400518
  misc_feature 1..112: note = hyper
  source 1..112: mol_type = genomic DNA

SEQ ID NO: 13588 - DNA, 41 bp, Homo sapiens
  misc_feature 1..41: note = chr19:58446443-58446484
  misc_feature 1..41: note = hyper
  source 1..41: mol_type = genomic DNA
agacctgtgaacagtcgccgctctctcgctgcttcaggatt

SEQ ID NO: 13589 - DNA, 68 bp, Homo sapiens
  misc_feature 1..68: note = chr19:58459164-58459232
  misc_feature 1..68: note = hyper
  source 1..68: mol_type = genomic DNA
taatgttcccacaggcgcacggcgggagagtgagggtcgcctccacctccttccggaagtaaaggcca

SEQ ID NO: 13590 - DNA, 78 bp, Homo sapiens
  misc_feature 1..78: note = chr19:58513793-58513871
  misc_feature 1..78: note = hyper
  source 1..78: mol_type = genomic DNA
gcggcgcagcaggatcggggtctgcccgcctggggcgtttggcttttgtcccgcgccgaggtccggcccaggagtgcg

SEQ ID NO: 13591 - DNA, 128 bp, Homo sapiens
  misc_feature 1..128: note = chr19:58514138-58514266
  misc_feature 1..128: note = hyper
  source 1..128: mol_type = genomic DNA
aggcctcacctcagccgcggacaatggcggctgcttccccggcgtcgaccggagcgcgccgcggggtctgctgggagctgtagttccaggcgggcacttccggcgtcgggcagcggcgccgccatgac

SEQ ID NO: 13592 - DNA, 30 bp, Homo sapiens
  misc_feature 1..30: note = chr19:58520911-58520941
  misc_feature 1..30: note = hyper
  source 1..30: mol_type = genomic DNA
cctgacgctgatgctcgtctggctgcccgt

SEQ ID NO: 13593 - DNA, 15 bp, Homo sapiens
  misc_feature 1..15: note = chr19:58521301-58521316
  misc_feature 1..15: note = hyper
  source 1..15: mol_type = genomic DNA
cggcagtaccttgcc

SEQ ID NO: 13594 - DNA, 186 bp, Homo sapiens
  misc_feature 1..186: note = chr19:58545202-58545388
  misc_feature 1..186: note = hyper
  source 1..186: mol_type = genomic DNA
cagcagcgtccctgacgctgcgcgacccgttgccaaggcgactggaaccgcggcccgaggtaactggagggcacggcgggggcggggcgctcatcccaggcggcttctgattggcctcggccgcctcgtgcgtcacagccccgcccctgcccgggagtcccgcagcggtgacttgtcaccgacgcc

SEQ ID NO: 13595 - DNA, 38 bp, Homo sapiens
  misc_feature 1..38: note = chr19:58545651-58545689
  misc_feature 1..38: note = hyper
  source 1..38: mol_type = genomic DNA
gtcgggggaggcgggcccgggcccgggagggggcgggc

SEQ ID NO: 13596 - DNA, 28 bp, Homo sapiens
  misc_feature 1..28: note = chr19:58609498-58609526
  misc_feature 1..28: note = hyper
  source 1..28: mol_type = genomic DNA
tcgctctctgacccccgcgctgcatccc

SEQ ID NO: 13597 - DNA, 32 bp, Homo sapiens; identical to SEQ ID NO: 4715
  misc_feature 1..32: note = chr19:58609712-58609744
  misc_feature 1..32: note = hyper
  source 1..32: mol_type = genomic DNA

SEQ ID NO: 13598 - DNA, 62 bp, Homo sapiens; identical to SEQ ID NO: 4716
  misc_feature 1..62: note = chr19:58609745-58609807
  misc_feature 1..62: note = hyper
  source 1..62: mol_type = genomic DNA

SEQ ID NO: 13599 - DNA, 245 bp, Homo sapiens
  misc_feature 1..245: note = chr19:58662055-58662300
  misc_feature 1..245: note = hyper
  source 1..245: mol_type = genomic DNA
gccaagacttccctccgcaggaaacggaggcagcgcagggctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactt

SEQ ID NO: 13600 - DNA, 222 bp, Homo sapiens
  misc_feature 1..222: note = chr19:58666273-58666495
  misc_feature 1..222: note = hyper
  source 1..222: mol_type = genomic DNA
cccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 13601 - DNA, 183 bp, Homo sapiens
  misc_feature 1..183: note = chr19:58666550-58666733
  misc_feature 1..183: note = hyper
  source 1..183: mol_type = genomic DNA
cgcggcgctccaccgcttccgccctcgggttgcgttagccgcgacgatggcgccccccagtggcagcagggaggctgtgggggtgctgggcgttgcggtgtgcaggttttctgggaggatacctggcgccgaccttgaagggaccccaacgtgagagggaaagacgcccgtgatgccaaggct

SEQ ID NO: 13602 - DNA, 30 bp, Homo sapiens
  misc_feature 1..30: note = chr19:58694552-58694582
  misc_feature 1..30: note = hyper
  source 1..30: mol_type = genomic DNA
tagtgtggggccctgcggcctagcgtccct

SEQ ID NO: 13603 - DNA, 30 bp, Homo sapiens
  misc_feature 1..30: note = chr19:58695225-58695255
  misc_feature 1..30: note = hyper
  source 1..30: mol_type = genomic DNA
gcggtagctccccagcggacaccttaagcc

SEQ ID NO: 13604 - DNA, 30 bp, Homo sapiens
  misc_feature 1..30: note = chr19:58951079-58951109
  misc_feature 1..30: note = hyper
  source 1..30: mol_type = genomic DNA
gggccggaatcccagcgggtgagggcctgg

SEQ ID NO: 13605 - DNA, 74 bp, Homo sapiens; identical to SEQ ID NO: 1413
  misc_feature 1..74: note = chr19:58951525-58951599
  misc_feature 1..74: note = hyper
  source 1..74: mol_type = genomic DNA

SEQ ID NO: 13606 - DNA, 178 bp, Homo sapiens; identical to SEQ ID NO: 1414
  misc_feature 1..178: note = chr19:58951600-58951778
  misc_feature 1..178: note = hyper
  source 1..178: mol_type = genomic DNA

SEQ ID NO: 13607 - DNA, 279 bp, Homo sapiens; identical to SEQ ID NO: 1415
  misc_feature 1..279: note = chr19:58951779-58952058
  misc_feature 1..279: note = hyper
  source 1..279: mol_type = genomic DNA

SEQ ID NO: 13608 - DNA, 28 bp, Homo sapiens
  misc_feature 1..28: note = chr20:291135-291163
  misc_feature 1..28: note = hyper
  source 1..28: mol_type = genomic DNA
cgttgccatagaaaccggccgcacaggc

SEQ ID NO: 13609 - DNA, 153 bp, Homo sapiens; identical to SEQ ID NO: 1417
  misc_feature 1..153: note = chr20:291220-291373
  misc_feature 1..153: note = hyper
  source 1..153: mol_type = genomic DNA

SEQ ID NO: 13610 - DNA, 145 bp, Homo sapiens
  misc_feature 1..145: note = chr20:590348-590493
  misc_feature 1..145: note = hyper
  source 1..145: mol_type = genomic DNA
acactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgccca

SEQ ID NO: 13611 - DNA, 274 bp, Homo sapiens; identical to SEQ ID NO: 1418
  misc_feature 1..274: note = chr20:644552-644826
  misc_feature 1..274: note = hyper
  source 1..274: mol_type = genomic DNA

SEQ ID NO: 13612 - DNA, 320 bp, Homo sapiens; identical to SEQ ID NO: 1419
  misc_feature 1..320: note = chr20:644985-645305
  misc_feature 1..320: note = hyper
  source 1..320: mol_type = genomic DNA

SEQ ID NO: 13613 - DNA, 139 bp, Homo sapiens
  misc_feature 1..139: note = chr20:656937-657076
  misc_feature 1..139: note = hyper
  source 1..139: mol_type = genomic DNA
aagagagggggaagccgaggggaacggagggaaagcggtcccgagcaggcggggttcaggcacatggggccgcagggaaggggatgcagaggaaagagtgcgcactggccagcggccaccctcccgcctccagtcctct

SEQ ID NO: 13614 - DNA, 47 bp, Homo sapiens
  misc_feature 1..47: note = chr20:708643-708690
  misc_feature 1..47: note = hyper
  source 1..47: mol_type = genomic DNA
ccactggttcccttccgtactcgggcttcccccgctgttgttactcc

SEQ ID NO: 13615 - DNA, 72 bp, Homo sapiens; identical to SEQ ID NO: 4724
  misc_feature 1..72: note = chr20:982727-982799
  misc_feature 1..72: note = hyper
  source 1..72: mol_type = genomic DNA

SEQ ID NO: 13616 - DNA, 253 bp, Homo sapiens; identical to SEQ ID NO: 4725
  misc_feature 1..253: note = chr20:982891-983144
  misc_feature 1..253: note = hyper
  source 1..253: mol_type = genomic DNA

SEQ ID NO: 13617 - DNA, 38 bp, Homo sapiens
  misc_feature 1..38: note = chr20:1783339-1783377
  misc_feature 1..38: note = hyper
  source 1..38: mol_type = genomic DNA
cagccattgcttgtgcgtcttcgcggagagagaggggg

SEQ ID NO: 13618 - DNA, 698 bp, Homo sapiens; identical to SEQ ID NO: 4726
  misc_feature 1..698: note = chr20:1783608-1784306
  misc_feature 1..698: note = hyper
  source 1..698: mol_type = genomic DNA

SEQ ID NO: 13619 - DNA, 96 bp, Homo sapiens
  misc_feature 1..96: note = chr20:2539456-2539552
  misc_feature 1..96: note = hyper
  source 1..96: mol_type = genomic DNA
gcgctcccgctccttcgcggcccttccccttcccccgtgagggactgatgcccccctccccggggagaggcagcccgtgccctcgctctggcttcc

SEQ ID NO: 13620 - DNA, 169 bp, Homo sapiens
  misc_feature 1..169: note = chr20:2539553-2539722
  misc_feature 1..169: note = hyper
  source 1..169: mol_type = genomic DNA
tgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtgga

SEQ ID NO: 13621 - DNA, 136 bp, Homo sapiens
  misc_feature 1..136: note = chr20:2668792-2668928
  misc_feature 1..136: note = hyper
  source 1..136: mol_type = genomic DNA
acactctggggcctccggggggcgctatggcccaacacacagcgtggccaagcgcgcctcagcctaactcaccacttcctatctgttttatacggtttgcacccgcttaaggcggcggaggcgtgggggagttctg

SEQ ID NO: 13622 - DNA, 35 bp, Homo sapiens
  misc_feature 1..35: note = chr20:2731640-2731675
  misc_feature 1..35: note = hyper
  source 1..35: mol_type = genomic DNA
gctatctgaaaagggcggtgcggggatcaggaaaa

SEQ ID NO: 13623 - DNA, 219 bp, Homo sapiens; identical to SEQ ID NO: 1420
  misc_feature 1..219: note = chr20:2780903-2781122
  misc_feature 1..219: note = hyper
  source 1..219: mol_type = genomic DNA

SEQ ID NO: 13624 - DNA, 589 bp, Homo sapiens; identical to SEQ ID NO: 1421
  misc_feature 1..589: note = chr20:2781123-2781712
  misc_feature 1..589: note = hyper
  source 1..589: mol_type = genomic DNA

SEQ ID NO: 13625 - DNA, 30 bp, Homo sapiens
  misc_feature 1..30: note = chr20:2781916-2781946
  misc_feature 1..30: note = hyper
  source 1..30: mol_type = genomic DNA
agttcttttaccacccgggagccaaccact

SEQ ID NO: 13626 - DNA, 38 bp, Homo sapiens
  misc_feature 1..38: note = chr20:2785819-2785857
  misc_feature 1..38: note = hyper
  source 1..38: mol_type = genomic DNA
agcccgtattctcctcggggagccggcagccctgggtc

SEQ ID NO: 13627 - DNA, 152 bp, Homo sapiens; identical to SEQ ID NO: 1422
  misc_feature 1..152: note = chr20:3052540-3052692
  misc_feature 1..152: note = hyper
  source 1..152: mol_type = genomic DNA

SEQ ID NO: 13628 - DNA, 380 bp, Homo sapiens; identical to SEQ ID NO: 1423
  misc_feature 1..380: note = chr20:3052693-3053073
  misc_feature 1..380: note = hyper
  source 1..380: mol_type = genomic DNA

SEQ ID NO: 13629 - DNA, 73 bp, Homo sapiens
  misc_feature 1..73: note = chr20:3063708-3063781
  misc_feature 1..73: note = hyper
  source 1..73: mol_type = genomic DNA
ttctcctcctggcagcgcagcgcctcagccgtgcccacgaagcagcccagctcgtccgcgcagcagatgctgg

SEQ ID NO: 13630 - DNA, 107 bp, Homo sapiens; identical to SEQ ID NO: 4731
  misc_feature 1..107: note = chr20:3073285-3073392
  misc_feature 1..107: note = hyper
  source 1..107: mol_type = genomic DNA

SEQ ID NO: 13631 - DNA, 295 bp, Homo sapiens; identical to SEQ ID NO: 4732
  misc_feature 1..295: note = chr20:3073560-3073855
  misc_feature 1..295: note = hyper
  source 1..295: mol_type = genomic DNA

SEQ ID NO: 13632 - DNA, 58 bp, Homo sapiens
  misc_feature 1..58: note = chr20:3218776-3218834
  misc_feature 1..58: note = hyper
  source 1..58: mol_type = genomic DNA
ctccagtcctgggaccgcgtcccggccgcctggaagccagagccgttggtccaaaagg

SEQ ID NO: 13633 - DNA, 69 bp, Homo sapiens
  misc_feature 1..69: note = chr20:3220874-3220943
  misc_feature 1..69: note = hyper
  source 1..69: mol_type = genomic DNA
ggaacggggacaggccggggcaagcccacctctgcgaaggaagggcttctggcgcgttggggaagcctc

SEQ ID NO: 13634 - DNA, 36 bp, Homo sapiens
  misc_feature 1..36: note = chr20:3229576-3229612
  misc_feature 1..36: note = hyper
  source 1..36: mol_type = genomic DNA
gttcctactacagctcggccgcggcaggctggggcc

SEQ ID NO: 13635 - DNA, 164 bp, Homo sapiens; identical to SEQ ID NO: 4733
  misc_feature 1..164: note = chr20:3641773-3641937
  misc_feature 1..164: note = hyper
  source 1..164: mol_type = genomic DNA

SEQ ID NO: 13636 - DNA, 49 bp, Homo sapiens
  misc_feature 1..49: note = chr20:3662664-3662713
  misc_feature 1..49: note = hyper
  source 1..49: mol_type = genomic DNA
tcggcctctaggcagcggctcgcaactccggctccgcccaggctggatt

SEQ ID NO: 13637 - DNA, 30 bp, Homo sapiens
  misc_feature 1..30: note = chr20:3663038-3663068
  misc_feature 1..30: note = hyper
  source 1..30: mol_type = genomic DNA
cgtggtgggatgaggcggtgggcaaaggcc

SEQ ID NO: 13638 - DNA, 130 bp, Homo sapiens
  misc_feature 1..130: note = chr20:3713321-3713451
  misc_feature 1..130: note = hyper
  source 1..130: mol_type = genomic DNA
gggaggcctcagggccgggcgcacgtcgagggctgcggccgccgcagcgggcacggccaacgagctgcgggcccgggatcgcggcggctggacggggctggagctgtcgggagggcggaggtgagttctg

SEQ ID NO: 13639 - DNA, 30 bp, Homo sapiens
  misc_feature 1..30: note = chr20:3759057-3759087
  misc_feature 1..30: note = hyper
  source 1..30: mol_type = genomic DNA
gacccctcacctgcacggtctcttgagagg

SEQ ID NO: 13640 - DNA, 93 bp, Homo sapiens
  misc_feature 1..93: note = chr20:4202639-4202732
  misc_feature 1..93: note = hyper
  source 1..93: mol_type = genomic DNA
ggagacggaggaaggcgcgcttgaactcgcggctggaacaggggtagatgagcgggttcacgcagctgttgaagtagccgagccagaagatga

SEQ ID NO: 13641 - DNA, 113 bp, Homo sapiens
  misc_feature 1..113: note = chr20:4229392-4229505
  misc_feature 1..113: note = hyper
  source 1..113: mol_type = genomic DNA
tcccccgcggagctccggttgtcctcgccgctgcctgcgcccaccacgccgccgccgccgcccgcgccccccggcacgccgcccaccgccgggccctccgagggggccgcgcc

SEQ ID NO: 13642 - DNA, 132 bp, Homo sapiens
  misc_feature 1..132: note = chr20:4229786-4229918
  misc_feature 1..132: note = hyper
  source 1..132: mol_type = genomic DNA
ggcggccgggctccccgaggccggccgtggagtagcaccgaagagccggggcccgctacgcgcgcggcgctctgagcgtgcccggcaagcgggcaaagcggcggctccggggccgggcggtgcaggcagcgg

SEQ ID NO: 13643 - DNA, 30 bp, Homo sapiens
  misc_feature 1..30: note = chr20:4230306-4230336
  misc_feature 1..30: note = hyper
  source 1..30: mol_type = genomic DNA
gggtcttcgggatcccggctttggccgcca

SEQ ID NO: 13644 - DNA, 751 bp, Homo sapiens
  misc_feature 1..751: note = chr20:4803129-4803880
  misc_feature 1..751: note = hyper
  source 1..751: mol_type = genomic DNA
cagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggc

SEQ ID NO: 13645 - DNA, 341 bp, Homo sapiens
  misc_feature 1..341: note = chr20:5296251-5296592
  misc_feature 1..341: note = hyper
  source 1..341: mol_type = genomic DNA
tttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactcc

SEQ ID NO: 13646 - DNA, 198 bp, Homo sapiens; identical to SEQ ID NO: 4734
  misc_feature 1..198: note = chr20:5296850-5297048
  misc_feature 1..198: note = hyper
  source 1..198: mol_type = genomic DNA

SEQ ID NO: 13647 - DNA, 194 bp, Homo sapiens; identical to SEQ ID NO: 4735
  misc_feature 1..194: note = chr20:5297225-5297419
  misc_feature 1..194: note = hyper
  source 1..194: mol_type = genomic DNA

SEQ ID NO: 13648 - DNA, 223 bp, Homo sapiens
  misc_feature 1..223: note = chr20:6032982-6033205
  misc_feature 1..223: note = hyper
  source 1..223: mol_type = genomic DNA
cggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtc

SEQ ID NO: 13649 - DNA, 256 bp, Homo sapiens
  misc_feature 1..256: note = chr20:6033206-6033462
  misc_feature 1..256: note = hyper
  source 1..256: mol_type = genomic DNA
aggctgcgcagtgtgcgcggtaggcagccgggcaggcgctccaggttgcggttcgccagggtcaaggccgtcgcatccgcggcgggcagcccctcgcagggcgagtcggtggcgttgctgccactgctcccccaggggccctgctgagtgacccggaagagcgggaccttctcctggggagggtctgcccagctggggcgcagcaccgtcagcagcagcagcggtagggtttgccgcatggcgtctggggagagaa

SEQ ID NO: 13650 - DNA, 277 bp, Homo sapiens; identical to SEQ ID NO: 4736
  misc_feature 1..277: note = chr20:8112335-8112612
  misc_feature 1..277: note = hyper
  source 1..277: mol_type = genomic DNA

SEQ ID NO: 13651 - DNA, 49 bp, Homo sapiens
  misc_feature 1..49: note = chr20:8112940-8112989
  misc_feature 1..49: note = hyper
  source 1..49: mol_type = genomic DNA
atgtgctgaatggtgcgctttgaggcggcggcggcggaggagcagaatc

SEQ ID NO: 13652 - DNA, 144 bp, Homo sapiens
  misc_feature 1..144: note = chr20:8113461-8113605
  misc_feature 1..144: note = hyper
  source 1..144: mol_type = genomic DNA
gggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagtt

SEQ ID NO: 13653 - DNA, 85 bp, Homo sapiens
  misc_feature 1..85: note = chr20:9487635-9487720
  misc_feature 1..85: note = hyper
  source 1..85: mol_type = genomic DNA
tcagtgccaggctcccgggagctgcagctggctccaagtgcgtggccggaggcgtcccccatctgcacgagtccccagagtcacc

SEQ ID NO: 13654 - DNA, 17 bp, Homo sapiens
  misc_feature 1..17: note = chr20:9487788-9487805
  misc_feature 1..17: note = hyper
  source 1..17: mol_type = genomic DNA
cgcgttgcctgctgtgg

SEQ ID NO: 13655 - DNA, 118 bp, Homo sapiens
  misc_feature 1..118: note = chr20:9488332-9488450
  misc_feature 1..118: note = hyper
  source 1..118: mol_type = genomic DNA
cctggcgggctggaccgggacagggggcggtgcgcaccggggctcccaagcagccttagcggtggagaccttccgaggggaggcgagcctgcggtttgtctcccgttaaggtggaaga

SEQ ID NO: 13656 - DNA, 205 bp, Homo sapiens; identical to SEQ ID NO: 1424
  misc_feature 1..205: note = chr20:9489503-9489708
  misc_feature 1..205: note = hyper
  source 1..205: mol_type = genomic DNA

SEQ ID NO: 13657 - DNA, 172 bp, Homo sapiens
  misc_feature 1..172: note = chr20:9495337-9495509
  misc_feature 1..172: note = hyper
  source 1..172: mol_type = genomic DNA
cgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctcc

SEQ ID NO: 13658 - DNA, 30 bp, Homo sapiens
  misc_feature 1..30: note = chr20:9496079-9496109
  misc_feature 1..30: note = hyper
  source 1..30: mol_type = genomic DNA
ttgttttgtttgttccgcagatacaatggc

SEQ ID NO: 13659 - DNA, 30 bp, Homo sapiens
  misc_feature 1..30: note = chr20:9496596-9496626
  misc_feature 1..30: note = hyper
  source 1..30: mol_type = genomic DNA
cgccccggggccgggcgagctgagggggcg

SEQ ID NO: 13660 - DNA, 164 bp, Homo sapiens
  misc_feature 1..164: note = chr20:9819538-9819702
  misc_feature 1..164: note = hyper
  source 1..164: mol_type = genomic DNA
gggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgg

SEQ ID NO: 13661 - DNA, 199 bp, Homo sapiens
  misc_feature 1..199: note = chr20:10198532-10198731
  misc_feature 1..199: note = hyper
  source 1..199: mol_type = genomic DNA
tcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 13662 - skipped

SEQ ID NO: 13663 - DNA, 295 bp, Homo sapiens
  misc_feature 1..295: note = chr20:10199333-10199628
  misc_feature 1..295: note = hyper
  source 1..295: mol_type = genomic DNA
aggtttgcaggccagcgcactgggaaccgagtcaagcgcgccgcagcccgggccccgcccccgcccccgccgtgccccgcccccacttcctcccgcccctcgctgggcggctattaaaagctgctgacgtcaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggta

SEQ ID NO: 13664 - DNA, 37 bp, Homo sapiens
  misc_feature 1..37: note = chr20:10200078-10200115
  misc_feature 1..37: note = hyper
  source 1..37: mol_type = genomic DNA
ggggagttcccgccccgggcaagctgagctgctgcag

SEQ ID NO: 13665 - DNA, 35 bp, Homo sapiens
  misc_feature 1..35: note = chr20:13200599-13200634
  misc_feature 1..35: note = hyper
  source 1..35: mol_type = genomic DNA
agggggaaagggaggcgtgccgtcaagaaagagtt

SEQ ID NO: 13666 - DNA, 96 bp, Homo sapiens; identical to SEQ ID NO: 4738
  misc_feature 1..96: note = chr20:17206513-17206609
  misc_feature 1..96: note = hyper
  source 1..96: mol_type = genomic DNA

SEQ ID NO: 13667 - DNA, 147 bp, Homo sapiens
  misc_feature 1..147: note = chr20:17208510-17208657
  misc_feature 1..147: note = hyper
  source 1..147: mol_type = genomic DNA
cccacccccatcccccggagaaagaatagtttcctacagacgaggctggacgtttggacactgcaattcacctcggtgtttctcccaccccgcgccgggaggacttccctcccagggacttcggtccctgctcctctccgggaacaa

SEQ ID NO: 13668 - DNA, 64 bp, Homo sapiens
  misc_feature 1..64: note = chr20:17208739-17208803
  misc_feature 1..64: note = hyper
  source 1..64: mol_type = genomic DNA
cgcccacccctggagcgcacttctggttggctccctagttctcaactcccggctacaggagctg

SEQ ID NO: 13669 - DNA, 57 bp, Homo sapiens
  misc_feature 1..57: note = chr20:19192824-19192881
  misc_feature 1..57: note = hyper
  source 1..57: mol_type = genomic DNA
ccaggcactgccccccgccaaccctggcccgaccagcctcgccgctgcaggctgccg

SEQ ID NO: 13670 - DNA, 19 bp, Homo sapiens
  misc_feature 1..19: note = chr20:19739612-19739631
  misc_feature 1..19: note = hyper
  source 1..19: mol_type = genomic DNA
cgggcggaggaggagcccc

SEQ ID NO: 13671 - DNA, 39 bp, Homo sapiens
  misc_feature 1..39: note = chr20:20344449-20344488
  misc_feature 1..39: note = hyper
  source 1..39: mol_type = genomic DNA
ggaaggggaaaggatcggggtcgccgcagcctttctggt

SEQ ID NO: 13672 - DNA, 377 bp, Homo sapiens
  misc_feature 1..377: note = chr20:20344800-20345177
  misc_feature 1..377: note = hyper
  source 1..377: mol_type = genomic DNA
agcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggact

SEQ ID NO: 13673 - DNA, 10 bp, Homo sapiens
  misc_feature 1..10: note = chr20:20346166-20346176
  misc_feature 1..10: note = hyper
  source 1..10: mol_type = genomic DNA
gggtggtgaa

SEQ ID NO: 13674 - DNA, 377 bp, Homo sapiens; identical to SEQ ID NO: 1426
  misc_feature 1..377: note = chr20:20347333-20347710
  misc_feature 1..377: note = hyper
  source 1..377: mol_type = genomic DNA

SEQ ID NO: 13675 - DNA, 486 bp, Homo sapiens; identical to SEQ ID NO: 1427
  misc_feature 1..486: note = chr20:20347736-20348222
  misc_feature 1..486: note = hyper
  source 1..486: mol_type = genomic DNA

SEQ ID NO: 13676 - DNA, 26 bp, Homo sapiens
  misc_feature 1..26: note = chr20:20348257-20348283
  misc_feature 1..26: note = hyper
  source 1..26: mol_type = genomic DNA
cggctccggctcgcggattgaaccct

SEQ ID NO: 13677 - DNA, 564 bp, Homo sapiens
  misc_feature 1..564: note = chr20:20348849-20349413
  misc_feature 1..564: note = hyper
  source 1..564: mol_type = genomic DNA
gccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctca

SEQ ID NO: 13678 - DNA, 446 bp, Homo sapiens
  misc_feature 1..446: note = chr20:20349851-20350297
  misc_feature 1..446: note = hyper
  source 1..446: mol_type = genomic DNA
gccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctg

SEQ ID NO: 13679 - DNA, 281 bp, Homo sapiens; identical to SEQ ID NO: 1429
  misc_feature 1..281: note = chr20:21080676-21080957
  misc_feature 1..281: note = hyper
  source 1..281: mol_type = genomic DNA

SEQ ID NO: 13680 - DNA, 817 bp, Homo sapiens; identical to SEQ ID NO: 1430
  misc_feature 1..817: note = chr20:21081028-21081845
  misc_feature 1..817: note = hyper
  source 1..817: mol_type = genomic DNA

SEQ ID NO: 13681 - DNA, 30 bp, Homo sapiens; identical to SEQ ID NO: 1431
  misc_feature 1..30: note = chr20:21082094-21082124
  misc_feature 1..30: note = hyper
  source 1..30: mol_type = genomic DNA

SEQ ID NO: 13682 - DNA, 741 bp, Homo sapiens; identical to SEQ ID NO: 1432
  misc_feature 1..741: note = chr20:21082215-21082956
  misc_feature 1..741: note = hyper
  source 1..741: mol_type = genomic DNA

SEQ ID NO: 13683 - DNA, 416 bp, Homo sapiens; identical to SEQ ID NO: 4747
  misc_feature 1..416: note = chr20:21083498-21083914
  misc_feature 1..416: note = hyper
  source 1..416: mol_type = genomic DNA

SEQ ID NO: 13684 - DNA, 70 bp, Homo sapiens; identical to SEQ ID NO: 4748
  misc_feature 1..70: note = chr20:21084291-21084361
  misc_feature 1..70: note = hyper
  source 1..70: mol_type = genomic DNA

SEQ ID NO: 13685 - DNA, 365 bp, Homo sapiens; identical to SEQ ID NO: 4749
  misc_feature 1..365: note = chr20:21085787-21086152
  misc_feature 1..365: note = hyper
  source 1..365: mol_type = genomic DNA

SEQ ID NO: 13686 - DNA, 257 bp, Homo sapiens; identical to SEQ ID NO: 4750
  misc_feature 1..257: note = chr20:21086194-21086451
  misc_feature 1..257: note = hyper
  source 1..257: mol_type = genomic DNA

SEQ ID NO: 13687 - DNA, 170 bp, Homo sapiens; identical to SEQ ID NO: 1433
  misc_feature 1..170: note = chr20:21086917-21087087
  misc_feature 1..170: note = hyper
  source 1..170: mol_type = genomic DNA

SEQ ID NO: 13688 - DNA, 15 bp, Homo sapiens
  misc_feature 1..15: note = chr20:21372178-21372193
  misc_feature 1..15: note = hyper
  source 1..15: mol_type = genomic DNA
gatggtggcggcgcc

SEQ ID NO: 13689 - DNA, 200 bp, Homo sapiens; identical to SEQ ID NO: 1435
  misc_feature 1..200: note = chr20:21372294-21372494
  misc_feature 1..200: note = hyper
  source 1..200: mol_type = genomic DNA

SEQ ID NO: 13690 - DNA, 36 bp, Homo sapiens
  misc_feature 1..36: note = chr20:21372695-21372731
  misc_feature 1..36: note = hyper
  source 1..36: mol_type = genomic DNA
aggatcctggagctgcgatctcgccagactctattc

SEQ ID NO: 13691 - DNA, 130 bp, Homo sapiens; identical to SEQ ID NO: 1436
  misc_feature 1..130: note = chr20:21376207-21376337
  misc_feature 1..130: note = hyper
  source 1..130: mol_type = genomic DNA

SEQ ID NO: 13692 - DNA, 32 bp, Homo sapiens; identical to SEQ ID NO: 1437
  misc_feature 1..32: note = chr20:21376702-21376734
  misc_feature 1..32: note = hyper
  source 1..32: mol_type = genomic DNA

SEQ ID NO: 13693 - DNA, 253 bp, Homo sapiens; identical to SEQ ID NO: 1438
  misc_feature 1..253: note = chr20:21376876-21377129
  misc_feature 1..253: note = hyper
  source 1..253: mol_type = genomic DNA

SEQ ID NO: 13694 - DNA, 168 bp, Homo sapiens; identical to SEQ ID NO: 1439
  misc_feature 1..168: note = chr20:21377473-21377641
  misc_feature 1..168: note = hyper
  source 1..168: mol_type = genomic DNA

SEQ ID NO: 13695 - DNA, 837 bp, Homo sapiens; identical to SEQ ID NO: 1440
  misc_feature 1..837: note = chr20:21377737-21378574
  misc_feature 1..837: note = hyper
  source 1..837: mol_type = genomic DNA

SEQ ID NO: 13696 - DNA, 701 bp, Homo sapiens; identical to SEQ ID NO: 4759
  misc_feature 1..701: note = chr20:21485959-21486660
  misc_feature 1..701: note = hyper
  source 1..701: mol_type = genomic DNA

SEQ ID NO: 13697 - DNA, 132 bp, Homo sapiens; identical to SEQ ID NO: 4760
  misc_feature 1..132: note = chr20:21486785-21486917
  misc_feature 1..132: note = hyper
  source 1..132: mol_type = genomic DNA

SEQ ID NO: 13698 - DNA, 627 bp, Homo sapiens; identical to SEQ ID NO: 4761
  misc_feature 1..627: note = chr20:21486954-21487581
  misc_feature 1..627: note = hyper
  source 1..627: mol_type = genomic DNA

SEQ ID NO: 13699 - DNA, 32 bp, Homo sapiens
  misc_feature 1..32: note = chr20:21488385-21488417
  misc_feature 1..32: note = hyper
  source 1..32: mol_type = genomic DNA
agtgggatggatccccgcgcataattcaaagg

SEQ ID NO: 13700 - DNA, 30 bp, Homo sapiens
  misc_feature 1..30: note = chr20:21488767-21488797
  misc_feature 1..30: note = hyper
  source 1..30: mol_type = genomic DNA
gcagtgagcaaagtgcgcacaagtgagcca

SEQ ID NO: 13701 - DNA, 146 bp, Homo sapiens; identical to SEQ ID NO: 1441
  misc_feature 1..146: note = chr20:21489301-21489447
  misc_feature 1..146: note = hyper
  source 1..146: mol_type = genomic DNA

SEQ ID NO: 13702 - DNA, 80 bp, Homo sapiens; identical to SEQ ID NO: 1442
  misc_feature 1..80: note = chr20:21489621-21489701
  misc_feature 1..80: note = hyper
  source 1..80: mol_type = genomic DNA

SEQ ID NO: 13703 - DNA, 523 bp, Homo sapiens; identical to SEQ ID NO: 1443
  misc_feature 1..523: note = chr20:21490175-21490698
  misc_feature 1..523: note = hyper
  source 1..523: mol_type = genomic DNA

SEQ ID NO: 13704 - DNA, 91 bp, Homo sapiens
  misc_feature 1..91: note = chr20:21490914-21491005
  misc_feature 1..91: note = hyper
  source 1..91: mol_type = genomic DNA
attgccaaagattctcgctccctggcttcctggggccaaagatcctagggagggctgcagtatcccctccctcccccgagcccagaacccc

SEQ ID NO: 13705 - DNA, 88 bp, Homo sapiens; identical to SEQ ID NO: 1444
  misc_feature 1..88: note = chr20:21491258-21491346
  misc_feature 1..88: note = hyper
  source 1..88: mol_type = genomic DNA

SEQ ID NO: 13706 - DNA, 319 bp, Homo sapiens; identical to SEQ ID NO: 1445
  misc_feature 1..319: note = chr20:21492507-21492826
  misc_feature 1..319: note = hyper
  source 1..319: mol_type = genomic DNA

SEQ ID NO: 13707 - DNA, 764 bp, Homo sapiens; identical to SEQ ID NO: 1446
  misc_feature 1..764: note = chr20:21493230-21493994
  misc_feature 1..764: note = hyper
  source 1..764: mol_type = genomic DNA

SEQ ID NO: 13708 - DNA, 205 bp, Homo sapiens; identical to SEQ ID NO: 4768
  misc_feature 1..205: note = chr20:21494557-21494762
  misc_feature 1..205: note = hyper
  source 1..205: mol_type = genomic DNA

SEQ ID NO: 13709 - DNA, 34 bp, Homo sapiens
  misc_feature 1..34: note = chr20:21496260-21496294
  misc_feature 1..34: note = hyper
  source 1..34: mol_type = genomic DNA
tggctacctgatgctcgttcgccccagaggagtg

SEQ ID NO: 13710 - DNA, 453 bp, Homo sapiens; identical to SEQ ID NO: 4769
  misc_feature 1..453: note = chr20:21496683-21497136
  misc_feature 1..453: note = hyper
  source 1..453: mol_type = genomic DNA

SEQ ID NO: 13711 - DNA, 74 bp, Homo sapiens
  misc_feature 1..74: note = chr20:21497413-21497487
  misc_feature 1..74: note = hyper
  source 1..74: mol_type = genomic DNA
tttggcagcaagtgtcgtttctcgcatatccccagagccctcttaggtgggggagtgcccgcagaggcctccca

SEQ ID NO: 13712 - DNA, 312 bp, Homo sapiens; identical to SEQ ID NO: 4770
  misc_feature 1..312: note = chr20:21497802-21498114
  misc_feature 1..312: note = hyper
  source 1..312: mol_type = genomic DNA

SEQ ID NO: 13713 - DNA, 370 bp, Homo sapiens; identical to SEQ ID NO: 4771
  misc_feature 1..370: note = chr20:21498479-21498849
  misc_feature 1..370: note = hyper
  source 1..370: mol_type = genomic DNA

SEQ ID NO: 13714 - DNA, 101 bp, Homo sapiens
  misc_feature 1..101: note = chr20:21499374-21499475
  misc_feature 1..101: note = hyper
  source 1..101: mol_type = genomic DNA
cctgttgtgggggtgcgctctaaacaacagcaaaccaggcaagaaaggaagatacaggagagcaggcgaggcctcggcacaccctacggaggggagccttt

SEQ ID NO: 13715 - DNA, 30 bp, Homo sapiens
  misc_feature 1..30: note = chr20:21500104-21500134
  misc_feature 1..30: note = hyper
  source 1..30: mol_type = genomic DNA
gttggagactcagagcgtggcatgcacttg

SEQ ID NO: 13716 - DNA, 303 bp, Homo sapiens; identical to SEQ ID NO: 1447
  misc_feature 1..303: note = chr20:21501450-21501753
  misc_feature 1..303: note = hyper
  source 1..303: mol_type = genomic DNA

SEQ ID NO: 13717 - DNA, 58 bp, Homo sapiens; identical to SEQ ID NO: 1448
  misc_feature 1..58: note = chr20:21502087-21502145
  misc_feature 1..58: note = hyper
  source 1..58: mol_type = genomic DNA

SEQ ID NO: 13718 - DNA, 257 bp, Homo sapiens; identical to SEQ ID NO: 1449
  misc_feature 1..257: note = chr20:21502443-21502700
  misc_feature 1..257: note = hyper
  source 1..257: mol_type = genomic DNA

SEQ ID NO: 13719 - DNA, 30 bp, Homo sapiens
  misc_feature 1..30: note = chr20:21503051-21503081
  misc_feature 1..30: note = hyper
  source 1..30: mol_type = genomic DNA
ggaccagacagtcagcgcctggcagcgagg

SEQ ID NO: 13720 - DNA, 281 bp, Homo sapiens; identical to SEQ ID NO: 4775
  misc_feature 1..281: note = chr20:21503617-21503898
  misc_feature 1..281: note = hyper
  source 1..281: mol_type = genomic DNA

SEQ ID NO: 13721 - DNA, 21 bp, Homo sapiens
  misc_feature 1..21: note = chr20:21503899-21503920
  misc_feature 1..21: note = hyper
  source 1..21: mol_type = genomic DNA
acttcgcgggaggtcacagac

SEQ ID NO: 13722 - DNA, 57 bp, Homo sapiens; identical to SEQ ID NO: 1450
  misc_feature 1..57: note = chr20:21682399-21682456
  misc_feature 1..57: note = hyper
  source 1..57: mol_type = genomic DNA

SEQ ID NO: 13723 - DNA, 455 bp, Homo sapiens; identical to SEQ ID NO: 4778
  misc_feature 1..455: note = chr20:21683317-21683772
  misc_feature 1..455: note = hyper
  source 1..455: mol_type = genomic DNA

SEQ ID NO: 13724 - DNA, 17 bp, Homo sapiens
  misc_feature 1..17: note = chr20:21683899-21683916
  misc_feature 1..17: note = hyper
  source 1..17: mol_type = genomic DNA
cgcggactctgctaccg

SEQ ID NO: 13725 - DNA, 109 bp, Homo sapiens; identical to SEQ ID NO: 4780
  misc_feature 1..109: note = chr20:21686184-21686293
  misc_feature 1..109: note = hyper
  source 1..109: mol_type = genomic DNA

SEQ ID NO: 13726 - DNA, 369 bp, Homo sapiens; identical to SEQ ID NO: 4781
  misc_feature 1..369: note = chr20:21686294-21686663
  misc_feature 1..369: note = hyper
  source 1..369: mol_type = genomic DNA

SEQ ID NO: 13727 - DNA, 217 bp, Homo sapiens
  misc_feature 1..217: note = chr20:21687009-21687226
  misc_feature 1..217: note = hyper
  source 1..217: mol_type = genomic DNA
gacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctg

SEQ ID NO: 13728 - DNA, 116 bp, Homo sapiens
  misc_feature 1..116: note = chr20:21689945-21690061
  misc_feature 1..116: note = hyper
  source 1..116: mol_type = genomic DNA
gggcggcggctacctcgccccgggcccgccgtggccgcctgcgcaaggtcctcctctggcgccccccggggccggcgtagctgtgcatggcggggaactcgcggcagcaatgacct

SEQ ID NO: 13729 - DNA, 61 bp, Homo sapiens; identical to SEQ ID NO: 4782
  misc_feature 1..61: note = chr20:21694499-21694560
  misc_feature 1..61: note = hyper
  source 1..61: mol_type = genomic DNA

SEQ ID NO: 13730 - DNA, 71 bp, Homo sapiens
  misc_feature 1..71: note = chr20:21748445-21748516
  misc_feature 1..71: note = hyper
  source 1..71: mol_type = genomic DNA
cccccttctggccctcgtcccgccggagctgcgcttgcgtgaacagccctcaaatgcgtgtttgccctgct

SEQ ID NO: 13731 - DNA, 226 bp, Homo sapiens
  misc_feature 1..226: note = chr20:22557414-22557640
  misc_feature 1..226: note = hyper
  source 1..226: mol_type = genomic DNA
gcgataaagattgggcgtttaaattggccatttggaagattacatctcttcagcgagggtctttctttcaaaactcgcactgaattaagggtcatggctactccgtacccggctctcaaaggcacggcacctttgaattaggttgcggagtggcctgggcgaggggacccggggccatcaaaggcccgagggaaggccgtggggcgacacccgtctaatgacaagt

SEQ ID NO: 13732 - DNA, 46 bp, Homo sapiens
  misc_feature 1..46: note = chr20:22558637-22558683
  misc_feature 1..46: note = hyper
  source 1..46: mol_type = genomic DNA
ggactcgaacccctgcgcgccaaggggagggcgtcaccatgctccg

SEQ ID NO: 13733 - DNA, 16 bp, Homo sapiens
  misc_feature 1..16: note = chr20:22559660-22559676
  misc_feature 1..16: note = hyper
  source 1..16: mol_type = genomic DNA
cgttatctcggaaccc

SEQ ID NO: 13734 - DNA, 13 bp, Homo sapiens
  misc_feature 1..13: note = chr20:22559677-22559690
  misc_feature 1..13: note = hyper
  source 1..13: mol_type = genomic DNA
ggctaggggaggg

SEQ ID NO: 13735 - DNA, 30 bp, Homo sapiens
  misc_feature 1..30: note = chr20:22562721-22562751
  misc_feature 1..30: note = hyper
  source 1..30: mol_type = genomic DNA
gttgttgatggagaacgggtggttgaaggc

SEQ ID NO: 13736 - DNA, 149 bp, Homo sapiens
  misc_feature 1..149: note = chr20:22567416-22567565
  misc_feature 1..149: note = hyper
  source 1..149: mol_type = genomic DNA
agcactattggtggccggggtcagggacaccagagagcgctcggcgggggcttccacagtgacagggcgccccctgtcggccgccaggcccgcgggaccgacccgagtcctcatttacccccgcgatcccaaccccgcagctccggcac

SEQ ID NO: 13737 - DNA, 124 bp, Homo sapiens
  misc_feature 1..124: note = chr20:23029875-23029999
  misc_feature 1..124: note = hyper
  source 1..124: mol_type = genomic DNA
ccgatccagaggcgccggcggccaacgccgccgtcgccgttcagtagcaaggaaatgacatcggcagccaccgaggagcgcactgtcattaggtggccccgcagtccgtcgcagatctgactgg

SEQ ID NO: 13738 - DNA, 62 bp, Homo sapiens
  misc_feature 1..62: note = chr20:23030295-23030357
  misc_feature 1..62: note = hyper
  source 1..62: mol_type = genomic DNA
gcagcctctgacatgcggatcggccagggctcgagtttataagtgcccggccctccctccct

SEQ ID NO: 13739 - DNA, 30 bp, Homo sapiens
  misc_feature 1..30: note = chr20:23030745-23030775
  misc_feature 1..30: note = hyper
  source 1..30: mol_type = genomic DNA
acaggacctgcaagacgctgggaggggtga

SEQ ID NO: 13740 - DNA, 30 bp, Homo sapiens
  misc_feature 1..30: note = chr20:23031047-23031077
  misc_feature 1..30: note = hyper
  source 1..30: mol_type = genomic DNA
atcgggtggggaagtcgcggggacactgtc

SEQ ID NO: 13741 - DNA, 163 bp, Homo sapiens
  misc_feature 1..163: note = chr20:23031307-23031470
  misc_feature 1..163: note = hyper
  source 1..163: mol_type = genomic DNA
ccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaaga

SEQ ID NO: 13742 - DNA, 804 bp, Homo sapiens; identical to SEQ ID NO: 4783
  misc_feature 1..804: note = chr20:24449900-24450704
  misc_feature 1..804: note = hyper
  source 1..804: mol_type = genomic DNA

SEQ ID NO: 13743 - DNA, 200 bp, Homo sapiens; identical to SEQ ID NO: 4784
  misc_feature 1..200: note = chr20:24450819-24451019
  misc_feature 1..200: note = hyper
  source 1..200: mol_type = genomic DNA

SEQ ID NO: 13744 - DNA, 81 bp, Homo sapiens
  misc_feature 1..81: note = chr20:24451426-24451507
  misc_feature 1..81: note = hyper
  source 1..81: mol_type = genomic DNA
acgcagaggcttgggcgcttggcacccagacttcaggtgcgcacagtcctcctgcgacgtcagatgcgctggcgccgcggc

SEQ ID NO: 13745 - DNA, 36 bp, Homo sapiens
  misc_feature 1..36: note = chr20:25058448-25058484
  misc_feature 1..36: note = hyper
  source 1..36: mol_type = genomic DNA
ccccagcgcttctcccgcttgcgccatttggccctg

SEQ ID NO: 13746 - DNA, 43 bp, Homo sapiens; identical to SEQ ID NO: 1451
  misc_feature 1..43: note = chr20:25061746-25061789
  misc_feature 1..43: note = hyper
  source 1..43: mol_type = genomic DNA

SEQ ID NO: 13747 - DNA, 334 bp, Homo sapiens; identical to SEQ ID NO: 1452
  misc_feature 1..334: note = chr20:25061978-25062312
  misc_feature 1..334: note = hyper
  source 1..334: mol_type = genomic DNA

SEQ ID NO: 13748 - DNA, 136 bp, Homo sapiens; identical to SEQ ID NO: 1453
  misc_feature 1..136: note = chr20:25062510-25062646
  misc_feature 1..136: note = hyper
  source 1..136: mol_type = genomic DNA

SEQ ID NO: 13749 - DNA, 111 bp, Homo sapiens; identical to SEQ ID NO: 1454
  misc_feature 1..111: note = chr20:25062707-25062818
  misc_feature 1..111: note = hyper
  source 1..111: mol_type = genomic DNA

SEQ ID NO: 13750 - DNA, 71 bp, Homo sapiens; identical to SEQ ID NO: 1455
  misc_feature 1..71: note = chr20:25062870-25062941
  misc_feature 1..71: note = hyper
  source 1..71: mol_type = genomic DNA

SEQ ID NO: 13751 - DNA, 180 bp, Homo sapiens; identical to SEQ ID NO: 1456
  misc_feature 1..180: note = chr20:25063727-25063907
  misc_feature 1..180: note = hyper
  source 1..180: mol_type = genomic DNA

SEQ ID NO: 13752 - DNA, 518 bp, Homo sapiens; identical to SEQ ID NO: 1457
  misc_feature 1..518: note = chr20:25063993-25064511
  misc_feature 1..518: note = hyper
  source 1..518: mol_type = genomic DNA

SEQ ID NO: 13753 - DNA, 30 bp, Homo sapiens
  misc_feature 1..30: note = chr20:25064790-25064820
  misc_feature 1..30: note = hyper
  source 1..30: mol_type = genomic DNA
ttaacccagtcacatcggacacagagacgt

SEQ ID NO: 13754 - DNA, 28 bp, Homo sapiens
  misc_feature 1..28: note = chr20:25065179-25065207
  misc_feature 1..28: note = hyper
  source 1..28: mol_type = genomic DNA
ccacccagagcccagcgtcaagttatac

SEQ ID NO: 13755 - DNA, 187 bp, Homo sapiens; identical to SEQ ID NO: 1459
  misc_feature 1..187: note = chr20:25065208-25065395
  misc_feature 1..187: note = hyper
  source 1..187: mol_type = genomic DNA

SEQ ID NO: 13756 - DNA, 29 bp, Homo sapiens
  misc_feature 1..29: note = chr20:25129464-25129493
  misc_feature 1..29: note = hyper
  source 1..29: mol_type = genomic DNA
cgcccatccccgtgcgcacgtgttcgctg

SEQ ID NO: 13757 - DNA, 206 bp, Homo sapiens
  misc_feature 1..206: note = chr20:25565991-25566197
  misc_feature 1..206: note = hyper
  source 1..206: mol_type = genomic DNA
gtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctccc

SEQ ID NO: 13758 - DNA, 151 bp, Homo sapiens
  misc_feature 1..151: note = chr20:26188811-26188962
  misc_feature 1..151: note = hyper
  source 1..151: mol_type = genomic DNA
aaacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccac

SEQ ID NO: 13759 - DNA, 19 bp, Homo sapiens
  misc_feature 1..19: note = chr20:26189582-26189601
  misc_feature 1..19: note = hyper
  source 1..19: mol_type = genomic DNA
ggcccgcagaggcgctcag

SEQ ID NO: 13760 - DNA, 30 bp, Homo sapiens
  misc_feature 1..30: note = chr20:26189977-26190007
  misc_feature 1..30: note = hyper
  source 1..30: mol_type = genomic DNA
ctcactcaaccgcctcgaaccccacaccga

SEQ ID NO: 13761 - DNA, 136 bp, Homo sapiens
  misc_feature 1..136: note = chr20:30063113-30063249
  misc_feature 1..136: note = hyper
  source 1..136: mol_type = genomic DNA
cctggagcatccagccgctggagctgcgagggaccctggacccctcccacgccgaggtaaagccctgcgctacgcgccgccaacttgctcaagttggagcagagttcgccaggcgattgaagggggattcggcagc

SEQ ID NO: 13762 - DNA, 262 bp, Homo sapiens
  misc_feature 1..262: note = chr20:30063250-30063512
  misc_feature 1..262: note = hyper
  source 1..262: mol_type = genomic DNA
ttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccg

SEQ ID NO: 13763 - DNA, 39 bp, Homo sapiens
  misc_feature 1..39: note = chr20:30582939-30582978
  misc_feature 1..39: note = hyper
  source 1..39: mol_type = genomic DNA
ctggcagatgctgttcgagagcgccgacgtgagcatgct

SEQ ID NO: 13764 - DNA, 136 bp, Homo sapiens
  misc_feature 1..136: note = chr20:30639183-30639319
  misc_feature 1..136: note = hyper
  source 1..136: mol_type = genomic DNA
aatggagcaggcctgcggaagagaaaccgctgaccacagacctgcctggaagtctcgggccgcggagttggggagggccgggccagaagggaggggtcggagtggtggggaaaagagatcacgatgcttccggggt

SEQ ID NO: 13765 - DNA, 236 bp, Homo sapiens
  misc_feature 1..236: note = chr20:30639800-30640036
  misc_feature 1..236: note = hyper
  source 1..236: mol_type = genomic DNA
gaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctg

SEQ ID NO: 13766 - DNA, 16 bp, Homo sapiens
  misc_feature 1..16: note = chr20:30640240-30640256
  misc_feature 1..16: note = hyper
  source 1..16: mol_type = genomic DNA
caagctgcgaggatcc

SEQ ID NO: 13767 - DNA, 103 bp, Homo sapiens
  misc_feature 1..103: note = chr20:30640257-30640360
  misc_feature 1..103: note = hyper
  source 1..103: mol_type = genomic DNA
ggctgcccgcgagacgaggagcgggcgcccaggtgagtgccgcgcacaggggaccgggaatacccggcccgcgaggggtcccaggaggcggagggagcccagg

SEQ ID NO: 13768 - DNA, 209 bp, Homo sapiens
  misc_feature 1..209: note = chr20:30777956-30778165
  misc_feature 1..209: note = hyper
  source 1..209: mol_type = genomic DNA
cgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtggg

SEQ ID NO: 13769 - DNA, 38 bp, Homo sapiens
  misc_feature 1..38: note = chr20:32804098-32804136
  misc_feature 1..38: note = hyper
  source 1..38: mol_type = genomic DNA
tctccgagtaggtgccgcgcgggcgggcgctggcgcca

SEQ ID NO: 13770 - DNA, 254 bp, Homo sapiens
  misc_feature 1..254: note = chr20:33146323-33146577
  misc_feature 1..254: note = hyper
  source 1..254: mol_type = genomic DNA
tgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagccc

SEQ ID NO: 13771 - DNA, 24 bp, Homo sapiens
  misc_feature 1..24: note = chr20:34188608-34188632
  misc_feature 1..24: note = hyper
  source 1..24: mol_type = genomic DNA
ttctttttcttctttcgggtgagc

SEQ ID NO: 13772 - DNA, 342 bp, Homo sapiens; identical to SEQ ID NO: 1461
  misc_feature 1..342: note = chr20:34188747-34189089
  misc_feature 1..342: note = hyper
  source 1..342: mol_type = genomic DNA

SEQ ID NO: 13773 - DNA, 326 bp, Homo sapiens; identical to SEQ ID NO: 1462
  misc_feature 1..326: note = chr20:34189166-34189492
  misc_feature 1..326: note = hyper
  source 1..326: mol_type = genomic DNA

SEQ ID NO: 13774 - DNA, 375 bp, Homo sapiens; identical to SEQ ID NO: 1463
  misc_feature 1..375: note = chr20:34189679-34190054
  misc_feature 1..375: note = hyper
  source 1..375: mol_type = genomic DNA

SEQ ID NO: 13775 - DNA, 74 bp, Homo sapiens
  misc_feature 1..74: note = chr20:35491337-35491411
  misc_feature 1..74: note = hyper
  source 1..74: mol_type = genomic DNA
tccaggcccagcaggcgcgcctcctccgacgcgcagtccgacacctccgagctgctatccgtgaggctgggggg

SEQ ID NO: 13776 - DNA, 40 bp, Homo sapiens
  misc_feature 1..40: note = chr20:36013211-36013251
  misc_feature 1..40: note = hyper
  source 1..40: mol_type = genomic DNA
ggcaccggatggccccggttgggcccgcgccaggatgcgc

SEQ ID NO: 13777 - DNA, 174 bp, Homo sapiens
  misc_feature 1..174: note = chr20:36531812-36531986
  misc_feature 1..174: note = hyper
  source 1..174: mol_type = genomic DNA
ctcggcggcgccacgcggcccgccggccacgcgccctgggacaaccacgtctccggccacggtgagttcggtcgccgcccccgcggacttccccaccaaaccccaacccgggccgcgccactccaacttggccgccccggggctcgaaccggcgccagtcgtggcgggcatccc

SEQ ID NO: 13778 - DNA, 69 bp, Homo sapiens
  misc_feature 1..69: note = chr20:36888892-36888961
  misc_feature 1..69: note = hyper
  source 1..69: mol_type = genomic DNA
gcgttaccatggtgacgggctgccagcggcgggcggcgcggctcctctcctgggcgcggggtctgtggg

SEQ ID NO: 13779 - DNA, 796 bp, Homo sapiens; identical to SEQ ID NO: 1464
  misc_feature 1..796: note = chr20:37302580-37303376
  misc_feature 1..796: note = hyper
  source 1..796: mol_type = genomic DNA

SEQ ID NO: 13780 - DNA, 122 bp, Homo sapiens
  misc_feature 1..122: note = chr20:37351701-37351823
  misc_feature 1..122: note = hyper
  source 1..122: mol_type = genomic DNA
acttccagtcacagccgctacttctccattcaggctgggactgccaggtggagccctgcggtttactgctcaggaggagcccggccaggacatcagctggggacttacgcagggacccattc

SEQ ID NO: 13781 - DNA, 401 bp, Homo sapiens; identical to SEQ ID NO: 1465
  misc_feature 1..401: note = chr20:37352115-37352516
  misc_feature 1..401: note = hyper
  source 1..401: mol_type = genomic DNA

SEQ ID NO: 13782 - DNA, 20 bp, Homo sapiens
  misc_feature 1..20: note = chr20:37352606-37352626
  misc_feature 1..20: note = hyper
  source 1..20: mol_type = genomic DNA
cggggcgcccagaccagtcc

SEQ ID NO: 13783 - DNA, 250 bp, Homo sapiens
  misc_feature 1..250: note = chr20:37352977-37353227
  misc_feature 1..250: note = hyper
  source 1..250: mol_type = genomic DNA
cgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgaggg

SEQ ID NO: 13784 - DNA, 284 bp, Homo sapiens; identical to SEQ ID NO: 1467
  misc_feature 1..284: note = chr20:37353435-37353719
  misc_feature 1..284: note = hyper
  source 1..284: mol_type = genomic DNA

SEQ ID NO: 13785 - DNA, 1026 bp, Homo sapiens; identical to SEQ ID NO: 1468
  misc_feature 1..1026: note = chr20:37353806-37354832
  misc_feature 1..1026: note = hyper
  source 1..1026: mol_type = genomic DNA

SEQ ID NO: 13786 - DNA, 239 bp, Homo sapiens; identical to SEQ ID NO: 1469
  misc_feature 1..239: note = chr20:37354993-37355232
  misc_feature 1..239: note = hyper
  source 1..239: mol_type = genomic DNA

SEQ ID NO: 13787 - DNA, 541 bp, Homo sapiens; identical to SEQ ID NO: 1470
  misc_feature 1..541: note = chr20:37355502-37356043
  misc_feature 1..541: note = hyper
  source 1..541: mol_type = genomic DNA

SEQ ID NO: 13788 - DNA, 297 bp, Homo sapiens; identical to SEQ ID NO: 1471
  misc_feature 1..297: note = chr20:37356168-37356465
  misc_feature 1..297: note = hyper
  source 1..297: mol_type = genomic DNA

SEQ ID NO: 13789 - DNA, 73 bp, Homo sapiens
  misc_feature 1..73: note = chr20:37356716-37356789
  misc_feature 1..73: note = hyper
  source 1..73: mol_type = genomic DNA
gcatgatgaactggacgcacatcgcagcctgcgtgctcaagggcctcttcgcgctcgtcgcctacctcacctg

SEQ ID NO: 13790 - DNA, 295 bp, Homo sapiens
  misc_feature 1..295: note = chr20:37357254-37357549
  misc_feature 1..295: note = hyper
  source 1..295: mol_type = genomic DNA
agcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctct

SEQ ID NO: 13791 - DNA, 365 bp, Homo sapiens; identical to SEQ ID NO: 1472
  misc_feature 1..365: note = chr20:37357825-37358190
  misc_feature 1..365: note = hyper
  source 1..365: mol_type = genomic DNA

SEQ ID NO: 13792 - DNA, 224 bp, Homo sapiens; identical to SEQ ID NO: 1473
  misc_feature 1..224: note = chr20:37434129-37434353
  misc_feature 1..224: note = hyper
  source 1..224: mol_type = genomic DNA

SEQ ID NO: 13793 - DNA, 234 bp, Homo sapiens; identical to SEQ ID NO: 1474
  misc_feature 1..234: note = chr20:37434488-37434722
  misc_feature 1..234: note = hyper
  source 1..234: mol_type = genomic DNA

SEQ ID NO: 13794 - DNA, 158 bp, Homo sapiens; identical to SEQ ID NO: 1475
  misc_feature 1..158: note = chr20:37434736-37434894
  misc_feature 1..158: note = hyper
  source 1..158: mol_type = genomic DNA

SEQ ID NO: 13795 - DNA, 440 bp, Homo sapiens; identical to SEQ ID NO: 1476
  misc_feature 1..440: note = chr20:37434930-37435370
  misc_feature 1..440: note = hyper
  source 1..440: mol_type = genomic DNA

SEQ ID NO: 13796 - DNA, 229 bp, Homo sapiens; identical to SEQ ID NO: 1477
  misc_feature 1..229: note = chr20:37435487-37435716
  misc_feature 1..229: note = hyper
  source 1..229: mol_type = genomic DNA

SEQ ID NO: 13797 - DNA, 132 bp, Homo sapiens; identical to SEQ ID NO: 1478
  misc_feature 1..132: note = chr20:37435717-37435849
  misc_feature 1..132: note = hyper
  source 1..132: mol_type = genomic DNA

SEQ ID NO: 13798 - DNA, 228 bp, Homo sapiens
  misc_feature 1..228: note = chr20:39316107-39316335
  misc_feature 1..228: note = hyper
  source 1..228: mol_type = genomic DNA
gcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggt

SEQ ID NO: 13799 - DNA, 515 bp, Homo sapiens
  misc_feature 1..515: note = chr20:39317052-39317567
  misc_feature 1..515: note = hyper
  source 1..515: mol_type = genomic DNA
cgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcggg

SEQ ID NO: 13800 - DNA, 146 bp, Homo sapiens; identical to SEQ ID NO: 4813
  misc_feature 1..146: note = chr20:39319058-39319204
  misc_feature 1..146: note = hyper
  source 1..146: mol_type = genomic DNA

SEQ ID NO: 13801 - DNA, 512 bp, Homo sapiens; identical to SEQ ID NO: 4814
  misc_feature 1..512: note = chr20:39995034-39995546
  misc_feature 1..512: note = hyper
  source 1..512: mol_type = genomic DNA

SEQ ID NO: 13802 - DNA, 67 bp, Homo sapiens; identical to SEQ ID NO: 4815
  misc_feature 1..67: note = chr20:39995547-39995614
  misc_feature 1..67: note = hyper
  source 1..67: mol_type = genomic DNA

SEQ ID NO: 13803 - DNA, 131 bp, Homo sapiens
  misc_feature 1..131: note = chr20:41817785-41817916
  misc_feature 1..131: note = hyper
  source 1..131: mol_type = genomic DNA
agcttcctgtatctccgaggaaaaaagaaaagccgccgccccggcagcctcggcctgctggggacctgtcctccccactaaaagcgcgcgctgcccgaggagctgcccgggagagaacgctccaccccggg

SEQ ID NO: 13804 - DNA, 15 bp, Homo sapiens
  misc_feature 1..15: note = chr20:41818007-41818022
  misc_feature 1..15: note = hyper
  source 1..15: mol_type = genomic DNA
cgcggaaagttactc

SEQ ID NO: 13805 - DNA, 236 bp, Homo sapiens; identical to SEQ ID NO: 1479
  misc_feature 1..236: note = chr20:41818513-41818749
  misc_feature 1..236: note = hyper
  source 1..236: mol_type = genomic DNA

SEQ ID NO: 13806 - DNA, 211 bp, Homo sapiens; identical to SEQ ID NO: 1480
  misc_feature 1..211: note = chr20:41818804-41819015
  misc_feature 1..211: note = hyper
  source 1..211: mol_type = genomic DNA

SEQ ID NO: 13807 - DNA, 102 bp, Homo sapiens
  misc_feature 1..102: note = chr20:42136090-42136192
  misc_feature 1..102: note = hyper
  source 1..102: mol_type = genomic DNA
tgtgatgcaggggttcgggggcaggaaaaatctcgacccgccacgcccgtgcggcaaacctgtcctaggttgagggggcatgaggcgcgcacaaccagggcc

SEQ ID NO: 13808 - DNA, 71 bp, Homo sapiens
  misc_feature 1..71: note = chr20:42136403-42136474
  misc_feature 1..71: note = hyper
  source 1..71: mol_type = genomic DNA
tgggctcagaccttgcgtcccctgggcgccgcgccaccccgctccgtccagggcggcgagggctcaggtct

SEQ ID NO: 13809 - DNA, 836 bp, Homo sapiens; identical to SEQ ID NO: 1481
  misc_feature 1..836: note = chr20:42543698-42544534
  misc_feature 1..836: note = hyper
  source 1..836: mol_type = genomic DNA

SEQ ID NO: 13810 - DNA, 257 bp, Homo sapiens; identical to SEQ ID NO: 1482
  misc_feature 1..257: note = chr20:42544727-42544984
  misc_feature 1..257: note = hyper
  source 1..257: mol_type = genomic DNA

SEQ ID NO: 13811 - DNA, 170 bp, Homo sapiens
  misc_feature 1..170: note = chr20:42587835-42588005
  misc_feature 1..170: note = hyper
  source 1..170: mol_type = genomic DNA
ggaggaatctgaggacgagaggggtaagatccctgcccactgccatgcagcagcttagtgcagagcctggacttgaacctagatctgcctgcttccagagctgtgctgcaccagtgttctcgcagctcccagtccaaaggccgacgttgagacagcgcttaaaaatatat

SEQ ID NO: 13812 - DNA, 798 bp, Homo sapiens
  misc_feature 1..798: note = chr20:43438334-43439132
  misc_feature 1..798: note = hyper
  source 1..798: mol_type = genomic DNA
cgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgc

SEQ ID NO: 13813 - DNA, 27 bp, Homo sapiens
  misc_feature 1..27: note = chr20:43439192-43439219
  misc_feature 1..27: note = hyper
  source 1..27: mol_type = genomic DNA
gcggcgccccccgccggcagcgcgagg

SEQ ID NO: 13814 - DNA, 263 bp, Homo sapiens
  misc_feature 1..263: note = chr20:43439247-43439510
  misc_feature 1..263: note = hyper
  source 1..263: mol_type = genomic DNA
cgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatg

SEQ ID NO: 13815 - skipped

SEQ ID NO: 13816 - DNA, 24 bp, Homo sapiens
  misc_feature 1..24: note = chr20:43726764-43726788
  misc_feature 1..24: note = hyper
  source 1..24: mol_type = genomic DNA
cgagtagcccgggttctccatggt

SEQ ID NO: 13817 - DNA, 187 bp, Homo sapiens
  misc_feature 1..187: note = chr20:44452827-44453014
  misc_feature 1..187: note = hyper
  source 1..187: mol_type = genomic DNA
tcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgacc

SEQ ID NO: 13818 - DNA, 30 bp, Homo sapiens
  misc_feature 1..30: note = chr20:44540105-44540135
  misc_feature 1..30: note = hyper
  source 1..30: mol_type = genomic DNA
ggggtggggtggggtcgcaggagttatctg

SEQ ID NO: 13819 - DNA, 37 bp, Homo sapiens
  misc_feature 1..37: note = chr20:44540652-44540689
  misc_feature 1..37: note = hyper
  source 1..37: mol_type = genomic DNA
ggcttcagtgcaccacgcggctcggcgagggactggg

SEQ ID NO: 13820 - DNA, 62 bp, Homo sapiens
  misc_feature 1..62: note = chr20:44639434-44639496
  misc_feature 1..62: note = hyper
  source 1..62: mol_type = genomic DNA
aggctgggagagcttcgcgcaggcgggatttcagcccgcacttatttcggagcccttgcctt

SEQ ID NO: 13821 - DNA, 233 bp, Homo sapiens
  misc_feature 1..233: note = chr20:44650230-44650463
  misc_feature 1..233: note = hyper
  source 1..233: mol_type = genomic DNA
gattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctga

SEQ ID NO: 13822 - DNA, 47 bp, Homo sapiens
  misc_feature 1..47: note = chr20:44659209-44659256
  misc_feature 1..47: note = hyper
  source 1..47: mol_type = genomic DNA
cgcgcctgctgtctgcgctcagcgccttcaaacgttcccctgggcac

SEQ ID NO: 13823 - DNA, 78 bp, Homo sapiens
  misc_feature 1..78: note = chr20:44660871-44660949
  misc_feature 1..78: note = hyper
  source 1..78: mol_type = genomic DNA
ctagttgcagggtctcgggccaggaagcccctattcctgtcccctgagcgccacccgcccccgcgaaggaggaggcgc

SEQ ID NO: 13824 - DNA, 90 bp, Homo sapiens
  misc_feature 1..90: note = chr20:44686525-44686615
  misc_feature 1..90: note = hyper
  source 1..90: mol_type = genomic DNA
aaggttgggagaaggcgcggaaaggagaggagctggggccttggggacccccaggtagtccatgcggcccattcctccccttcccactcc

SEQ ID NO: 13825 - DNA, 164 bp, Homo sapiens
  misc_feature 1..164: note = chr20:44686627-44686791
  misc_feature 1..164: note = hyper
  source 1..164: mol_type = genomic DNA
cgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaa

SEQ ID NO: 13826 - DNA, 41 bp, Homo sapiens
  misc_feature 1..41: note = chr20:44687186-44687227
  misc_feature 1..41: note = hyper
  source 1..41: mol_type = genomic DNA
tcaagaggaagaaaccgagaggcccgcgccccaccgaggaa

SEQ ID NO: 13827 - skipped

SEQ ID NO: 13828 - DNA, 562 bp, Homo sapiens
  misc_feature 1..562: note = chr20:44803172-44803734
  misc_feature 1..562: note = hyper
  source 1..562: mol_type = genomic DNA
cggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagg

SEQ ID NO: 13829 - DNA, 127 bp, Homo sapiens
  misc_feature 1..127: note = chr20:44880040-44880167
  misc_feature 1..127: note = hyper
  source 1..127: mol_type = genomic DNA
cggccgccgggatgtcgcccccgacggggcacccggacgggcccgcggccctgaacgccgcccagccgcgggggtacccggctggagggggagggggcgcggccgcatccggggcatggacagcccc

SEQ ID NO: 13830 - DNA, 157 bp, Homo sapiens
  misc_feature 1..157: note = chr20:44936314-44936471
  misc_feature 1..157: note = hyper
  source 1..157: mol_type = genomic DNA
cgcggctggagtcagcctccgggtgtccccggacgcggcacgacctcgcacacacacaccgcgcgcacacgctcgcgccgtgcggtattttcccggccccggaccccgcctctgggaggggccggggagccgagccccgctagcagggttgggggac

SEQ ID NO: 13831 - DNA, 127 bp, Homo sapiens
  misc_feature 1..127: note = chr20:44941500-44941627
  misc_feature 1..127: note = hyper
  source 1..127: mol_type = genomic DNA
gcccttggctgggggcgccaggacggggaggggcgagcctgcgggagccacaggcgccgaggccgtgcgcccttaagcacctccacctcatggcgttaatcctcgcagaccccgcagccagactgcc

SEQ ID NO: 13832 - DNA, 71 bp, Homo sapiens
  misc_feature 1..71: note = chr20:45141858-45141929
  misc_feature 1..71: note = hyper
  source 1..71: mol_type = genomic DNA
ttcaccttcaccaagcgccttcttcgggcaaatcagggccctagagagagctcgcccgtggcctgcaggtc

SEQ ID NO: 13833 - DNA, 43 bp, Homo sapiens
  misc_feature 1..43: note = chr20:45142185-45142228
  misc_feature 1..43: note = hyper
  source 1..43: mol_type = genomic DNA
cccggaagagcctggcgaaccggaagggcgtccaggtaaaaaa

SEQ ID NO: 13834 - DNA, 128 bp, Homo sapiens; identical to SEQ ID NO: 1483
  misc_feature 1..128: note = chr20:45279854-45279982
  misc_feature 1..128: note = hyper
  source 1..128: mol_type = genomic DNA

SEQ ID NO: 13835 - DNA, 218 bp, Homo sapiens; identical to SEQ ID NO: 1484
  misc_feature 1..218: note = chr20:45280039-45280257
  misc_feature 1..218: note = hyper
  source 1..218: mol_type = genomic DNA

SEQ ID NO: 13836 - DNA, 410 bp, Homo sapiens
  misc_feature 1..410: note = chr20:45523248-45523658
  misc_feature 1..410: note = hyper
  source 1..410: mol_type = genomic DNA
accggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggcc

SEQ ID NO: 13837 - DNA, 140 bp, Homo sapiens
  misc_feature 1..140: note = chr20:45523893-45524033
  misc_feature 1..140: note = hyper
  source 1..140: mol_type = genomic DNA
tgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccc

SEQ ID NO: 13838 - DNA, 55 bp, Homo sapiens
  misc_feature 1..55: note = chr20:45524523-45524578
  misc_feature 1..55: note = hyper
  source 1..55: mol_type = genomic DNA
aggttcctgcttccccgaagccgaggctgagagttgacagcgtgcaccctgccgc

SEQ ID NO: 13839 - DNA, 218 bp, Homo sapiens; identical to SEQ ID NO: 4822
  misc_feature 1..218: note = chr20:47443719-47443937
  misc_feature 1..218: note = hyper
  source 1..218: mol_type = genomic DNA

SEQ ID NO: 13840 - DNA, 297 bp, Homo sapiens; identical to SEQ ID NO: 4823
  misc_feature 1..297: note = chr20:47443944-47444241
  misc_feature 1..297: note = hyper
  source 1..297: mol_type = genomic DNA

SEQ ID NO: 13841 - DNA, 186 bp, Homo sapiens; identical to SEQ ID NO: 4824
  misc_feature 1..186: note = chr20:47444242-47444428
  misc_feature 1..186: note = hyper
  source 1..186: mol_type = genomic DNA

SEQ ID NO: 13842 - DNA, 129 bp, Homo sapiens; identical to SEQ ID NO: 4825
  misc_feature 1..129: note = chr20:47444452-47444581
  misc_feature 1..129: note = hyper
  source 1..129: mol_type = genomic DNA

SEQ ID NO: 13843 - DNA, 184 bp, Homo sapiens; identical to SEQ ID NO: 4826
  misc_feature 1..184: note = chr20:47444609-47444793
  misc_feature 1..184: note = hyper
  source 1..184: mol_type = genomic DNA

SEQ ID NO: 13844 - DNA, 295 bp, Homo sapiens; identical to SEQ ID NO: 4827
  misc_feature 1..295: note = chr20:47444920-47445215
  misc_feature 1..295: note = hyper
  source 1..295: mol_type = genomic DNA

SEQ ID NO: 13845 - DNA, 134 bp, Homo sapiens; identical to SEQ ID NO: 4828
  misc_feature 1..134: note = chr20:47934853-47934987
  misc_feature 1..134: note = hyper
  source 1..134: mol_type = genomic DNA

SEQ ID NO: 13846 - DNA, 606 bp, Homo sapiens; identical to SEQ ID NO: 4829
  misc_feature 1..606: note = chr20:47934988-47935594
  misc_feature 1..606: note = hyper
  source 1..606: mol_type = genomic DNA

SEQ ID NO: 13847 - DNA, 50 bp, Homo sapiens
  misc_feature 1..50: note = chr20:47935928-47935978
  misc_feature 1..50: note = hyper
  source 1..50: mol_type = genomic DNA
gttgcaagcttctttcgggcggaggggtcacaaggcgaatggagaaggtg

SEQ ID NO: 13848 - DNA, 30 bp, Homo sapiens
  misc_feature 1..30: note = chr20:48099143-48099173
  misc_feature 1..30: note = hyper
  source 1..30: mol_type = genomic DNA
ggcgcgcgtcacggccgtcttctcacctcc

SEQ ID NO: 13849 - DNA, 30 bp, Homo sapiens
  misc_feature 1..30: note = chr20:48099543-48099573
  misc_feature 1..30: note = hyper
  source 1..30: mol_type = genomic DNA
tcccgaacctggccccgccatggggagaga

SEQ ID NO: 13850 - DNA, 225 bp, Homo sapiens
  misc_feature 1..225: note = chr20:48184381-48184606
  misc_feature 1..225: note = hyper
  source 1..225: mol_type = genomic DNA
ttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagc

SEQ ID NO: 13851 - DNA, 54 bp, Homo sapiens
  misc_feature 1..54: note = chr20:48788965-48789019
  misc_feature 1..54: note = hyper
  source 1..54: mol_type = genomic DNA
ccagagctgaccctgcggcgcctttcccaggctcgcgtccggtgagttcctatt

SEQ ID NO: 13852 - DNA, 255 bp, Homo sapiens
  misc_feature 1..255: note = chr20:49639257-49639512
  misc_feature 1..255: note = hyper
  source 1..255: mol_type = genomic DNA
tggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctgga

SEQ ID NO: 13853 - DNA, 83 bp, Homo sapiens
  misc_feature 1..83: note = chr20:49639774-49639857
  misc_feature 1..83: note = hyper
  source 1..83: mol_type = genomic DNA
tcgggacagtggcagcggcgccaccgtcacggggcgtccaggcgcccaatcgggaccccgcaccttggatccgggggccctgg

SEQ ID NO: 13854 - DNA, 38 bp, Homo sapiens
  misc_feature 1..38: note = chr20:49639882-49639920
  misc_feature 1..38: note = hyper
  source 1..38: mol_type = genomic DNA
cggccagttcctgagcccgcgtccgggactgctcgcgc

SEQ ID NO: 13855 - DNA, 48 bp, Homo sapiens
  misc_feature 1..48: note = chr20:49836918-49836966
  misc_feature 1..48: note = hyper
  source 1..48: mol_type = genomic DNA
ccgtcctgcaggtggcgcgcctgagcccgtgcacggcagcctctccgg

SEQ ID NO: 13856 - DNA, 30 bp, Homo sapiens
  misc_feature 1..30: note = chr20:50157990-50158020
  misc_feature 1..30: note = hyper
  source 1..30: mol_type = genomic DNA
tcctcctccctctaacgaatgctcctgtta

SEQ ID NO: 13857 - DNA, 30 bp, Homo sapiens
  misc_feature 1..30: note = chr20:50158389-50158419
  misc_feature 1..30: note = hyper
  source 1..30: mol_type = genomic DNA
aggtgatgggagctgcgtggcctcacttca

SEQ ID NO: 13858 - DNA, 809 bp, Homo sapiens; identical to SEQ ID NO: 1485
  misc_feature 1..809: note = chr20:50720392-50721201
  misc_feature 1..809: note = hyper
  source 1..809: mol_type = genomic DNA

SEQ ID NO: 13859 - DNA, 437 bp, Homo sapiens; identical to SEQ ID NO: 1486
  misc_feature 1..437: note = chr20:50721234-50721671
  misc_feature 1..437: note = hyper
  source 1..437: mol_type = genomic DNA

SEQ ID NO: 13860 - DNA, 30 bp, Homo sapiens
  misc_feature 1..30: note = chr20:51589878-51589908
  misc_feature 1..30: note = hyper
  source 1..30: mol_type = genomic DNA
gaaacggctccgcttcggggctgccctgtg

SEQ ID NO: 13861 - DNA, 30 bp, Homo sapiens
  misc_feature 1..30: note = chr20:52789445-52789475
  misc_feature 1..30: note = hyper
  source 1..30: mol_type = genomic DNA
acaggatcagcagcccgtagccttctttgc

SEQ ID NO: 13862 - DNA, 15 bp, Homo sapiens
  misc_feature 1..15: note = chr20:52789934-52789949
  misc_feature 1..15: note = hyper
  source 1..15: mol_type = genomic DNA
tggggcccggcaggg

SEQ ID NO: 13863 - DNA, 48 bp, Homo sapiens
  misc_feature 1..48: note = chr20:53091752-53091800
  misc_feature 1..48: note = hyper
  source 1..48: mol_type = genomic DNA
ctccccagacacacacgcaaaatcggcccttctcggggaaagggcagg

SEQ ID NO: 13864 - DNA, 67 bp, Homo sapiens
  misc_feature 1..67: note = chr20:53092166-53092233
  misc_feature 1..67: note = hyper
  source 1..67: mol_type = genomic DNA
gctggatccctcagccgccgccgctcctcctcctggcaggccggccgcggagtcagctgacgccggc

SEQ ID NO: 13865 - DNA, 100 bp, Homo sapiens
  misc_feature 1..100: note = chr20:53092234-53092334
  misc_feature 1..100: note = hyper
  source 1..100: mol_type = genomic DNA
ctccagcctcgcctccccgcgccgcgctctgcgctccccgaaagtggctgcaagccggccgcccactgtcagggttggggggacagagaaagtgatgtgc

SEQ ID NO: 13866 - DNA, 41 bp, Homo sapiens
  misc_feature 1..41: note = chr20:53092335-53092376
  misc_feature 1..41: note = hyper
  source 1..41: mol_type = genomic DNA
ccttctaaagcctcgcccagcgccgccgaagcagcttcacc

SEQ ID NO: 13867 - DNA, 32 bp, Homo sapiens
  misc_feature 1..32: note = chr20:53092763-53092795
  misc_feature 1..32: note = hyper
  source 1..32: mol_type = genomic DNA
ctttctgatggtggccgcgtgttgggcttcag

SEQ ID NO: 13868 - DNA, 30 bp, Homo sapiens
  misc_feature 1..30: note = chr20:53093219-53093249
  misc_feature 1..30: note = hyper
  source 1..30: mol_type = genomic DNA
tgatacctggcatagcgcaagtgctcccta

SEQ ID NO: 13869 - DNA, 218 bp, Homo sapiens; identical to SEQ ID NO: 4832
  misc_feature 1..218: note = chr20:54578507-54578725
  misc_feature 1..218: note = hyper
  source 1..218: mol_type = genomic DNA

SEQ ID NO: 13870 - DNA, 405 bp, Homo sapiens
  misc_feature 1..405: note = chr20:54580117-54580522
  misc_feature 1..405: note = hyper
  source 1..405: mol_type = genomic DNA
aaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 13871 - DNA, 42 bp, Homo sapiens
  misc_feature 1..42: note = chr20:54580621-54580663
  misc_feature 1..42: note = hyper
  source 1..42: mol_type = genomic DNA
cgctccgggaagatgagcctcagaagccgcaggggcgcgcct

SEQ ID NO: 13872 - DNA, 65 bp, Homo sapiens
  misc_feature 1..65: note = chr20:54919287-54919352
  misc_feature 1..65: note = hyper
  source 1..65: mol_type = genomic DNA
cgagcgcgcaactctcagcctcggagcgtgctggaaatgctgatgggaaccgtttgaatgaccgg

SEQ ID NO: 13873 - DNA, 413 bp, Homo sapiens; identical to SEQ ID NO: 1487
  misc_feature 1..413: note = chr20:55199898-55200311
  misc_feature 1..413: note = hyper
  source 1..413: mol_type = genomic DNA

SEQ ID NO: 13874 - DNA, 98 bp, Homo sapiens; identical to SEQ ID NO: 1488
  misc_feature 1..98: note = chr20:55200615-55200713
  misc_feature 1..98: note = hyper
  source 1..98: mol_type = genomic DNA

SEQ ID NO: 13875 - DNA, 320 bp, Homo sapiens; identical to SEQ ID NO: 4835
  misc_feature 1..320: note = chr20:55201037-55201357
  misc_feature 1..320: note = hyper
  source 1..320: mol_type = genomic DNA

SEQ ID NO: 13876 - skipped

SEQ ID NO: 13877 - DNA, 305 bp, Homo sapiens; identical to SEQ ID NO: 4837
  misc_feature 1..305: note = chr20:55201764-55202069
  misc_feature 1..305: note = hyper
  source 1..305: mol_type = genomic DNA

SEQ ID NO: 13878 - DNA, 268 bp, Homo sapiens; identical to SEQ ID NO: 4838
  misc_feature 1..268: note = chr20:55202358-55202626
  misc_feature 1..268: note = hyper
  source 1..268: mol_type = genomic DNA

SEQ ID NO: 13879 - DNA, 111 bp, Homo sapiens
  misc_feature 1..111: note = chr20:55202996-55203107
  misc_feature 1..111: note = hyper
  source 1..111: mol_type = genomic DNA
atgctaaagttcaaacgaacccgagaaggaacagcgaggcagtggatgccgccattccgtggatgggagagtcatgtctactgcaggtgcggacaccgtactgataggcat

SEQ ID NO: 13880 - DNA, 254 bp, Homo sapiens
  misc_feature 1..254: note = chr20:55204135-55204389
  misc_feature 1..254: note = hyper
  source 1..254: mol_type = genomic DNA
ggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttcc

SEQ ID NO: 13881 - DNA, 47 bp, Homo sapiens
  misc_feature 1..47: note = chr20:55204938-55204985
  misc_feature 1..47: note = hyper
  source 1..47: mol_type = genomic DNA
ctcggaaaagtgccccgtctgcaaccctcagacgtggcttttacgca

SEQ ID NO: 13882 - DNA, 89 bp, Homo sapiens
  misc_feature 1..89: note = chr20:55206293-55206382
  misc_feature 1..89: note = hyper
  source 1..89: mol_type = genomic DNA
cgggtcccccacctctcctccgccgggcagcacctctacagccccgcgccacccctctcccacactggagtcgccgaatatcagccgcc

SEQ ID NO: 13883 - DNA, 73 bp, Homo sapiens
  misc_feature 1..73: note = chr20:55499791-55499864
  misc_feature 1..73: note = hyper
  source 1..73: mol_type = genomic DNA
aaaggggggggaacccgattagttccaaataagcgtctcttaatcacccttatgaaggcgtaatttgcaaaac

SEQ ID NO: 13884 - DNA, 163 bp, Homo sapiens
  misc_feature 1..163: note = chr20:55500507-55500670
  misc_feature 1..163: note = hyper
  source 1..163: mol_type = genomic DNA
aactgtagggtgcctcgccgactcggagccgcagagactggcggcgggtcaacttggaccactttgcattcacgctttgaataggcggagcgggaggcgtcctttcccgcggccgcctttcagccgagagagtgacagattggaggtcagcggctggcgggac

SEQ ID NO: 13885 - DNA, 50 bp, Homo sapiens
  misc_feature 1..50: note = chr20:55500671-55500721
  misc_feature 1..50: note = hyper
  source 1..50: mol_type = genomic DNA
gaagccctcgccgggcagatggacccgctccgggccgcgccggggacccc

SEQ ID NO: 13886 - DNA, 39 bp, Homo sapiens
  misc_feature 1..39: note = chr20:55501052-55501091
  misc_feature 1..39: note = hyper
  source 1..39: mol_type = genomic DNA
cgtaggagcttgccggtctccgaccgctgctggcctgcg

SEQ ID NO: 13887 - DNA, 754 bp, Homo sapiens; identical to SEQ ID NO: 4839
  misc_feature 1..754: note = chr20:56803371-56804125
  misc_feature 1..754: note = hyper
  source 1..754: mol_type = genomic DNA

SEQ ID NO: 13888 - DNA, 264 bp, Homo sapiens; identical to SEQ ID NO: 1489
  misc_feature 1..264: note = chr20:57224816-57225080
  misc_feature 1..264: note = hyper
  source 1..264: mol_type = genomic DNA

SEQ ID NO: 13889 - DNA, 177 bp, Homo sapiens; identical to SEQ ID NO: 1490
  misc_feature 1..177: note = chr20:57225218-57225395
  misc_feature 1..177: note = hyper
  source 1..177: mol_type = genomic DNA

SEQ ID NO: 13890 - DNA, 109 bp, Homo sapiens
  misc_feature 1..109: note = chr20:57875719-57875828
  misc_feature 1..109: note = hyper
  source 1..109: mol_type = genomic DNA
ggccggagctggagacgcagcgagcgatcggccggcctcgaacccccacagctggagggcgaggccagctgtacccggccccagtgccctttcgcggccacaagcggcc

SEQ ID NO: 13891 - DNA, 60 bp, Homo sapiens
  misc_feature 1..60: note = chr20:58179203-58179263
  misc_feature 1..60: note = hyper
  source 1..60: mol_type = genomic DNA
gaggaagcctcaggtcgctcccctccggtgccggggtgggcgcgtcgggacccactggcc

SEQ ID NO: 13892 - DNA, 190 bp, Homo sapiens
  misc_feature 1..190: note = chr20:58180213-58180403
  misc_feature 1..190: note = hyper
  source 1..190: mol_type = genomic DNA
cgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccggg

SEQ ID NO: 13893 - DNA, 106 bp, Homo sapiens
  misc_feature 1..106: note = chr20:58180470-58180576
  misc_feature 1..106: note = hyper
  source 1..106: mol_type = genomic DNA
cgggtgctgaccggctgggggaagagaggcagacccgtggccgcctccgcccagcgccggttctgggccattccctccctccccactgccgggccccagctccgga

SEQ ID NO: 13894 - DNA, 30 bp, Homo sapiens
  misc_feature 1..30: note = chr20:58508817-58508847
  misc_feature 1..30: note = hyper
  source 1..30: mol_type = genomic DNA
catcccccccacccccgccaacgctcgccg

SEQ ID NO: 13895 - DNA, 16 bp, Homo sapiens
  misc_feature 1..16: note = chr20:59826962-59826978
  misc_feature 1..16: note = hyper
  source 1..16: mol_type = genomic DNA
agtgcacactcccacc

SEQ ID NO: 13896 - DNA, 68 bp, Homo sapiens; identical to SEQ ID NO: 4843
  misc_feature 1..68: note = chr20:59828340-59828408
  misc_feature 1..68: note = hyper
  source 1..68: mol_type = genomic DNA

SEQ ID NO: 13897 - DNA, 147 bp, Homo sapiens
  misc_feature 1..147: note = chr20:59829066-59829213
  misc_feature 1..147: note = hyper
  source 1..147: mol_type = genomic DNA
tcccagaagcttggtcggagggccctgtcgtccaccccatccttccctggccctgtgccatgggctctagacttccccactgagcaggaaaggcgagcgagctccggaggacaggaggagaccccctttccggtcagttaggggagc

SEQ ID NO: 13898 - DNA, 396 bp, Homo sapiens
  misc_feature 1..396: note = chr20:61339658-61340054
  misc_feature 1..396: note = hyper
  source 1..396: mol_type = genomic DNA
cccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagac

SEQ ID NO: 13899 - DNA, 374 bp, Homo sapiens; identical to SEQ ID NO: 4844
  misc_feature 1..374: note = chr20:61340304-61340678
  misc_feature 1..374: note = hyper
  source 1..374: mol_type = genomic DNA

SEQ ID NO: 13900 - DNA, 79 bp, Homo sapiens
  misc_feature 1..79: note = chr20:61447684-61447763
  misc_feature 1..79: note = hyper
  source 1..79: mol_type = genomic DNA
acggttccttcaggccggggatcccggggaggggttcttcccctcggccagggtcatcgttttgcgatctctcctggga

SEQ ID NO: 13901 - DNA, 22 bp, Homo sapiens
  misc_feature 1..22: note = chr20:61560439-61560461
  misc_feature 1..22: note = hyper
  source 1..22: mol_type = genomic DNA
tacttcgtttaaagccggattt

SEQ ID NO: 13902 - DNA, 226 bp, Homo sapiens; identical to SEQ ID NO: 4845
  misc_feature 1..226: note = chr20:61560696-61560922
  misc_feature 1..226: note = hyper
  source 1..226: mol_type = genomic DNA

SEQ ID NO: 13903 - DNA, 332 bp, Homo sapiens
  misc_feature 1..332: note = chr20:61585342-61585674
  misc_feature 1..332: note = hyper
  source 1..332: mol_type = genomic DNA
gggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgag

SEQ ID NO: 13904 - DNA, 368 bp, Homo sapiens
  misc_feature 1..368: note = chr20:61637281-61637649
  misc_feature 1..368: note = hyper
  source 1..368: mol_type = genomic DNA
cgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcag

SEQ ID NO: 13905 - DNA, 29 bp, Homo sapiens
  misc_feature 1..29: note = chr20:61637928-61637957
  misc_feature 1..29: note = hyper
  source 1..29: mol_type = genomic DNA
ggggaggtcgccgcccgggcccggagtgc

SEQ ID NO: 13906 - DNA, 250 bp, Homo sapiens; identical to SEQ ID NO: 1492
  misc_feature 1..250: note = chr20:61638220-61638470
  misc_feature 1..250: note = hyper
  source 1..250: mol_type = genomic DNA

SEQ ID NO: 13907 - DNA, 118 bp, Homo sapiens; identical to SEQ ID NO: 1493
  misc_feature 1..118: note = chr20:61638534-61638652
  misc_feature 1..118: note = hyper
  source 1..118: mol_type = genomic DNA

SEQ ID NO: 13908 - DNA, 53 bp, Homo sapiens; identical to SEQ ID NO: 1494
  misc_feature 1..53: note = chr20:61703709-61703762
  misc_feature 1..53: note = hyper
  source 1..53: mol_type = genomic DNA

SEQ ID NO: 13909 - DNA, 190 bp, Homo sapiens; identical to SEQ ID NO: 1495
  misc_feature 1..190: note = chr20:61703845-61704035
  misc_feature 1..190: note = hyper
  source 1..190: mol_type = genomic DNA

SEQ ID NO: 13910 - DNA, 180 bp, Homo sapiens
  misc_feature 1..180: note = chr20:61733260-61733440
  misc_feature 1..180: note = hyper
  source 1..180: mol_type = genomic DNA
cctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgtt

SEQ ID NO: 13911 - DNA, 346 bp, Homo sapiens
  misc_feature 1..346: note = chr20:61733715-61734061
  misc_feature 1..346: note = hyper
  source 1..346: mol_type = genomic DNA
gctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcc

SEQ ID NO: 13912 - DNA, 89 bp, Homo sapiens
  misc_feature 1..89: note = chr20:61747845-61747934
  misc_feature 1..89: note = hyper
  source 1..89: mol_type = genomic DNA
agctgcagggagctgcgcggggggagccgcagagctgggcacttgcgaattaagtcccggtgaccggtgactgccgaggctctggcagg

SEQ ID NO: 13913 - DNA, 357 bp, Homo sapiens
  misc_feature 1..357: note = chr20:61806443-61806800
  misc_feature 1..357: note = hyper
  source 1..357: mol_type = genomic DNA
ccacctgacccgtagcgaagttgccggccccgctgcgcgccggcctttgtgcgcaccgaggcggccgccgggaaccgggagcccgagctggcccggcagcgccgccgcccccaccttcgcgccccttttcactcccccactgtccccggagctggcaaataaacaaatccacaaacaaattatccgtgtgctccggagaggcggcggcgtgggcggcggcggagagaaggcgccgggcaaggcgagactaggcccccgcggagcgggggaagcacagaccccagcccgggcccggcagcagtaagttgacttttatgaaacctacgaagctcgcggggccaccgaaaaggtccccac

SEQ ID NO: 13914 - DNA, 133 bp, Homo sapiens
  misc_feature 1..133: note = chr20:61807785-61807918
  misc_feature 1..133: note = hyper
  source 1..133: mol_type = genomic DNA
aagggcgaggaattgcggctgggaagggtcaggttgaagccgcaccaaagggggaggggcgtcctgatggttgaggaccggcggagtcggtgcgggcagaaccaacccgagttcctgccgcccttcctaaccg

SEQ ID NO: 13915 - DNA, 200 bp, Homo sapiens; identical to SEQ ID NO: 1496
  misc_feature 1..200: note = chr20:61808181-61808381
  misc_feature 1..200: note = hyper
  source 1..200: mol_type = genomic DNA

SEQ ID NO: 13916 - DNA, 222 bp, Homo sapiens; identical to SEQ ID NO: 1497
  misc_feature 1..222: note = chr20:61808666-61808888
  misc_feature 1..222: note = hyper
  source 1..222: mol_type = genomic DNA

SEQ ID NO: 13917 - DNA, 117 bp, Homo sapiens; identical to SEQ ID NO: 1498
  misc_feature 1..117: note = chr20:61808889-61809006
  misc_feature 1..117: note = hyper
  source 1..117: mol_type = genomic DNA

SEQ ID NO: 13918 - DNA, 339 bp, Homo sapiens; identical to SEQ ID NO: 1499
  misc_feature 1..339: note = chr20:61809218-61809557
  misc_feature 1..339: note = hyper
  source 1..339: mol_type = genomic DNA

SEQ ID NO: 13919 - DNA, 74 bp, Homo sapiens; identical to SEQ ID NO: 1500
  misc_feature 1..74: note = chr20:61809558-61809632
  misc_feature 1..74: note = hyper
  source 1..74: mol_type = genomic DNA

SEQ ID NO: 13920 - DNA, 295 bp, Homo sapiens; identical to SEQ ID NO: 1501
  misc_feature 1..295: note = chr20:61809840-61810135
  misc_feature 1..295: note = hyper
  source 1..295: mol_type = genomic DNA

SEQ ID NO: 13921 - DNA, 79 bp, Homo sapiens
  misc_feature 1..79: note = chr20:61862380-61862459
  misc_feature 1..79: note = hyper
  source 1..79: mol_type = genomic DNA
cccctgatggcctctcgacgtccagccgcttgtgtgttctgccaatgggctcctctccgtgtccagggcttaggtgcct

SEQ ID NO: 13922 - DNA, 265 bp, Homo sapiens; identical to SEQ ID NO: 4857
  misc_feature 1..265: note = chr20:61884691-61884956
  misc_feature 1..265: note = hyper
  source 1..265: mol_type = genomic DNA

SEQ ID NO: 13923 - DNA, 113 bp, Homo sapiens
  misc_feature 1..113: note = chr20:61886030-61886143
  misc_feature 1..113: note = hyper
  source 1..113: mol_type = genomic DNA
ccgttcttaaaggggcgatggcgcggcctctcgggtagcgaggggcggcgccgcggccccaggacagacctgcagctgaggggagcccgccctggacgcggcagggatgaccg

SEQ ID NO: 13924 - DNA, 49 bp, Homo sapiens
  misc_feature 1..49: note = chr20:62103577-62103626
  misc_feature 1..49: note = hyper
  source 1..49: mol_type = genomic DNA
aaattctgcagcttgcggtagaaggcgttgcgcttggggggcttcccgg

SEQ ID NO: 13925 - DNA, 91 bp, Homo sapiens
  misc_feature 1..91: note = chr20:62103667-62103758
  misc_feature 1..91: note = hyper
  source 1..91: mol_type = genomic DNA
cgcttgggggcctcggagccggcgatcagcagcgccccgtcccgggtggagtcgggcgcgccggggtccagccccacgaagcccaccttca

SEQ ID NO: 13926 - DNA, 88 bp, Homo sapiens
  misc_feature 1..88: note = chr20:62119922-62120010
  misc_feature 1..88: note = hyper
  source 1..88: mol_type = genomic DNA
ggcctcgcgggagtcctgcctgggcggctgctccacggtctgcggggcggccacggggcgggggcagccctaacgctgccactgggcg

SEQ ID NO: 13927 - DNA, 276 bp, Homo sapiens
  misc_feature 1..276: note = chr20:62461349-62461625
  misc_feature 1..276: note = hyper
  source 1..276: mol_type = genomic DNA
tcacaatcttgccaccgtaatccactccaaatgcatcgttgagattgcagcacggaaagcgagagaggaaattcgctgcgaatctcaaactttcttttgtttatatttcttcgctgtcagaaaatatccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattcccc

SEQ ID NO: 13928 - DNA, 101 bp, Homo sapiens
  misc_feature 1..101: note = chr20:62947884-62947985
  misc_feature 1..101: note = hyper
  source 1..101: mol_type = genomic DNA
ctcgggccgggaacgcgggaggaggcggcgccctgcgccgggaggccccagacaccgtgggcgggcggctgtgcgcggccaggctgcgtgggagcgggcag

SEQ ID NO: 13929 - DNA, 157 bp, Homo sapiens
  misc_feature 1..157: note = chr20:62948007-62948164
  misc_feature 1..157: note = hyper
  source 1..157: mol_type = genomic DNA
cgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcct

SEQ ID NO: 13930 - DNA, 215 bp, Homo sapiens
  misc_feature 1..215: note = chr21:15588524-15588739
  misc_feature 1..215: note = hyper
  source 1..215: mol_type = genomic DNA
ggaggccgacaggaccgtgtttgttgggaatttagaggcccgagttcgggaagagattctgtacgagctgttccttcaggtaccgtctctgggaaggggcggcggaggggcggagcacgtcgggccggaaacatagcgcgcacctggaccacccggagcccggcccccttccgtcccatcctgagcaggggttttaatttcgtttcctcttggcg

SEQ ID NO: 13931 - DNA, 36 bp, Homo sapiens
  misc_feature 1..36: note = chr21:22370664-22370700
  misc_feature 1..36: note = hyper
  source 1..36: mol_type = genomic DNA
ttctgccgccgctgccgccgccgctgcctggatata

SEQ ID NO: 13932 - DNA, 154 bp, Homo sapiens
  misc_feature 1..154: note = chr21:26934572-26934726
  misc_feature 1..154: note = hyper
  source 1..154: mol_type = genomic DNA
cgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcg

SEQ ID NO: 13933 - DNA, 362 bp, Homo sapiens; identical to SEQ ID NO: 4858
  misc_feature 1..362: note = chr21:27012346-27012708
  misc_feature 1..362: note = hyper
  source 1..362: mol_type = genomic DNA

SEQ ID NO: 13934 - DNA, 235 bp, Homo sapiens
  misc_feature 1..235: note = chr21:27944913-27945148
  misc_feature 1..235: note = hyper
  source 1..235: mol_type = genomic DNA
caaatcccctaaacacgagactgctatttccaaggtggaaagggaaagaaaagaaatgcaaaaggtaaaagttaaaggaaaaggaacaaaacaaaaccgcgtgcggctggaagtgcgcgggtttctgccgtcgcctcgcggaaaaggcagaagcgtctgcaaaggtccttctgcaaaggtcccggtccgtccagctcaacccacgttagcccggaccgtgacccaagggcagccc

SEQ ID NO: 13935 - DNA, 64 bp, Homo sapiens
  misc_feature 1..64: note = chr21:28216633-28216697
  misc_feature 1..64: note = hyper
  source 1..64: mol_type = genomic DNA
cggtctccgctttcccagtcggccggggctcgtcgtccacgaccccgcacgtgccgccgacgtc

SEQ ID NO: 13936 - DNA, 82 bp, Homo sapiens
  misc_feature 1..82: note = chr21:28216984-28217066
  misc_feature 1..82: note = hyper
  source 1..82: mol_type = genomic DNA
ccaaaaagctgctgtcgggccgcagctccagatccagctgctggtcaaaggcgtgcaggcggaggcgcgtggtcccgtgtcc

SEQ ID NO: 13937 - DNA, 70 bp, Homo sapiens
  misc_feature 1..70: note = chr21:28217614-28217684
  misc_feature 1..70: note = hyper
  source 1..70: mol_type = genomic DNA
cctccgccttggctgcgatgttgctcactctgctcagggctctcccctctccgtccggtagcgcaccctg

SEQ ID NO: 13938 - DNA, 81 bp, Homo sapiens
  misc_feature 1..81: note = chr21:28218267-28218348
  misc_feature 1..81: note = hyper
  source 1..81: mol_type = genomic DNA
caggagctccttagccgccgcctgctctctcttcgccccagcttttctagggaaagcttggccctgcgcttcccccagaaa

SEQ ID NO: 13939 - DNA, 30 bp, Homo sapiens
  misc_feature 1..30: note = chr21:28218688-28218718
  misc_feature 1..30: note = hyper
  source 1..30: mol_type = genomic DNA
gctggggctagcaagcgtgcagagggggaa

SEQ ID NO: 13940 - DNA, 30 bp, Homo sapiens
  misc_feature 1..30: note = chr21:28339426-28339456
  misc_feature 1..30: note = hyper
  source 1..30: mol_type = genomic DNA
acaatgaatttatagcggcatgccatcctg

SEQ ID NO: 13941 - DNA, 15 bp, Homo sapiens
  misc_feature 1..15: note = chr21:28340034-28340049
  misc_feature 1..15: note = hyper
  source 1..15: mol_type = genomic DNA
ctcttgatgctttga

SEQ ID NO: 13942 - DNA, 286 bp, Homo sapiens; identical to SEQ ID NO: 4860
  misc_feature 1..286: note = chr21:28340062-28340348
  misc_feature 1..286: note = hyper
  source 1..286: mol_type = genomic DNA

SEQ ID NO: 13943 - DNA, 221 bp, Homo sapiens; identical to SEQ ID NO: 4861
  misc_feature 1..221: note = chr21:31311413-31311634
  misc_feature 1..221: note = hyper
  source 1..221: mol_type = genomic DNA

SEQ ID NO: 13944 - DNA, 102 bp, Homo sapiens; identical to SEQ ID NO: 4862
  misc_feature 1..102: note = chr21:31312079-31312181
  misc_feature 1..102: note = hyper
  source 1..102: mol_type = genomic DNA

SEQ ID NO: 13945 - DNA, 207 bp, Homo sapiens
  misc_feature 1..207: note = chr21:32716260-32716467
  misc_feature 1..207: note = hyper
  source 1..207: mol_type = genomic DNA
ggcgcagcttggagacgcgcttgctcgttctgggaaggggcacgggacgcacggttccccggccccagctgcacagctcagctcggggctctcacctatcctcgttcagagccacattcggctgcctcccctgaccacccgacacaaagagattcgccggtggaaagaatcgatttcaaaattcaagctcaccgctgctcaacaagg

SEQ ID NO: 13946 - DNA, 638 bp, Homo sapiens; identical to SEQ ID NO: 1502
  misc_feature 1..638: note = chr21:34392436-34393074
  misc_feature 1..638: note = hyper
  source 1..638: mol_type = genomic DNA

SEQ ID NO: 13947 - DNA, 337 bp, Homo sapiens; identical to SEQ ID NO: 4864
  misc_feature 1..337: note = chr21:34395421-34395758
  misc_feature 1..337: note = hyper
  source 1..337: mol_type = genomic DNA

SEQ ID NO: 13948 - DNA, 696 bp, Homo sapiens; identical to SEQ ID NO: 1503
  misc_feature 1..696: note = chr21:34396045-34396741
  misc_feature 1..696: note = hyper
  source 1..696: mol_type = genomic DNA

SEQ ID NO: 13949 - DNA, 33 bp, Homo sapiens
  misc_feature 1..33: note = chr21:34397670-34397703
  misc_feature 1..33: note = hyper
  source 1..33: mol_type = genomic DNA
tgagatgggaacaggcggcgggaaaccagacag

SEQ ID NO: 13950 - DNA, 141 bp, Homo sapiens
  misc_feature 1..141: note = chr21:34397990-34398131
  misc_feature 1..141: note = hyper
  source 1..141: mol_type = genomic DNA
tccccaagaatctcccggccacgggcgcccattggttgtgcgcagggaggaggcgtgtgcccggcctggcgagtttcattgagcggaattagcccggatgacatcagcttcccagccccccggcgggcccagctcattggc

SEQ ID NO: 13951 - DNA, 67 bp, Homo sapiens
  misc_feature 1..67: note = chr21:34398132-34398199
  misc_feature 1..67: note = hyper
  source 1..67: mol_type = genomic DNA
aggcagcccctccaggacacgcacattgttccccgcccccgcccccgccaccgctgccgccgtcgcc

SEQ ID NO: 13952 - DNA, 22 bp, Homo sapiens
  misc_feature 1..22: note = chr21:34398200-34398222
  misc_feature 1..22: note = hyper
  source 1..22: mol_type = genomic DNA
ctgccaccgggctataaaaacc

SEQ ID NO: 13953 - DNA, 237 bp, Homo sapiens
  misc_feature 1..237: note = chr21:34398223-34398460
  misc_feature 1..237: note = hyper
  source 1..237: mol_type = genomic DNA
gccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctcca

SEQ ID NO: 13954 - DNA, 93 bp, Homo sapiens; identical to SEQ ID NO: 1504
  misc_feature 1..93: note = chr21:34399166-34399259
  misc_feature 1..93: note = hyper
  source 1..93: mol_type = genomic DNA

SEQ ID NO: 13955 - DNA, 664 bp, Homo sapiens; identical to SEQ ID NO: 1505
  misc_feature 1..664: note = chr21:34399441-34400105
  misc_feature 1..664: note = hyper
  source 1..664: mol_type = genomic DNA

SEQ ID NO: 13956 - DNA, 27 bp, Homo sapiens
  misc_feature 1..27: note = chr21:34400231-34400258
  misc_feature 1..27: note = hyper
  source 1..27: mol_type = genomic DNA
cgcgaggaggggcgcaggaccatggac

SEQ ID NO: 13957 - DNA, 225 bp, Homo sapiens; identical to SEQ ID NO: 4869
  misc_feature 1..225: note = chr21:34401167-34401392
  misc_feature 1..225: note = hyper
  source 1..225: mol_type = genomic DNA

SEQ ID NO: 13958 - DNA, 58 bp, Homo sapiens
  misc_feature 1..58: note = chr21:34442191-34442249
  misc_feature 1..58: note = hyper
  source 1..58: mol_type = genomic DNA
ctccttcaacagccccgcttgccttgaaaaggcgcccttactccgctcagggggcctg

SEQ ID NO: 13959 - DNA, 998 bp, Homo sapiens
  misc_feature 1..998: note = chr21:34442594-34443592
  misc_feature 1..998: note = hyper
  source 1..998: mol_type = genomic DNA
gggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttgggg

SEQ ID NO: 13960 - DNA, 382 bp, Homo sapiens; identical to SEQ ID NO: 1507
  misc_feature 1..382: note = chr21:34443981-34444363
  misc_feature 1..382: note = hyper
  source 1..382: mol_type = genomic DNA

SEQ ID NO: 13961 - DNA, 154 bp, Homo sapiens; identical to SEQ ID NO: 1508
  misc_feature 1..154: note = chr21:34444444-34444598
  misc_feature 1..154: note = hyper
  source 1..154: mol_type = genomic DNA

SEQ ID NO: 13962 - DNA, 96 bp, Homo sapiens; identical to SEQ ID NO: 1509
  misc_feature 1..96: note = chr21:36041933-36042029
  misc_feature 1..96: note = hyper
  source 1..96: mol_type = genomic DNA

SEQ ID NO: 13963 - DNA, 79 bp, Homo sapiens; identical to SEQ ID NO: 1510
  misc_feature 1..79: note = chr21:36042091-36042170
  misc_feature 1..79: note = hyper
  source 1..79: mol_type = genomic DNA

SEQ ID NO: 13964 - DNA, 144 bp, Homo sapiens; identical to SEQ ID NO: 1511
  misc_feature 1..144: note = chr21:36042171-36042315
  misc_feature 1..144: note = hyper
  source 1..144: mol_type = genomic DNA

SEQ ID NO: 13965 - DNA, 522 bp, Homo sapiens; identical to SEQ ID NO: 4875
  misc_feature 1..522: note = chr21:36042632-36043154
  misc_feature 1..522: note = hyper
  source 1..522: mol_type = genomic DNA

SEQ ID NO: 13966 - DNA, 519 bp, Homo sapiens; identical to SEQ ID NO: 4876
  misc_feature 1..519: note = chr21:38065004-38065523
  misc_feature 1..519: note = hyper
  source 1..519: mol_type = genomic DNA

SEQ ID NO: 13967 - DNA, 262 bp, Homo sapiens; identical to SEQ ID NO: 4877
  misc_feature 1..262: note = chr21:38065799-38066061
  misc_feature 1..262: note = hyper
  source 1..262: mol_type = genomic DNA

SEQ ID NO: 13968 - DNA, 30 bp, Homo sapiens
  misc_feature 1..30: note = chr21:38066830-38066860
  misc_feature 1..30: note = hyper
  source 1..30: mol_type = genomic DNA
gaggtcgtcgctggacgctgggctcccttg

SEQ ID NO: 13969 - DNA, 375 bp, Homo sapiens
  misc_feature 1..375: note = chr21:38069173-38069548
  misc_feature 1..375: note = hyper
  source 1..375: mol_type = genomic DNA
cagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggcc

SEQ ID NO: 13970 - DNA, 27 bp, Homo sapiens
  misc_feature 1..27: note = chr21:38069853-38069880
  misc_feature 1..27: note = hyper
  source 1..27: mol_type = genomic DNA
cgatgtggactccgcaaggggctaggg

SEQ ID NO: 13971 - DNA, 134 bp, Homo sapiens
  misc_feature 1..134: note = chr21:38070581-38070715
  misc_feature 1..134: note = hyper
  source 1..134: mol_type = genomic DNA
cacctgcgccacctgcgcccaccctgtgaccctggctcagcgaccttggcccttaatcgcccaacgccgattcctcaaaattccggctgcgctgaatcgggctgcttttgccgccgccccggcagttgggccct

SEQ ID NO: 13972 - DNA, 71 bp, Homo sapiens
  misc_feature 1..71: note = chr21:38072282-38072353
  misc_feature 1..71: note = hyper
  source 1..71: mol_type = genomic DNA
aagcgcaagccagcccgcccagaggggttgccgcggcctggcgtccagagctggggcgtctgagggaggtt

SEQ ID NO: 13973 - DNA, 243 bp, Homo sapiens
  misc_feature 1..243: note = chr21:38072927-38073170
  misc_feature 1..243: note = hyper
  source 1..243: mol_type = genomic DNA
agtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccagggg

SEQ ID NO: 13974 - DNA, 112 bp, Homo sapiens
  misc_feature 1..112: note = chr21:38073239-38073351
  misc_feature 1..112: note = hyper
  source 1..112: mol_type = genomic DNA
cgcccacgccggttgccgctggtgacagtggctgcccggccaggcacctccgagcagcaggtctgagcgtttttggcgtcccaagcgttccgggccgcgtcttccagagcct

SEQ ID NO: 13975 - DNA, 35 bp, Homo sapiens
  misc_feature 1..35: note = chr21:38076386-38076421
  misc_feature 1..35: note = hyper
  source 1..35: mol_type = genomic DNA
tgtcatttgcccacacgaaacgaggtggggttcaa

SEQ ID NO: 13976 - DNA, 131 bp, Homo sapiens; identical to SEQ ID NO: 4878
  misc_feature 1..131: note = chr21:38079932-38080063
  misc_feature 1..131: note = hyper
  source 1..131: mol_type = genomic DNA

SEQ ID NO: 13977 - DNA, 213 bp, Homo sapiens; identical to SEQ ID NO: 4879
  misc_feature 1..213: note = chr21:38080174-38080387
  misc_feature 1..213: note = hyper
  source 1..213: mol_type = genomic DNA

SEQ ID NO: 13978 - DNA, 134 bp, Homo sapiens; identical to SEQ ID NO: 4880
  misc_feature 1..134: note = chr21:38080550-38080684
  misc_feature 1..134: note = hyper
  source 1..134: mol_type = genomic DNA

SEQ ID NO: 13979 - DNA, 181 bp, Homo sapiens
  misc_feature 1..181: note = chr21:38081665-38081846
  misc_feature 1..181: note = hyper
  source 1..181: mol_type = genomic DNA
gggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctt

SEQ ID NO: 13980 - DNA, 45 bp, Homo sapiens
  misc_feature 1..45: note = chr21:38082684-38082729
  misc_feature 1..45: note = hyper
  source 1..45: mol_type = genomic DNA
cgggtcggccgggtagccctgagcacagctcgccacttccaggtg

SEQ ID NO: 13981 - DNA, 39 bp, Homo sapiens
  misc_feature 1..39: note = chr21:38082930-38082969
  misc_feature 1..39: note = hyper
  source 1..39: mol_type = genomic DNA
catgacttaggtcagcgagtcagccgctagctctgcatt

SEQ ID NO: 13982 - DNA, 581 bp, Homo sapiens
  misc_feature 1..581: note = chr21:38119754-38120335
  misc_feature 1..581: note = hyper
  source 1..581: mol_type = genomic DNA
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcc

SEQ ID NO: 13983 - DNA, 30 bp, Homo sapiens
  misc_feature 1..30: note = chr21:38593435-38593465
  misc_feature 1..30: note = hyper
  source 1..30: mol_type = genomic DNA
cgcgcgaggcccgggcgcccgagcggcgat

SEQ ID NO: 13984 - DNA, 160 bp, Homo sapiens; identical to SEQ ID NO: 4881
  misc_feature 1..160: note = chr21:39286695-39286855
  misc_feature 1..160: note = hyper
  source 1..160: mol_type = genomic DNA

SEQ ID NO: 13985 - DNA, 37 bp, Homo sapiens
  misc_feature 1..37: note = chr21:39288011-39288048
  misc_feature 1..37: note = hyper
  source 1..37: mol_type = genomic DNA
aaccggcttctccctcgcctttcggctgacttgggca

SEQ ID NO: 13986 - DNA, 30 bp, Homo sapiens
  misc_feature 1..30: note = chr21:39288362-39288392
  misc_feature 1..30: note = hyper
  source 1..30: mol_type = genomic DNA
agactccattctgctcgcggctgctccggc

SEQ ID NO: 13987 - DNA, 32 bp, Homo sapiens
  misc_feature 1..32: note = chr21:40032174-40032206
  misc_feature 1..32: note = hyper
  source 1..32: mol_type = genomic DNA
cccagatgaagtccccgcggtgtgctctcctg

SEQ ID NO: 13988 - DNA, 73 bp, Homo sapiens
  misc_feature 1..73: note = chr21:40033138-40033211
  misc_feature 1..73: note = hyper
  source 1..73: mol_type = genomic DNA
ctcctaactcggggtcgcttttagcgagaagtgatatttttccagcctcattgaaaaccgttgcaaacattga

SEQ ID NO: 13989 - DNA, 241 bp, Homo sapiens
  misc_feature 1..241: note = chr21:42688845-42689086
  misc_feature 1..241: note = hyper
  source 1..241: mol_type = genomic DNA
gggcgagggtaggggcggggaaggaggaccccaggggaagcgtcgctccccaaccctgcctgggacccgccacgcttagcaaaagcgggagggctggttcttggcgccgaggctggtcttagacctgggatcaggaatgcgggaagcgattccagagggggcgaacagcgggggtttccagcagggttccccgaccctgtttccccgcgctcgccaggcctgttcccgccgccccagccgg

SEQ ID NO: 13990 - DNA, 56 bp, Homo sapiens
  misc_feature 1..56: note = chr21:42878736-42878792
  misc_feature 1..56: note = hyper
  source 1..56: mol_type = genomic DNA
taattttccatgattcgggaggttctcgcggctgggagctccgtgaggtcaggcat

SEQ ID NO: 13991 - DNA, 38 bp, Homo sapiens; identical to SEQ ID NO: 1512
  misc_feature 1..38: note = chr21:44494740-44494778
  misc_feature 1..38: note = hyper
  source 1..38: mol_type = genomic DNA

SEQ ID NO: 13992 - DNA, 57 bp, Homo sapiens; identical to SEQ ID NO: 1513
  misc_feature 1..57: note = chr21:44494940-44494997
  misc_feature 1..57: note = hyper
  source 1..57: mol_type = genomic DNA

SEQ ID NO: 13993 - DNA, 122 bp, Homo sapiens; identical to SEQ ID NO: 1514
  misc_feature 1..122: note = chr21:44494998-44495120
  misc_feature 1..122: note = hyper
  source 1..122: mol_type = genomic DNA

SEQ ID NO: 13994 - DNA, 282 bp, Homo sapiens
  misc_feature 1..282: note = chr21:44495327-44495609
  misc_feature 1..282: note = hyper
  source 1..282: mol_type = genomic DNA
cctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacg

SEQ ID NO: 13995 - DNA, 218 bp, Homo sapiens
  misc_feature 1..218: note = chr21:44496505-44496723
  misc_feature 1..218: note = hyper
  source 1..218: mol_type = genomic DNA
gcgggactcgatggccgcgctctgtggccgccggacgccgtgcgcagcgccccgcgtgaccgcgcccagagccgggtccgaaccccgagccgaggcgcagaacagtcgccttgcgcggctccggtgcggcccacggccaggggctgccgggcgctctcggggacggggccgactccgcgcagggtggtagcaggggcgccccgcggggctccttcgcc

SEQ ID NO: 13996 - DNA, 63 bp, Homo sapiens
  misc_feature 1..63: note = chr21:44847543-44847606
  misc_feature 1..63: note = hyper
  source 1..63: mol_type = genomic DNA
cgcgcgtggggctggcggcgcggatgccctggggcgctgcagaccccgagaggccgcttgccc

SEQ ID NO: 13997 - DNA, 167 bp, Homo sapiens
  misc_feature 1..167: note = chr21:44847607-44847774
  misc_feature 1..167: note = hyper
  source 1..167: mol_type = genomic DNA
cggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgc

SEQ ID NO: 13998 - DNA, 305 bp, Homo sapiens
  misc_feature 1..305: note = chr21:45148390-45148695
  misc_feature 1..305: note = hyper
  source 1..305: mol_type = genomic DNA
ttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcg

SEQ ID NO: 13999 - DNA, 64 bp, Homo sapiens
  misc_feature 1..64: note = chr21:45148943-45149007
  misc_feature 1..64: note = hyper
  source 1..64: mol_type = genomic DNA
caccccgcacccgcccgcccgcaatcctgccccctggctgcggcctccgcggctcttcccaccc

SEQ ID NO: 14000 - DNA, 51 bp, Homo sapiens
  misc_feature 1..51: note = chr21:45875681-45875732
  misc_feature 1..51: note = hyper
  source 1..51: mol_type = genomic DNA
cgagcctctcccggccggctccgcgcgcggccccgccgtccacgcccagcg

SEQ ID NO: 14001 - DNA, 48 bp, Homo sapiens; identical to SEQ ID NO: 4885
  misc_feature 1..48: note = chr21:46126380-46126428
  misc_feature 1..48: note = hyper
  source 1..48: mol_type = genomic DNA

SEQ ID NO: 14002 - DNA, 132 bp, Homo sapiens; identical to SEQ ID NO: 4886
  misc_feature 1..132: note = chr21:46126566-46126698
  misc_feature 1..132: note = hyper
  source 1..132: mol_type = genomic DNA

SEQ ID NO: 14003 - DNA, 211 bp, Homo sapiens
  misc_feature 1..211: note = chr21:46127234-46127445
  misc_feature 1..211: note = hyper
  source 1..211: mol_type = genomic DNA
gagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatag

SEQ ID NO: 14004 - DNA, 30 bp, Homo sapiens
  misc_feature 1..30: note = chr21:46128279-46128309
  misc_feature 1..30: note = hyper
  source 1..30: mol_type = genomic DNA
cggacttggagacctcgccaaggaccagga

SEQ ID NO: 14005 - DNA, 107 bp, Homo sapiens; identical to SEQ ID NO: 4887
  misc_feature 1..107: note = chr21:46128961-46129068
  misc_feature 1..107: note = hyper
  source 1..107: mol_type = genomic DNA

SEQ ID NO: 14006 - DNA, 37 bp, Homo sapiens
  misc_feature 1..37: note = chr21:46129376-46129413
  misc_feature 1..37: note = hyper
  source 1..37: mol_type = genomic DNA
atgagtcctagaaagcgagagacgagaggggaatgag

SEQ ID NO: 14007 - DNA, 40 bp, Homo sapiens
  misc_feature 1..40: note = chr21:46352791-46352831
  misc_feature 1..40: note = hyper
  source 1..40: mol_type = genomic DNA
gggttcggtgcgggacggcccaggccgccaggacccccaa

SEQ ID NO: 14008 - DNA, 85 bp, Homo sapiens
  misc_feature 1..85: note = chr21:46825637-46825722
  misc_feature 1..85: note = hyper
  source 1..85: mol_type = genomic DNA
cggggaccgaacctccgcggccggcggggtcgtcggtgccgggagggctcggggcggggccgcggggtctcgggagacgcggcct

SEQ ID NO: 14009 - DNA, 73 bp, Homo sapiens; identical to SEQ ID NO: 1515
  misc_feature 1..73: note = chr21:47010408-47010481
  misc_feature 1..73: note = hyper
  source 1..73: mol_type = genomic DNA

SEQ ID NO: 14010 - DNA, 73 bp, Homo sapiens; identical to SEQ ID NO: 4889
  misc_feature 1..73: note = chr21:47062752-47062825
  misc_feature 1..73: note = hyper
  source 1..73: mol_type = genomic DNA

SEQ ID NO: 14011 - DNA, 839 bp, Homo sapiens; identical to SEQ ID NO: 4890
  misc_feature 1..839: note = chr21:47063538-47064377
  misc_feature 1..839: note = hyper
  source 1..839: mol_type = genomic DNA

SEQ ID NO: 14012 - DNA, 250 bp, Homo sapiens
  misc_feature 1..250: note = chr21:47518063-47518313
  misc_feature 1..250: note = hyper
  source 1..250: mol_type = genomic DNA
ggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcg

SEQ ID NO: 14013 - DNA, 38 bp, Homo sapiens
  misc_feature 1..38: note = chr21:47518776-47518814
  misc_feature 1..38: note = hyper
  source 1..38: mol_type = genomic DNA
cccgccctgggactccgccggggcgctggtggaaccgc

SEQ ID NO: 14014 - DNA, 163 bp, Homo sapiens
  misc_feature 1..163: note = chr21:48087336-48087499
  misc_feature 1..163: note = hyper
  source 1..163: mol_type = genomic DNA
cgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctg

SEQ ID NO: 14015 - skipped

SEQ ID NO: 14016 - DNA, 15 bp, Homo sapiens
  misc_feature 1..15: note = chr22:17082988-17083003
  misc_feature 1..15: note = hyper
  source 1..15: mol_type = genomic DNA
cgcagccaccacccc

SEQ ID NO: 14017 - DNA, 30 bp, Homo sapiens
  misc_feature 1..30: note = chr22:17084014-17084044
  misc_feature 1..30: note = hyper
  source 1..30: mol_type = genomic DNA
tgtaaattaagacaccgttttagtgccagc

SEQ ID NO: 14018 - DNA, 167 bp, Homo sapiens; identical to SEQ ID NO: 4891
  misc_feature 1..167: note = chr22:17600967-17601134
  misc_feature 1..167: note = hyper
  source 1..167: mol_type = genomic DNA

SEQ ID NO: 14019 - DNA, 143 bp, Homo sapiens; identical to SEQ ID NO: 4892
  misc_feature 1..143: note = chr22:17601259-17601402
  misc_feature 1..143: note = hyper
  source 1..143: mol_type = genomic DNA

SEQ ID NO: 14020 - DNA, 206 bp, Homo sapiens
  misc_feature 1..206: note = chr22:17849555-17849761
  misc_feature 1..206: note = hyper
  source 1..206: mol_type = genomic DNA
tctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctcc

SEQ ID NO: 14021 - DNA, 303 bp, Homo sapiens; identical to SEQ ID NO: 4893
  misc_feature 1..303: note = chr22:17850318-17850621
  misc_feature 1..303: note = hyper
  source 1..303: mol_type = genomic DNA

SEQ ID NO: 14022 - DNA, 53 bp, Homo sapiens; identical to SEQ ID NO: 4894
  misc_feature 1..53: note = chr22:17850978-17851031
  misc_feature 1..53: note = hyper
  source 1..53: mol_type = genomic DNA

SEQ ID NO: 14023 - DNA, 190 bp, Homo sapiens
  misc_feature 1..190: note = chr22:19016914-19017104
  misc_feature 1..190: note = hyper
  source 1..190: mol_type = genomic DNA
ttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcg

SEQ ID NO: 14024 - DNA, 260 bp, Homo sapiens
  misc_feature 1..260: note = chr22:19017319-19017579
  misc_feature 1..260: note = hyper
  source 1..260: mol_type = genomic DNA
cgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcgga

SEQ ID NO: 14025 - DNA, 15 bp, Homo sapiens
  misc_feature 1..15: note = chr22:19510932-19510947
  misc_feature 1..15: note = hyper
  source 1..15: mol_type = genomic DNA
ggagaaggtcagctg

SEQ ID NO: 14026 - DNA, 315 bp, Homo sapiens; identical to SEQ ID NO: 1517
  misc_feature 1..315: note = chr22:19511141-19511456
  misc_feature 1..315: note = hyper
  source 1..315: mol_type = genomic DNA

SEQ ID NO: 14027 - DNA, 335 bp, Homo sapiens; identical to SEQ ID NO: 1518
  misc_feature 1..335: note = chr22:19511541-19511876
  misc_feature 1..335: note = hyper
  source 1..335: mol_type = genomic DNA

SEQ ID NO: 14028 - DNA, 67 bp, Homo sapiens; identical to SEQ ID NO: 1519
  misc_feature 1..67: note = chr22:19512252-19512319
  misc_feature 1..67: note = hyper
  source 1..67: mol_type = genomic DNA

SEQ ID NO: 14029 - DNA, 15 bp, Homo sapiens
  misc_feature 1..15: note = chr22:19512376-19512391
  misc_feature 1..15: note = hyper
  source 1..15: mol_type = genomic DNA
cgtagaggccctcgt

SEQ ID NO: 14030 - DNA, 127 bp, Homo sapiens; identical to SEQ ID NO: 4900
  misc_feature 1..127: note = chr22:19706238-19706365
  misc_feature 1..127: note = hyper
  source 1..127: mol_type = genomic DNA

SEQ ID NO: 14031 - DNA, 204 bp, Homo sapiens; identical to SEQ ID NO: 4901
  misc_feature 1..204: note = chr22:19706366-19706570
  misc_feature 1..204: note = hyper
  source 1..204: mol_type = genomic DNA

SEQ ID NO: 14032 - DNA, 145 bp, Homo sapiens
  misc_feature 1..145: note = chr22:19742613-19742758
  misc_feature 1..145: note = hyper
  source 1..145: mol_type = genomic DNA
ttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcc

SEQ ID NO: 14033 - DNA, 181 bp, Homo sapiens
  misc_feature 1..181: note = chr22:19742788-19742969
  misc_feature 1..181: note = hyper
  source 1..181: mol_type = genomic DNA
cgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggcca

SEQ ID NO: 14034 - DNA, 156 bp, Homo sapiens
  misc_feature 1..156: note = chr22:19748644-19748800
  misc_feature 1..156: note = hyper
  source 1..156: mol_type = genomic DNA
cgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccgg

SEQ ID NO: 14035 - DNA, 109 bp, Homo sapiens
  misc_feature 1..109: note = chr22:20791235-20791344
  misc_feature 1..109: note = hyper
  source 1..109: mol_type = genomic DNA
tccccacctggttgtcgccagggttcccacatcctccggtcccctgtgcctgtcatagtccttccgcctcccgcttctggtccacttcgagcgccggctcctcgacgct

SEQ ID NO: 14036 - DNA, 30 bp, Homo sapiens
  misc_feature 1..30: note = chr22:20791681-20791711
  misc_feature 1..30: note = hyper
  source 1..30: mol_type = genomic DNA
cctgggatgcactgtcgtggcccatggccg

SEQ ID NO: 14037 - DNA, 30 bp, Homo sapiens
  misc_feature 1..30: note = chr22:21319768-21319798
  misc_feature 1..30: note = hyper
  source 1..30: mol_type = genomic DNA
gcgggggcaacgggacggagccggcgaggc

SEQ ID NO: 14038 - DNA, 166 bp, Homo sapiens; identical to SEQ ID NO: 4902
  misc_feature 1..166: note = chr22:22862697-22862863
  misc_feature 1..166: note = hyper
  source 1..166: mol_type = genomic DNA

SEQ ID NO: 14039 - DNA, 88 bp, Homo sapiens; identical to SEQ ID NO: 4903
  misc_feature 1..88: note = chr22:22863219-22863307
  misc_feature 1..88: note = hyper
  source 1..88: mol_type = genomic DNA

SEQ ID NO: 14040 - DNA, 30 bp, Homo sapiens
  misc_feature 1..30: note = chr22:23908209-23908239
  misc_feature 1..30: note = hyper
  source 1..30: mol_type = genomic DNA
actcacttctcaggacgcctgtcctgctgt

SEQ ID NO: 14041 - DNA, 30 bp, Homo sapiens
  misc_feature 1..30: note = chr22:23908658-23908688
  misc_feature 1..30: note = hyper
  source 1..30: mol_type = genomic DNA
ccgagcgtgcccggccgggtctgcagccgt

SEQ ID NO: 14042 - DNA, 454 bp, Homo sapiens
  misc_feature 1..454: note = chr22:24180540-24180994
  misc_feature 1..454: note = hyper
  source 1..454: mol_type = genomic DNA
tcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 14043 - DNA, 390 bp, Homo sapiens
  misc_feature 1..390: note = chr22:24181054-24181444
  misc_feature 1..390: note = hyper
  source 1..390: mol_type = genomic DNA
cgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtgg

SEQ ID NO: 14044 - DNA, 258 bp, Homo sapiens; identical to SEQ ID NO: 4904
  misc_feature 1..258: note = chr22:25678357-25678615
  misc_feature 1..258: note = hyper
  source 1..258: mol_type = genomic DNA

SEQ ID NO: 14045 - DNA, 253 bp, Homo sapiens; identical to SEQ ID NO: 4905
  misc_feature 1..253: note = chr22:25678616-25678869
  misc_feature 1..253: note = hyper
  source 1..253: mol_type = genomic DNA

SEQ ID NO: 14046 - DNA, 208 bp, Homo sapiens; identical to SEQ ID NO: 4906
  misc_feature 1..208: note = chr22:25679042-25679250
  misc_feature 1..208: note = hyper
  source 1..208: mol_type = genomic DNA

SEQ ID NO: 14047 - DNA, 198 bp, Homo sapiens; identical to SEQ ID NO: 4907
  misc_feature 1..198: note = chr22:25679267-25679465
  misc_feature 1..198: note = hyper
  source 1..198: mol_type = genomic DNA

SEQ ID NO: 14048 - DNA, 738 bp, Homo sapiens
  misc_feature 1..738: note = chr22:25816913-25817651
  misc_feature 1..738: note = hyper
  source 1..738: mol_type = genomic DNA
gccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggcgcggcgggcggcggccgcgggcgcgcgtcccatccgggtcccgagtaaccgccaccgccgctgccaaagctcgccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtctctgaaatggggcatcggagggcgggtggggggcactccgggagagagcgctccaaagtgcctggcgccgcgccctgcgcgcagctagcaccccagcaaggggctggttatgacttggctggaccagttccatccctgtcgccccctcccccagccctgtcctctcctgtcccatccccgtggttctacctgt

SEQ ID NO: 14049 - DNA, 30 bp, Homo sapiens
  misc_feature 1..30: note = chr22:26564863-26564893
  misc_feature 1..30: note = hyper
  source 1..30: mol_type = genomic DNA
ctcgtgttagatgcacgattttgtggctat

SEQ ID NO: 14050 - DNA, 177 bp, Homo sapiens
  misc_feature 1..177: note = chr22:26565184-26565361
  misc_feature 1..177: note = hyper
  source 1..177: mol_type = genomic DNA
agcagggagagaaaacgctcggctcccaggacgcaaggggaattggcgttaaactttgcagggccgacgggccggcggccagaggaggcggctggcacccccggcgccgccgcggcccctccagctcactgcccgctcgcccgccccctccctccctgcactcgctcggcacagact

SEQ ID NO: 14051 - DNA, 131 bp, Homo sapiens
  misc_feature 1..131: note = chr22:26565502-26565633
  misc_feature 1..131: note = hyper
  source 1..131: mol_type = genomic DNA
ggaagctgccccggcccgcggcctcctccctcgctcccgcttcccctttctcgctcaccgccgccctccttccccagctccctcgccgtccgcccgccccacagccagcggctccgcgccccctgcagcca

SEQ ID NO: 14052 - DNA, 36 bp, Homo sapiens
  misc_feature 1..36: note = chr22:26565935-26565971
  misc_feature 1..36: note = hyper
  source 1..36: mol_type = genomic DNA
ggcgcttccctgcttcggctgcgggctccctttcgg

SEQ ID NO: 14053 - DNA, 129 bp, Homo sapiens
  misc_feature 1..129: note = chr22:27053864-27053993
  misc_feature 1..129: note = hyper
  source 1..129: mol_type = genomic DNA
tttaggagtccagtgcgaatggggatcttgcaatcatgattatgagggggaacaaagaccctttccttccgacgacacaagacacaatttgggaggtggacccgcggaccttctcggtccaccaggtta

SEQ ID NO: 14054 - DNA, 33 bp, Homo sapiens
  misc_feature 1..33: note = chr22:28197337-28197370
  misc_feature 1..33: note = hyper
  source 1..33: mol_type = genomic DNA
cttcgcggccacgtccgccgcctgccgcttctg

SEQ ID NO: 14055 - DNA, 91 bp, Homo sapiens
  misc_feature 1..91: note = chr22:28198065-28198156
  misc_feature 1..91: note = hyper
  source 1..91: mol_type = genomic DNA
tggagcgagacccaccgggtgggcagggggcggggaggtgggcggtgagcggtacggggcgctcagacaatgaggtcgccaggcaaagacc

SEQ ID NO: 14056 - DNA, 30 bp, Homo sapiens
  misc_feature 1..30: note = chr22:28198371-28198401
  misc_feature 1..30: note = hyper
  source 1..30: mol_type = genomic DNA
actgcctggggttcccggttctcaccggcc

SEQ ID NO: 14057 - DNA, 239 bp, Homo sapiens
  misc_feature 1..239: note = chr22:28838200-28838439
  misc_feature 1..239: note = hyper
  source 1..239: mol_type = genomic DNA
acacacgctggtgcacgctgacacgcacagacacacgcccgtgcacaatggccagcgcaggcaatcgcacgggcccacgaggcctcaggagccccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggct

SEQ ID NO: 14058 - DNA, 40 bp, Homo sapiens
  misc_feature 1..40: note = chr22:29075517-29075557
  misc_feature 1..40: note = hyper
  source 1..40: mol_type = genomic DNA
caggcgctcctctgccgctgaggcccggcccggctcccac

SEQ ID NO: 14059 - DNA, 53 bp, Homo sapiens
  misc_feature 1..53: note = chr22:29076122-29076175
  misc_feature 1..53: note = hyper
  source 1..53: mol_type = genomic DNA
caagaggaacttccccgcaagaagtgtcgagttaaggacgctactaagggggc

SEQ ID NO: 14060 - DNA, 42 bp, Homo sapiens
  misc_feature 1..42: note = chr22:29426589-29426631
  misc_feature 1..42: note = hyper
  source 1..42: mol_type = genomic DNA
cccggtggggaggggcgcggccggtggcgaggagggcacttt

SEQ ID NO: 14061 - DNA, 30 bp, Homo sapiens
  misc_feature 1..30: note = chr22:29876013-29876043
  misc_feature 1..30: note = hyper
  source 1..30: mol_type = genomic DNA
cctctgacgcagcgtcgattccccttccct

SEQ ID NO: 14062 - DNA, 303 bp, Homo sapiens
  misc_feature 1..303: note = chr22:29876952-29877255
  misc_feature 1..303: note = hyper
  source 1..303: mol_type = genomic DNA
ccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccggactgcgcgtggagtggcgcgctgctcaccttcc

SEQ ID NO: 14063 - DNA, 114 bp, Homo sapiens
  misc_feature 1..114: note = chr22:30116044-30116158
  misc_feature 1..114: note = hyper
  source 1..114: mol_type = genomic DNA
cggtagcggccgcgccggcgagcggactagcgggcggcgagcagcgcggagcgcgcggggcaccgaggagcgggcgcggcgggcaccgcgcgaggcagccggagctctcggaaa

SEQ ID NO: 14064 - DNA, 36 bp, Homo sapiens
  misc_feature 1..36: note = chr22:30116411-30116447
  misc_feature 1..36: note = hyper
  source 1..36: mol_type = genomic DNA
agatgccgttccacccggtgacggcggcgttgatgt

SEQ ID NO: 14065 - DNA, 78 bp, Homo sapiens
  misc_feature 1..78: note = chr22:30116757-30116835
  misc_feature 1..78: note = hyper
  source 1..78: mol_type = genomic DNA
gctgcggaaacttgccgggccccgcagcggggtcacggggccgcgcagtcggcggtgacggtgcggcaacgcggcgga

SEQ ID NO: 14066 - DNA, 174 bp, Homo sapiens
  misc_feature 1..174: note = chr22:30938095-30938269
  misc_feature 1..174: note = hyper
  source 1..174: mol_type = genomic DNA
ccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggag

SEQ ID NO: 14067 - DNA, 39 bp, Homo sapiens
  misc_feature 1..39: note = chr22:30938602-30938641
  misc_feature 1..39: note = hyper
  source 1..39: mol_type = genomic DNA
ctgcctgctgctccccgcgtcctgcgcctggtcaggagt

SEQ ID NO: 14068 - DNA, 373 bp, Homo sapiens
  misc_feature 1..373: note = chr22:31218396-31218769
  misc_feature 1..373: note = hyper
  source 1..373: mol_type = genomic DNA
cgctcaggctgggctcggctcccgcggcgcggacggggttaacgcgctcatgtaccgggtggcgggcggcagtggtgcattgtggtaacgcggcgccgggacccacgagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttg

SEQ ID NO: 14069 - DNA, 624 bp, Homo sapiens
  misc_feature 1..624: note = chr22:31480781-31481405
  misc_feature 1..624: note = hyper
  source 1..624: mol_type = genomic DNA
gggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggac

SEQ ID NO: 14070 - DNA, 30 bp, Homo sapiens
  misc_feature 1..30: note = chr22:32572248-32572278
  misc_feature 1..30: note = hyper
  source 1..30: mol_type = genomic DNA
ggcatctgcagcctccgctctcctgttctg

SEQ ID NO: 14071 - DNA, 37 bp, Homo sapiens
  misc_feature 1..37: note = chr22:33197694-33197731
  misc_feature 1..37: note = hyper
  source 1..37: mol_type = genomic DNA
cgggcagcaggcaggcggcgggcgctcagacggcttc

SEQ ID NO: 14072 - DNA, 198 bp, Homo sapiens; identical to SEQ ID NO: 1521
  misc_feature 1..198: note = chr22:33453877-33454075
  misc_feature 1..198: note = hyper
  source 1..198: mol_type = genomic DNA

SEQ ID NO: 14073 - DNA, 66 bp, Homo sapiens; identical to SEQ ID NO: 1522
  misc_feature 1..66: note = chr22:33454193-33454259
  misc_feature 1..66: note = hyper
  source 1..66: mol_type = genomic DNA

SEQ ID NO: 14074 - DNA, 90 bp, Homo sapiens; identical to SEQ ID NO: 1523
  misc_feature 1..90: note = chr22:33454345-33454435
  misc_feature 1..90: note = hyper
  source 1..90: mol_type = genomic DNA

SEQ ID NO: 14075 - DNA, 30 bp, Homo sapiens
  misc_feature 1..30: note = chr22:35420285-35420315
  misc_feature 1..30: note = hyper
  source 1..30: mol_type = genomic DNA
tggaaatgaatttagcgtcagcacagttat

SEQ ID NO: 14076 - DNA, 30 bp, Homo sapiens
  misc_feature 1..30: note = chr22:36553195-36553225
  misc_feature 1..30: note = hyper
  source 1..30: mol_type = genomic DNA
atttctaaaaacacgcgagccagctaacct

SEQ ID NO: 14077 - DNA, 52 bp, Homo sapiens
  misc_feature 1..52: note = chr22:37730735-37730787
  misc_feature 1..52: note = hyper
  source 1..52: mol_type = genomic DNA
catctggaaagggggcgcgggcggggatcggtaggaccgcctatgctcaggg

SEQ ID NO: 14078 - DNA, 69 bp, Homo sapiens
  misc_feature 1..69: note = chr22:37731155-37731224
  misc_feature 1..69: note = hyper
  source 1..69: mol_type = genomic DNA
ggatagggtagtatacgatagggggcgtaaagaagggtcatgggctccggtggtcgcaggtcccaccgg

SEQ ID NO: 14079 - DNA, 324 bp, Homo sapiens; identical to SEQ ID NO: 4911
  misc_feature 1..324: note = chr22:38220648-38220972
  misc_feature 1..324: note = hyper
  source 1..324: mol_type = genomic DNA

SEQ ID NO: 14080 - DNA, 60 bp, Homo sapiens
  misc_feature 1..60: note = chr22:38221288-38221348
  misc_feature 1..60: note = hyper
  source 1..60: mol_type = genomic DNA
ccgtgcggccgccgacgccgccaccgtgcccgccgcgccttgcgtcgcgtccgccccgcg

SEQ ID NO: 14081 - DNA, 33 bp, Homo sapiens; identical to SEQ ID NO: 4912
  misc_feature 1..33: note = chr22:38477099-38477132
  misc_feature 1..33: note = hyper
  source 1..33: mol_type = genomic DNA

SEQ ID NO: 14082 - DNA, 498 bp, Homo sapiens; identical to SEQ ID NO: 4913
  misc_feature 1..498: note = chr22:38477296-38477794
  misc_feature 1..498: note = hyper
  source 1..498: mol_type = genomic DNA

SEQ ID NO: 14083 - DNA, 30 bp, Homo sapiens
  misc_feature 1..30: note = chr22:38478441-38478471
  misc_feature 1..30: note = hyper
  source 1..30: mol_type = genomic DNA
ggggccctctgagctcgcagggcagccccc

SEQ ID NO: 14084 - DNA, 78 bp, Homo sapiens
  misc_feature 1..78: note = chr22:39853473-39853551
  misc_feature 1..78: note = hyper
  source 1..78: mol_type = genomic DNA
acgccagcatctccccgccggggaccccgggggccgcggagccgccgccgccgctgctgccgccgttgctgagaccca

SEQ ID NO: 14085 - DNA, 30 bp, Homo sapiens
  misc_feature 1..30: note = chr22:39854232-39854262
  misc_feature 1..30: note = hyper
  source 1..30: mol_type = genomic DNA
gtggggaggggagtgcgcctgggtgtgtgt

SEQ ID NO: 14086 - DNA, 30 bp, Homo sapiens
  misc_feature 1..30: note = chr22:39942115-39942145
  misc_feature 1..30: note = hyper
  source 1..30: mol_type = genomic DNA
gggtgctgatgatgtcggaggagctccttg

SEQ ID NO: 14087 - DNA, 137 bp, Homo sapiens
  misc_feature 1..137: note = chr22:39954439-39954576
  misc_feature 1..137: note = hyper
  source 1..137: mol_type = genomic DNA
gccagagctggtgcccgtgtccggcgggctgagctgggagcgctggcctgggagcgcggcagcgggggccactggatgggggaatcccgggcagggtttaactttcccggaggcgggggtggcggagaccccccctt

SEQ ID NO: 14088 - DNA, 109 bp, Homo sapiens
  misc_feature 1..109: note = chr22:40081839-40081948
  misc_feature 1..109: note = hyper
  source 1..109: mol_type = genomic DNA
cagcctgaccctgagcgacagcccccggcgtgccctggggccgcccgcgcctgctccaggaccccgggccggcctgtcccccgccgctcgccgccgcctgagcctgcgc

SEQ ID NO: 14089 - DNA, 105 bp, Homo sapiens
  misc_feature 1..105: note = chr22:42307095-42307200
  misc_feature 1..105: note = hyper
  source 1..105: mol_type = genomic DNA
cgcagaggccgcggctcatttccaccggggaagcctctatgccccagccgagggaccgcctctcggcctctcacgcccctccgcgtgctccgccgccgctcagcc

SEQ ID NO: 14090 - DNA, 409 bp, Homo sapiens; identical to SEQ ID NO: 4914
  misc_feature 1..409: note = chr22:42310042-42310451
  misc_feature 1..409: note = hyper
  source 1..409: mol_type = genomic DNA

SEQ ID NO: 14091 - DNA, 123 bp, Homo sapiens
  misc_feature 1..123: note = chr22:42311386-42311509
  misc_feature 1..123: note = hyper
  source 1..123: mol_type = genomic DNA
agcccggaattgccccgggacgggcagggccaccctctcacctccttcccgtcccctctgtccgttctgatcataacataaggagggccccttcccctctcggcgcctcgattttcccacctg

SEQ ID NO: 14092 - DNA, 369 bp, Homo sapiens; identical to SEQ ID NO: 4915
  misc_feature 1..369: note = chr22:42353611-42353980
  misc_feature 1..369: note = hyper
  source 1..369: mol_type = genomic DNA

SEQ ID NO: 14093 - DNA, 75 bp, Homo sapiens
  misc_feature 1..75: note = chr22:42679405-42679480
  misc_feature 1..75: note = hyper
  source 1..75: mol_type = genomic DNA
cggctggatctggaccggaggggacgggggcgggcactcggcccctgggactgtgacccggggccctgcccttca

SEQ ID NO: 14094 - DNA, 215 bp, Homo sapiens
  misc_feature 1..215: note = chr22:42679916-42680131
  misc_feature 1..215: note = hyper
  source 1..215: mol_type = genomic DNA
cgaggcgggggaggaggggaaagggaaaaaaggagaaggaaaaggaaaggggggcagtttctcggctctcagcctcctcgcggctcctcctgcccaagccggcaagtgaagtcacagggccggggcggtgacatcagctgagcctctgacatcacggcccctgccgatctcacctctgcagggtggagatggaggagcagcggggaggagggatg

SEQ ID NO: 14095 - DNA, 68 bp, Homo sapiens
  misc_feature 1..68: note = chr22:42896621-42896689
  misc_feature 1..68: note = hyper
  source 1..68: mol_type = genomic DNA
tgctacctaggcaggcgtgagggtgtgacggccgcgcattcgccagacgagagcgatggctgagaacg

SEQ ID NO: 14096 - DNA, 37 bp, Homo sapiens
  misc_feature 1..37: note = chr22:43739465-43739502
  misc_feature 1..37: note = hyper
  source 1..37: mol_type = genomic DNA
ccggccaatgggcgccggcctccggccctccgaggaa

SEQ ID NO: 14097 - DNA, 50 bp, Homo sapiens
  misc_feature 1..50: note = chr22:43740084-43740134
  misc_feature 1..50: note = hyper
  source 1..50: mol_type = genomic DNA
tcggccggcgaagttcgctgcccggaatgcgaggccgaggcctccccctg

SEQ ID NO: 14098 - DNA, 234 bp, Homo sapiens; identical to SEQ ID NO: 4916
  misc_feature 1..234: note = chr22:44258285-44258519
  misc_feature 1..234: note = hyper
  source 1..234: mol_type = genomic DNA

SEQ ID NO: 14099 - DNA, 30 bp, Homo sapiens
  misc_feature 1..30: note = chr22:44263900-44263930
  misc_feature 1..30: note = hyper
  source 1..30: mol_type = genomic DNA
gtccgcggtgctgaacgcacagcttcccct

SEQ ID NO: 14100 - DNA, 46 bp, Homo sapiens
  misc_feature 1..46: note = chr22:44287650-44287696
  misc_feature 1..46: note = hyper
  source 1..46: mol_type = genomic DNA
cgcggggctcgctggcgcaggcattcggtggcgcccacgtggtggg

SEQ ID NO: 14101 - DNA, 139 bp, Homo sapiens
  misc_feature 1..139: note = chr22:44726839-44726978
  misc_feature 1..139: note = hyper
  source 1..139: mol_type = genomic DNA
aggcccctctgggtccgcagcgtggccctcagtccccgtgcagcccgcacggggctcccagctcactgagctccccgactctgttcttggaagccagtcccccccttggacgcggattccggtcccggccgccgcgtcc

SEQ ID NO: 14102 - DNA, 93 bp, Homo sapiens
  misc_feature 1..93: note = chr22:44727446-44727539
  misc_feature 1..93: note = hyper
  source 1..93: mol_type = genomic DNA
tgcgggggctgcccacgcccccgcgatgcccctgccgccgccgcaacagttgtccgggttctgggggctgcggggacgcggggactccgggct

SEQ ID NO: 14103 - DNA, 137 bp, Homo sapiens
  misc_feature 1..137: note = chr22:44727790-44727927
  misc_feature 1..137: note = hyper
  source 1..137: mol_type = genomic DNA
atgctcgccgggccccgcgctcgccgccgccgccgccgccgccgccgctgcccacttcactctttggcgctcgctccgcgccgcgccctctgctgccccctcgcccgggctcgccgagctcccgccgccctgcccgc

SEQ ID NO: 14104 - DNA, 46 bp, Homo sapiens
  misc_feature 1..46: note = chr22:45016369-45016415
  misc_feature 1..46: note = hyper
  source 1..46: mol_type = genomic DNA
tttccgacaaccacacggcgccggctgcacacgtcctgtttgcgtg

SEQ ID NO: 14105 - DNA, 60 bp, Homo sapiens
  misc_feature 1..60: note = chr22:45403086-45403146
  misc_feature 1..60: note = hyper
  source 1..60: mol_type = genomic DNA
tcctttcagcaagcccggccccccccaaaacccgccactcgcgcacgccccctcccatca

SEQ ID NO: 14106 - DNA, 403 bp, Homo sapiens
  misc_feature 1..403: note = chr22:45404239-45404642
  misc_feature 1..403: note = hyper
  source 1..403: mol_type = genomic DNA
ccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcg

SEQ ID NO: 14107 - DNA, 224 bp, Homo sapiens
  misc_feature 1..224: note = chr22:45405046-45405270
  misc_feature 1..224: note = hyper
  source 1..224: mol_type = genomic DNA
cgcactcccctccccgggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagc

SEQ ID NO: 14108 - DNA, 31 bp, Homo sapiens
  misc_feature 1..31: note = chr22:45405596-45405627
  misc_feature 1..31: note = hyper
  source 1..31: mol_type = genomic DNA
gggaagacaggcttccgggcgccgcggcgcc

SEQ ID NO: 14109 - DNA, 68 bp, Homo sapiens
  misc_feature 1..68: note = chr22:45405628-45405696
  misc_feature 1..68: note = hyper
  source 1..68: mol_type = genomic DNA
agccctcggctgccccaactcctcaggctgcccggcaagttgcgccgggtccccgggctgccggcgcg

SEQ ID NO: 14110 - DNA, 289 bp, Homo sapiens
  misc_feature 1..289: note = chr22:45406039-45406328
  misc_feature 1..289: note = hyper
  source 1..289: mol_type = genomic DNA
cggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatattttatttaaattcttccgtcccctcctgtccataccagcgccgcgacttgggggatta

SEQ ID NO: 14111 - DNA, 442 bp, Homo sapiens; identical to SEQ ID NO: 4917
  misc_feature 1..442: note = chr22:46262610-46263052
  misc_feature 1..442: note = hyper
  source 1..442: mol_type = genomic DNA

SEQ ID NO: 14112 - DNA, 17 bp, Homo sapiens
  misc_feature 1..17: note = chr22:46263743-46263760
  misc_feature 1..17: note = hyper
  source 1..17: mol_type = genomic DNA
cgcgcctgtcccctccc

SEQ ID NO: 14113 - DNA, 54 bp, Homo sapiens
  misc_feature 1..54: note = chr22:46658689-46658743
  misc_feature 1..54: note = hyper
  source 1..54: mol_type = genomic DNA
aagccctgctggggccgcgggcctggcgcggcggagcgcggggagacgcgggcc

SEQ ID NO: 14114 - DNA, 309 bp, Homo sapiens; identical to SEQ ID NO: 4918
  misc_feature 1..309: note = chr22:48885529-48885838
  misc_feature 1..309: note = hyper
  source 1..309: mol_type = genomic DNA

SEQ ID NO: 14115 - DNA, 733 bp, Homo sapiens
  misc_feature 1..733: note = chr22:48886204-48886937
  misc_feature 1..733: note = hyper
  source 1..733: mol_type = genomic DNA
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtggg

SEQ ID NO: 14116 - DNA, 148 bp, Homo sapiens; identical to SEQ ID NO: 1524
  misc_feature 1..148: note = chr22:48971532-48971680
  misc_feature 1..148: note = hyper
  source 1..148: mol_type = genomic DNA

SEQ ID NO: 14117 - DNA, 201 bp, Homo sapiens; identical to SEQ ID NO: 1525
  misc_feature 1..201: note = chr22:48971758-48971959
  misc_feature 1..201: note = hyper
  source 1..201: mol_type = genomic DNA

SEQ ID NO: 14118 - DNA, 176 bp, Homo sapiens; identical to SEQ ID NO: 1526
  misc_feature 1..176: note = chr22:48971960-48972136
  misc_feature 1..176: note = hyper
  source 1..176: mol_type = genomic DNA

SEQ ID NO: 14119 - DNA, 45 bp, Homo sapiens
  misc_feature 1..45: note = chr22:48972421-48972466
  misc_feature 1..45: note = hyper
  source 1..45: mol_type = genomic DNA
ctgcccggctcgcggcggctccggcgcccgacccggcttccagca

SEQ ID NO: 14120 - DNA, 37 bp, Homo sapiens
  misc_feature 1..37: note = chr22:50421971-50422008
  misc_feature 1..37: note = hyper
  source 1..37: mol_type = genomic DNA
cgccagggggctccacggaggccgcccctcatccaca

SEQ ID NO: 14121 - DNA, 48 bp, Homo sapiens
  misc_feature 1..48: note = chr22:50453483-50453531
  misc_feature 1..48: note = hyper
  source 1..48: mol_type = genomic DNA
ccgcgcaggtttccacggagacgcgcgtggctccgggtcgtcgtcctg

SEQ ID NO: 14122 - DNA, 212 bp, Homo sapiens; identical to SEQ ID NO: 4922
  misc_feature 1..212: note = chr22:50496971-50497183
  misc_feature 1..212: note = hyper
  source 1..212: mol_type = genomic DNA

SEQ ID NO: 14123 - DNA, 74 bp, Homo sapiens; identical to SEQ ID NO: 4923
  misc_feature 1..74: note = chr22:50497213-50497287
  misc_feature 1..74: note = hyper
  source 1..74: mol_type = genomic DNA

SEQ ID NO: 14124 - DNA, 59 bp, Homo sapiens; identical to SEQ ID NO: 4924
  misc_feature 1..59: note = chr22:50623656-50623715
  misc_feature 1..59: note = hyper
  source 1..59: mol_type = genomic DNA

SEQ ID NO: 14125 - DNA, 120 bp, Homo sapiens; identical to SEQ ID NO: 4925
  misc_feature 1..120: note = chr22:50623741-50623861
  misc_feature 1..120: note = hyper
  source 1..120: mol_type = genomic DNA

SEQ ID NO: 14126 - DNA, 88 bp, Homo sapiens; identical to SEQ ID NO: 1527
  misc_feature 1..88: note = chr22:51042317-51042405
  misc_feature 1..88: note = hyper
  source 1..88: mol_type = genomic DNA

SEQ ID NO: 14127 - DNA, 109 bp, Homo sapiens; identical to SEQ ID NO: 1528
  misc_feature 1..109: note = chr22:51042457-51042566
  misc_feature 1..109: note = hyper
  source 1..109: mol_type = genomic DNA

SEQ ID NO: 14128 - DNA, 94 bp, Homo sapiens
  misc_feature 1..94: note = chr22:51112080-51112174
  misc_feature 1..94: note = hyper
  source 1..94: mol_type = genomic DNA
ccctaggcccttccccgtaggtcgcgcccccatcccgccgtcgctaaggtgacggggagggggcgacaggcgttggatccggaccggccagggg

SEQ ID NO: 14129 - DNA, 96 bp, Homo sapiens
  misc_feature 1..96: note = chrX:3264807-3264903
  misc_feature 1..96: note = hyper
  source 1..96: mol_type = genomic DNA
ccaagggaccctggccgcgccgctctgcgctcagccttcctctcgcgtcttcattgcgcctgggcccgggtgggcatgcctcgcccactccagctg

SEQ ID NO: 14130 - DNA, 29 bp, Homo sapiens
  misc_feature 1..29: note = chrX:3265150-3265179
  misc_feature 1..29: note = hyper
  source 1..29: mol_type = genomic DNA
cgggctggccccgccggcatcccactagc

SEQ ID NO: 14131 - DNA, 20 bp, Homo sapiens
  misc_feature 1..20: note = chrX:6143666-6143686
  misc_feature 1..20: note = hyper
  source 1..20: mol_type = genomic DNA
gcttcgtcaggataacgagg

SEQ ID NO: 14132 - DNA, 199 bp, Homo sapiens
  misc_feature 1..199: note = chrX:6143746-6143945
  misc_feature 1..199: note = hyper
  source 1..199: mol_type = genomic DNA
ttttttttttttttttgcttttgccttcctcacatcaccggaagggctgattctgagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaa

SEQ ID NO: 14133 - DNA, 30 bp, Homo sapiens
  misc_feature 1..30: note = chrX:6144913-6144943
  misc_feature 1..30: note = hyper
  source 1..30: mol_type = genomic DNA
tccctacctcatccccgctcgcgcttccgc

SEQ ID NO: 14134 - DNA, 307 bp, Homo sapiens
  misc_feature 1..307: note = chrX:6145243-6145550
  misc_feature 1..307: note = hyper
  source 1..307: mol_type = genomic DNA
gggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcc

SEQ ID NO: 14135 - DNA, 30 bp, Homo sapiens
  misc_feature 1..30: note = chrX:8698521-8698551
  misc_feature 1..30: note = hyper
  source 1..30: mol_type = genomic DNA
gttcaagatcatccccgagggtaaggggaa

SEQ ID NO: 14136 - DNA, 216 bp, Homo sapiens
  misc_feature 1..216: note = chrX:8698842-8699058
  misc_feature 1..216: note = hyper
  source 1..216: mol_type = genomic DNA
gaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 14137 - DNA, 71 bp, Homo sapiens
  misc_feature 1..71: note = chrX:8699110-8699181
  misc_feature 1..71: note = hyper
  source 1..71: mol_type = genomic DNA
cggggtttgggggacggttcccccgggactcgttgaggagtatccgaatacggccccgccaaatcccctgt

SEQ ID NO: 14138 - DNA, 62 bp, Homo sapiens
  misc_feature 1..62: note = chrX:8699504-8699566
  misc_feature 1..62: note = hyper
  source 1..62: mol_type = genomic DNA
ctttgcgggagtcgccgcccgcccggagtctcgcgcactccaattcccgggaaaccgccaca

SEQ ID NO: 14139 - DNA, 145 bp, Homo sapiens
  misc_feature 1..145: note = chrX:13956384-13956529
  misc_feature 1..145: note = hyper
  source 1..145: mol_type = genomic DNA
cagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacc

SEQ ID NO: 14140 - DNA, 281 bp, Homo sapiens
  misc_feature 1..281: note = chrX:13956777-13957058
  misc_feature 1..281: note = hyper
  source 1..281: mol_type = genomic DNA
ctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatcc

SEQ ID NO: 14141 - DNA, 30 bp, Homo sapiens
  misc_feature 1..30: note = chrX:16730016-16730046
  misc_feature 1..30: note = hyper
  source 1..30: mol_type = genomic DNA
gaaaggccatgttaccggcgctgatcacca

SEQ ID NO: 14142 - DNA, 40 bp, Homo sapiens
  misc_feature 1..40: note = chrX:40017828-40017868
  misc_feature 1..40: note = hyper
  source 1..40: mol_type = genomic DNA
acgacctctggttcccggactcccgcgatggtcaacgtgt

SEQ ID NO: 14143 - DNA, 38 bp, Homo sapiens
  misc_feature 1..38: note = chrX:40034521-40034559
  misc_feature 1..38: note = hyper
  source 1..38: mol_type = genomic DNA
ggctggccccgcgcgcgtaagcgcggcactcagcagct

SEQ ID NO: 14144 - DNA, 172 bp, Homo sapiens
  misc_feature 1..172: note = chrX:91035629-91035801
  misc_feature 1..172: note = hyper
  source 1..172: mol_type = genomic DNA
ttctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggc

SEQ ID NO: 14145 - DNA, 34 bp, Homo sapiens
  misc_feature 1..34: note = chrX:91037095-91037129
  misc_feature 1..34: note = hyper
  source 1..34: mol_type = genomic DNA
cgagcagccctgccccgcgcgctccctgcgcgca

SEQ ID NO: 14146 - DNA, 27 bp, Homo sapiens
  misc_feature 1..27: note = AC211950.2_11234-25326:156-183
  misc_feature 1..27: note = hyper
  source 1..27: mol_type = genomic DNA
gggttcgatccccgtgccggtcagaag

SEQ ID NO: 14147 - DNA, 43 bp, Homo sapiens
  misc_feature 1..43: note = AC211950.2_11234-25326:13516-13559
  misc_feature 1..43: note = hyper
  source 1..43: mol_type = genomic DNA
ttatcaggagcctgccggtactttgggccgccaaatccctggc

SEQ ID NO: 14148 - DNA, 420 bp, Homo sapiens; identical to SEQ ID NO: 1529
  misc_feature 1..420: note = AC241851.2_88-34049:15130-15550
  misc_feature 1..420: note = hyper
  source 1..420: mol_type = genomic DNA

SEQ ID NO: 14149 - DNA, 91 bp, Homo sapiens
  misc_feature 1..91: note = AEKP01168736.1_1-4752:1669-1760
  misc_feature 1..91: note = hyper
  source 1..91: mol_type = genomic DNA
gtctaagctagggcccggggtccaaaggaaaggctttcagatctgagctccgcggctctggcggcggtggagctgggagcccgcggtggcc

SEQ ID NO: 14150 - DNA, 811 bp, Homo sapiens
  misc_feature 1..811: note = AEKP01168736.1_1-4752:1820-2631
  misc_feature 1..811: note = hyper
  source 1..811: mol_type = genomic DNA
tggtcctgggctcggcgatgcgggtgcacctgggcgggctggccggcgcggctgcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccggggtaagggtgcaccccgtggctgggagctgtggctgcgaacgccccctgcgcggtgccctgctcccttgggacctgttgcttggcgcgcactcctcccccaagtccctaaaatacaatgtctagggactcggggggaaggtgagcagaaggccgggactgcgaaaacccttccgagaggcacccggctgcgatcccaactgctctagctctccccgcgccctccccgggtggggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtct

SEQ ID NO: 14151 - DNA, 82 bp, Homo sapiens
  misc_feature 1..82: note = JH159140.1:144237-144319
  misc_feature 1..82: note = hyper
  source 1..82: mol_type = genomic DNA
tgcccctaggtctgtcgctcagccgccgtccacactcgctgcaggggggggggcacagaatttaccgcggcaagaacatccc

SEQ ID NO: 14152 - DNA, 36 bp, Homo sapiens; identical to SEQ ID NO: 4929
  misc_feature 1..36: note = JH636052.4:1362180-1362216
  misc_feature 1..36: note = hyper
  source 1..36: mol_type = genomic DNA

SEQ ID NO: 14153 - DNA, 194 bp, Homo sapiens
  misc_feature 1..194: note = JH636052.4:5118735-5118929
  misc_feature 1..194: note = hyper
  source 1..194: mol_type = genomic DNA
gggcgaaggccattccgctgcccttccagcttcggaatcacccaatgcacgggtttcaaccgtagccagcaagatgcgcctctcaggttttccgaggctttggagcctgcacaattgttctacaaaaggcagtagctccgccgaacgttggatcgtcccttggtctggtgataccagaacgagagttgactgtg

SEQ ID NO: 14154 - DNA, 172 bp, Homo sapiens
  misc_feature 1..172: note = JH636058.1:413215-413387
  misc_feature 1..172: note = hyper
  source 1..172: mol_type = genomic DNA
ccaggcactcggcggcgaagtagtccaggcacgccacggcggccgacatgctgggaccgcccggccgccggcgagcgccgtccgaacgcggccggccgcgggcgacggagttcccgggagcgtccgtcccgcagcctcggagcgagaagcaggaggccgggtgctcgccgcc

SEQ ID NO: 14155 - DNA, 572 bp, Homo sapiens
  misc_feature 1..572: note = chr1:913532-914104
  misc_feature 1..572: note = hypo
  source 1..572: mol_type = genomic DNA
tccaaccccaggaaccgcctgccccaccctaaccctgcacactcttggcctgggaactgcctgccccgcacacgcccgccccgggaaccgcctgccccagatacatccatcatgggacatgtctgtcctaagatacatttgtgctggacacgtctaccctggacacgtcttcccgaaacccctctgtcatggacacgtcttcctgagaactggttgccccgggaaccgcctgccccgggaaccgcccgccctggacgcgtctgtcggagtcacatcgcccccgtgcttcttctgcctgagatttgggtgacctggttgagttgggccagtttgggggaactgccagtggaggccccgtgttctggtctgtaaagcatctcccagaggacatcagtgtgagatgggcctcgtagagtgcctgaccctgaaggtagccaggcctgggcgggaaccctgccagaggctgggggagggacgccgccgtcacatgggcccgaacacagggcaacggcggcgcagagccaaccccctgaacaacccgggtgcttggactgggccgccccatctggact

SEQ ID NO: 14156 - DNA, 33 bp, Homo sapiens
  misc_feature 1..33: note = chr1:942352-942385
  misc_feature 1..33: note = hypo
  source 1..33: mol_type = genomic DNA
ccgggcctcggaccccgacggggctcacccacc

SEQ ID NO: 14157 - DNA, 34 bp, Homo sapiens
  misc_feature 1..34: note = chr1:1050115-1050149
  misc_feature 1..34: note = hypo
  source 1..34: mol_type = genomic DNA
actgaacatcccaggcggccgcccctaccctggg

SEQ ID NO: 14158 - DNA, 30 bp, Homo sapiens
  misc_feature 1..30: note = chr1:1080808-1080838
  misc_feature 1..30: note = hypo
  source 1..30: mol_type = genomic DNA
ccgacctgacctgaccgcacggctgaccca

SEQ ID NO: 14159 - DNA, 155 bp, Homo sapiens
  misc_feature 1..155: note = chr1:1145553-1145708
  misc_feature 1..155: note = hypo
  source 1..155: mol_type = genomic DNA
ctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggc

SEQ ID NO: 14160 - DNA, 137 bp, Homo sapiens
  misc_feature 1..137: note = chr1:1146693-1146830
  misc_feature 1..137: note = hypo
  source 1..137: mol_type = genomic DNA
tgcagcccacagtgccggtcggagactcccgtctgccaaggtttttattgtggtcccgcggggcaggaggtatgcatggcatacgtaagcagagagccggaggcagccatcggcacctagaacggtgcagagttggc

SEQ ID NO: 14161 - DNA, 146 bp, Homo sapiens; identical to SEQ ID NO: 1530
  misc_feature 1..146: note = chr1:1235932-1236078
  misc_feature 1..146: note = hypo
  source 1..146: mol_type = genomic DNA

SEQ ID NO: 14162 - DNA, 129 bp, Homo sapiens
  misc_feature 1..129: note = chr1:1238321-1238450
  misc_feature 1..129: note = hypo
  source 1..129: mol_type = genomic DNA
cctgtaggctgtcagcgaacctctgcagacattcctggaggagcagatgggaacccgtgctgagatggcaaatccgggcccaggtcacccagccacgccctctgagcccctgggcggtgcagacaccgg

SEQ ID NO: 14163 - DNA, 30 bp, Homo sapiens
  misc_feature 1..30: note = chr1:1245257-1245287
  misc_feature 1..30: note = hypo
  source 1..30: mol_type = genomic DNA
cctgccctcaagtcacgtgctgattttagc

SEQ ID NO: 14164 - DNA, 72 bp, Homo sapiens
  misc_feature 1..72: note = chr1:1267177-1267249
  misc_feature 1..72: note = hypo
  source 1..72: mol_type = genomic DNA
gccaaggcaggcagccgcgacatcgccgcctactgcaactacacgcagtaccagccccgtgtgctggctgtc

SEQ ID NO: 14165 - DNA, 692 bp, Homo sapiens; identical to SEQ ID NO: 1531
  misc_feature 1..692: note = chr1:1267466-1268158
  misc_feature 1..692: note = hypo
  source 1..692: mol_type = genomic DNA

SEQ ID NO: 14166 - DNA, 30 bp, Homo sapiens
  misc_feature 1..30: note = chr1:1563193-1563223
  misc_feature 1..30: note = hypo
  source 1..30: mol_type = genomic DNA
tgacgtcaacctgcccgtgagtgctgctcc

SEQ ID NO: 14167 - DNA, 129 bp, Homo sapiens
  misc_feature 1..129: note = chr1:1856222-1856351
  misc_feature 1..129: note = hypo
  source 1..129: mol_type = genomic DNA
agggcgcctgagtctcgctcaggcccagcttagctgaacccacgtccccacctgtgtcctccctgccctcaccccctctccttagagcaccctttctccatgcaacgcccgtctcgggctctgcctcca

SEQ ID NO: 14168 - DNA, 30 bp, Homo sapiens
  misc_feature 1..30: note = chr1:1874744-1874774
  misc_feature 1..30: note = hypo
  source 1..30: mol_type = genomic DNA
agacacgccaacacacgcagctggctcccg

SEQ ID NO: 14169 - DNA, 30 bp, Homo sapiens
  misc_feature 1..30: note = chr1:1915087-1915117
  misc_feature 1..30: note = hypo
  source 1..30: mol_type = genomic DNA
gctcttctgtaagttcggaattgtttcaaa

SEQ ID NO: 14170 - DNA, 38 bp, Homo sapiens
  misc_feature 1..38: note = chr1:2013465-2013503
  misc_feature 1..38: note = hypo
  source 1..38: mol_type = genomic DNA
aaagcaggcttgatccgggctgccgtggttccgatcga

SEQ ID NO: 14171 - DNA, 64 bp, Homo sapiens
  misc_feature 1..64: note = chr1:2066615-2066679
  misc_feature 1..64: note = hypo
  source 1..64: mol_type = genomic DNA
acgggagtggcctgtcgcagctgcaccctgcgtgggctcgtggctgccacgctgtttctttaca

SEQ ID NO: 14172 - DNA, 30 bp, Homo sapiens
  misc_feature 1..30: note = chr1:2141654-2141684
  misc_feature 1..30: note = hypo
  source 1..30: mol_type = genomic DNA
acacctgaaatcaagcgggagggtaggaat

SEQ ID NO: 14173 - DNA, 213 bp, Homo sapiens
  misc_feature 1..213: note = chr1:2263131-2263344
  misc_feature 1..213: note = hypo
  source 1..213: mol_type = genomic DNA
gggaacagtcaaagacgactttgcaggatcctgcctgagagttgtaacaaaggcgcgcgtttctcccgcatgcgccgtccttcttatgtaaccactgccgctcctctcccgcggctgcgcctctcccgccgctgcgcctctccctcgtgcggctctcccgcccctgcgcctctccctcgtgcgcctctcccgcccctgcgcctctccctcgtg

SEQ ID NO: 14174 - DNA, 224 bp, Homo sapiens; identical to SEQ ID NO: 4932
  misc_feature 1..224: note = chr1:2267466-2267690
  misc_feature 1..224: note = hypo
  source 1..224: mol_type = genomic DNA

SEQ ID NO: 14175 - DNA, 102 bp, Homo sapiens
  misc_feature 1..102: note = chr1:2275689-2275791
  misc_feature 1..102: note = hypo
  source 1..102: mol_type = genomic DNA
ggcacaaggggctggcgggcctgggagggatctgcagggcaggttgagacatggttctgaagccaggcagctgctccccagaagctccggtgagcacactcg

SEQ ID NO: 14176 - DNA, 49 bp, Homo sapiens
  misc_feature 1..49: note = chr1:2304340-2304389
  misc_feature 1..49: note = hypo
  source 1..49: mol_type = genomic DNA
cccgtggaatgttcccgcacgtcttcccgctggtcgggatttaggccct

SEQ ID NO: 14177 - DNA, 49 bp, Homo sapiens
  misc_feature 1..49: note = chr1:2307845-2307894
  misc_feature 1..49: note = hypo
  source 1..49: mol_type = genomic DNA
ccccttccacctgctcggcctctggaaggtgccccgggctttcaggagg

SEQ ID NO: 14178 - DNA, 161 bp, Homo sapiens
  misc_feature 1..161: note = chr1:2308245-2308406
  misc_feature 1..161: note = hypo
  source 1..161: mol_type = genomic DNA
actgatccaatagcccggtcttgtctaattcacgttatcaatcacacctttgacaattcggctgtttctgtttcatgtaccccaagcaggaacgagcaagagcttattaaatagggtgcaggggaggctcctgatcctcctgctgacggcacagactggga

SEQ ID NO: 14179 - DNA, 52 bp, Homo sapiens
  misc_feature 1..52: note = chr1:2308606-2308658
  misc_feature 1..52: note = hypo
  source 1..52: mol_type = genomic DNA
gtgcggtacgggacacgggaaggtggtggtggtcacacgacctttggggaag

SEQ ID NO: 14180 - DNA, 49 bp, Homo sapiens
  misc_feature 1..49: note = chr1:2338188-2338237
  misc_feature 1..49: note = hypo
  source 1..49: mol_type = genomic DNA
cactccttcctggctcgctgccgctgcctgaaaccgtacagctgcagcc

SEQ ID NO: 14181 - DNA, 348 bp, Homo sapiens
  misc_feature 1..348: note = chr1:2359972-2360320
  misc_feature 1..348: note = hypo
  source 1..348: mol_type = genomic DNA
gacctcatggtcctccgtggcctcgcctaggcttgcggcagccgacgtggcgttgttgcctaattaggttggactgtgccagccccagcggagcccacgcccggcccttgcgccggcagacgtgtcggggcacggctcctgcactcccactgccgcaggaactgctcaggaacctgccggtctccggctgggacggtggctggatcagctcaagcctccagggccctgaggctgaggggctgagtgctcattccagccgcctcggggaacccgggctgggagaccccatgcctgggggtgagcctggagccagggcagtgcggtgagaggctccggagagagggctgg

SEQ ID NO: 14182 - DNA, 180 bp, Homo sapiens
  misc_feature 1..180: note = chr1:2396998-2397178
  misc_feature 1..180: note = hypo
  source 1..180: mol_type = genomic DNA
tcctcacctgctgcccgccgcctgccgcccgccacctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtga

SEQ ID NO: 14183 - DNA, 89 bp, Homo sapiens
  misc_feature 1..89: note = chr1:2428272-2428361
  misc_feature 1..89: note = hypo
  source 1..89: mol_type = genomic DNA
ccagctggcaggtgtcgtccttcagcgagaccaaggcccaccagattctgcagcagaagccggcgcagtacctacgcttcaaccagcag

SEQ ID NO: 14184 - DNA, 30 bp, Homo sapiens
  misc_feature 1..30: note = chr1:2468639-2468669
  misc_feature 1..30: note = hypo
  source 1..30: mol_type = genomic DNA
ctatgcatgcatctgcgtgcatgtgcccag

SEQ ID NO: 14185 - DNA, 30 bp, Homo sapiens
  misc_feature 1..30: note = chr1:2507045-2507075
  misc_feature 1..30: note = hypo
  source 1..30: mol_type = genomic DNA
ctcacaggctcacagcgggtgtactttatt

SEQ ID NO: 14186 - DNA, 66 bp, Homo sapiens
  misc_feature 1..66: note = chr1:2537084-2537150
  misc_feature 1..66: note = hypo
  source 1..66: mol_type = genomic DNA
cctgggcaaggggcccggggtccccgcagcctggctgaggcaggctgcagccgcctccccacagga

SEQ ID NO: 14187 - DNA, 79 bp, Homo sapiens
  misc_feature 1..79: note = chr1:2537758-2537837
  misc_feature 1..79: note = hypo
  source 1..79: mol_type = genomic DNA
ctgtgagttcatcagcgccagctgccgctccagctcccactcgagtcctggggagacagtgccccgcactggagactgg

SEQ ID NO: 14188 - DNA, 113 bp, Homo sapiens
  misc_feature 1..113: note = chr1:2708372-2708485
  misc_feature 1..113: note = hypo
  source 1..113: mol_type = genomic DNA
tctctcctctctttccgagattccagttacacacacgagactttgatattgtccccaggtcacccagcctctgttcatttttcttctgttcttcgtatcgagtaatttctatt

SEQ ID NO: 14189 - DNA, 136 bp, Homo sapiens
  misc_feature 1..136: note = chr1:2725529-2725665
  misc_feature 1..136: note = hypo
  source 1..136: mol_type = genomic DNA
aggagctggggctgccggcctcgcaggtgtggttggggtgggtggggctgccgtgggcctggctccatggctctgtgcaggtggcagccggcgccgcgtgtcgccacccacacaggaaaggcgagattggtggcag

SEQ ID NO: 14190 - DNA, 54 bp, Homo sapiens
  misc_feature 1..54: note = chr1:3078787-3078841
  misc_feature 1..54: note = hypo
  source 1..54: mol_type = genomic DNA
cccccaggaaaaccccgtgcccggtaaatagtgactctgcgtccctcctcccga

SEQ ID NO: 14191 - DNA, 87 bp, Homo sapiens
  misc_feature 1..87: note = chr1:3102677-3102764
  misc_feature 1..87: note = hypo
  source 1..87: mol_type = genomic DNA
gtctcctttaggtgacggtgacgttgtaaataatatgtatgagcccaaccgggacctgctggccagccacagcgcggaggacgaggc

SEQ ID NO: 14192 - DNA, 56 bp, Homo sapiens
  misc_feature 1..56: note = chr1:3111327-3111383
  misc_feature 1..56: note = hypo
  source 1..56: mol_type = genomic DNA
gtattctcagtcccacgttttatcatctaaacgccaaaactcgttcctggcctgcc

SEQ ID NO: 14193 - DNA, 39 bp, Homo sapiens
  misc_feature 1..39: note = chr1:3411209-3411248
  misc_feature 1..39: note = hypo
  source 1..39: mol_type = genomic DNA
cacaggagcagctgccgttgctggcgtggcacaggcccc

SEQ ID NO: 14194 - DNA, 15 bp, Homo sapiens
  misc_feature 1..15: note = chr1:3659628-3659643
  misc_feature 1..15: note = hypo
  source 1..15: mol_type = genomic DNA
tctctttagggaagc

SEQ ID NO: 14195 - DNA, 30 bp, Homo sapiens
  misc_feature 1..30: note = chr1:3680070-3680100
  misc_feature 1..30: note = hypo
  source 1..30: mol_type = genomic DNA
ccactcagtggttcccggcccaggagctgg

SEQ ID NO: 14196 - DNA, 104 bp, Homo sapiens
  misc_feature 1..104: note = chr1:3683740-3683844
  misc_feature 1..104: note = hypo
  source 1..104: mol_type = genomic DNA
catactcaggttgggcgaaatgaccccacctcttttttctccccggctgtccccagcaagtgtcggaactggagagaaagctcaccaagcgggactgtgtcatc

SEQ ID NO: 14197 - DNA, 180 bp, Homo sapiens
  misc_feature 1..180: note = chr1:4082823-4083003
  misc_feature 1..180: note = hypo
  source 1..180: mol_type = genomic DNA
cccaaacgtcagtggcgctgagcagagcaaccctgatttagcgactccttgttggtcctggctcccagtgtgttggggacgtgatgcgggtgactctgctgtgggctcacaggctctgctggttccatggacagaaataaagtggaacttcatgctgctggaactcgggcggttgtgctg

SEQ ID NO: 14198 - DNA, 151 bp, Homo sapiens
  misc_feature 1..151: note = chr1:4111083-4111234
  misc_feature 1..151: note = hypo
  source 1..151: mol_type = genomic DNA
ggcctcctctggaatcttcactgagcacctgccatggtggggactgttgccagcactgggtatgagacctcctgggagccctcagctgggcaggagcctgggggatcagaaaggatcgaggtttggaatggagcgccgcagctggtgcctg

SEQ ID NO: 14199 - DNA, 141 bp, Homo sapiens
  misc_feature 1..141: note = chr1:4402113-4402254
  misc_feature 1..141: note = hypo
  source 1..141: mol_type = genomic DNA
actgctgtgtgtccccgcggattcaggcggctctgatcccacctgataggtagacaagaacgcacttggcaactagtagccactcacctggtacccgggccatgtggacctgccctagtgtggcctcgcttactgcccgcc

SEQ ID NO: 14200 - DNA, 30 bp, Homo sapiens
  misc_feature 1..30: note = chr1:4486536-4486566
  misc_feature 1..30: note = hypo
  source 1..30: mol_type = genomic DNA
tgccaaagccatggccgcagacatacgatg

SEQ ID NO: 14201 - DNA, 53 bp, Homo sapiens
  misc_feature 1..53: note = chr1:4772565-4772618
  misc_feature 1..53: note = hypo
  source 1..53: mol_type = genomic DNA
gaagacaactgtggccgccaccaccaccaccaccaccacggccacccccatga

SEQ ID NO: 14202 - DNA, 128 bp, Homo sapiens; identical to SEQ ID NO: 1532
  misc_feature 1..128: note = chr1:6166321-6166449
  misc_feature 1..128: note = hypo
  source 1..128: mol_type = genomic DNA

SEQ ID NO: 14203 - DNA, 30 bp, Homo sapiens
  misc_feature 1..30: note = chr1:6280243-6280273
  misc_feature 1..30: note = hypo
  source 1..30: mol_type = genomic DNA
agttttgattttccccgtgtttgcatggca

SEQ ID NO: 14204 - DNA, 30 bp, Homo sapiens
  misc_feature 1..30: note = chr1:6360980-6361010
  misc_feature 1..30: note = hypo
  source 1..30: mol_type = genomic DNA
acacatggagagtcacgcttccaaagtcac

SEQ ID NO: 14205 - DNA, 56 bp, Homo sapiens
  misc_feature 1..56: note = chr1:6391449-6391505
  misc_feature 1..56: note = hypo
  source 1..56: mol_type = genomic DNA
gcctcagccaagggacgcctggagccacccggcgctggagacgccaggagggatcc

SEQ ID NO: 14206 - DNA, 177 bp, Homo sapiens
  misc_feature 1..177: note = chr1:6446131-6446308
  misc_feature 1..177: note = hypo
  source 1..177: mol_type = genomic DNA
tgagttccacctgggcggagttccacctgggcagagaggtcttggctcacaggcaccgggagagctggaaggctgcggggaagccgaggaaggccaacacaccgcacaacacggcaggtgcctggccctcctctgacagtggccctcaagctccaggagggccgaggaaaatgcaga

SEQ ID NO: 14207 - DNA, 98 bp, Homo sapiens
  misc_feature 1..98: note = chr1:11036301-11036399
  misc_feature 1..98: note = hypo
  source 1..98: mol_type = genomic DNA
agccagacggccctgcgggagaggagggaagggggtggggacatgcaccgcccagctgctgcctcatctaccttcattcactcattatatttcttttt

SEQ ID NO: 14208 - DNA, 30 bp, Homo sapiens
  misc_feature 1..30: note = chr1:11131698-11131728
  misc_feature 1..30: note = hypo
  source 1..30: mol_type = genomic DNA
cagagtaaaaggcagcgtcatcccgtgggc

SEQ ID NO: 14209 - DNA, 84 bp, Homo sapiens
  misc_feature 1..84: note = chr1:11936694-11936778
  misc_feature 1..84: note = hypo
  source 1..84: mol_type = genomic DNA
gatgtgaagtagcttcgggcagaactccaaaccttagagagatcatttgaaaataccatttgggctgggcgcagtggctcatgc

SEQ ID NO: 14210 - DNA, 474 bp, Homo sapiens
  misc_feature 1..474: note = chr1:12251443-12251917
  misc_feature 1..474: note = hypo
  source 1..474: mol_type = genomic DNA
aactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcagg

SEQ ID NO: 14211 - DNA, 60 bp, Homo sapiens
  misc_feature 1..60: note = chr1:14730412-14730472
  misc_feature 1..60: note = hypo
  source 1..60: mol_type = genomic DNA
aagaagaggtctctgcgcagagaggtcccggagaaaatgggttgccgcttctgcagtgaa

SEQ ID NO: 14212 - DNA, 41 bp, Homo sapiens
  misc_feature 1..41: note = chr1:16534552-16534593
  misc_feature 1..41: note = hypo
  source 1..41: mol_type = genomic DNA
tccgctcaggaccttcgaggctcactcgggtggacccagac

SEQ ID NO: 14213 - DNA, 30 bp, Homo sapiens
  misc_feature 1..30: note = chr1:19213653-19213683
  misc_feature 1..30: note = hypo
  source 1..30: mol_type = genomic DNA
ggtgttggtccaaaccgcaccattttgtca

SEQ ID NO: 14214 - DNA, 64 bp, Homo sapiens
  misc_feature 1..64: note = chr1:21042770-21042834
  misc_feature 1..64: note = hypo
  source 1..64: mol_type = genomic DNA
taagagcagcacctgcggggctctcacagggtgcatacagggcttctttcgtgcatgggcacag

SEQ ID NO: 14215 - DNA, 30 bp, Homo sapiens
  misc_feature 1..30: note = chr1:22777528-22777558
  misc_feature 1..30: note = hypo
  source 1..30: mol_type = genomic DNA
cgcttcaacagggaacgcatagtgtgtgag

SEQ ID NO: 14216 - DNA, 80 bp, Homo sapiens
  misc_feature 1..80: note = chr1:22927402-22927482
  misc_feature 1..80: note = hypo
  source 1..80: mol_type = genomic DNA
gtggaggaggggtaccgcctgcccgcacccatgggctgcccccacgccctgcaccagctcatgctcgactgttggcacaa

SEQ ID NO: 14217 - DNA, 42 bp, Homo sapiens
  misc_feature 1..42: note = chr1:24119192-24119234
  misc_feature 1..42: note = hypo
  source 1..42: mol_type = genomic DNA
tgtgcccctgctcaccgatgctgccaccgtgtctggagctga

SEQ ID NO: 14218 - DNA, 103 bp, Homo sapiens; identical to SEQ ID NO: 4934
  misc_feature 1..103: note = chr1:27190175-27190278
  misc_feature 1..103: note = hypo
  source 1..103: mol_type = genomic DNA

SEQ ID NO: 14219 - DNA, 30 bp, Homo sapiens
  misc_feature 1..30: note = chr1:27844537-27844567
  misc_feature 1..30: note = hypo
  source 1..30: mol_type = genomic DNA
gagcagatctgagcacgctcctcaccagcc

SEQ ID NO: 14220 - DNA, 30 bp, Homo sapiens
  misc_feature 1..30: note = chr1:29074253-29074283
  misc_feature 1..30: note = hypo
  source 1..30: mol_type = genomic DNA
atcctagttctcagccggtgagcaaaccac

SEQ ID NO: 14221 - DNA, 16 bp, Homo sapiens
  misc_feature 1..16: note = chr1:29516596-29516612
  misc_feature 1..16: note = hypo
  source 1..16: mol_type = genomic DNA
atagtcaaggccgggc

SEQ ID NO: 14222 - DNA, 41 bp, Homo sapiens
  misc_feature 1..41: note = chr1:32705509-32705550
  misc_feature 1..41: note = hypo
  source 1..41: mol_type = genomic DNA
tggtctctgtgcctccgccagtcacgcgggcttgtttcgcg

SEQ ID NO: 14223 - DNA, 143 bp, Homo sapiens
  misc_feature 1..143: note = chr1:33473115-33473258
  misc_feature 1..143: note = hypo
  source 1..143: mol_type = genomic DNA
acaagagatgggaaccggctccttcccccaacataactcacccctccagcctttctggaatacgggtgattccaggagctatgcaaatccagcacattggaactttagtaccaacaataaggaaacaacggaggatggcaaaa

SEQ ID NO: 14224 - DNA, 20 bp, Homo sapiens
  misc_feature 1..20: note = chr1:35660562-35660582
  misc_feature 1..20: note = hypo
  source 1..20: mol_type = genomic DNA
aggcgggaccgggtgcggtg

SEQ ID NO: 14225 - DNA, 22 bp, Homo sapiens
  misc_feature 1..22: note = chr1:35664724-35664746
  misc_feature 1..22: note = hypo
  source 1..22: mol_type = genomic DNA
ccaccggcgctagctattctta

SEQ ID NO: 14226 - DNA, 115 bp, Homo sapiens
  misc_feature 1..115: note = chr1:36563456-36563571
  misc_feature 1..115: note = hypo
  source 1..115: mol_type = genomic DNA
tggctgggttgtagccgctgtggccattgtagagagtccggtcaaatttcacgggcatgcccgaggcggggaagggcgaggtgagcaccgcagtgaaggccggtgtggcatgggc

SEQ ID NO: 14227 - DNA, 81 bp, Homo sapiens; identical to SEQ ID NO: 4936
  misc_feature 1..81: note = chr1:38398328-38398409
  misc_feature 1..81: note = hypo
  source 1..81: mol_type = genomic DNA

SEQ ID NO: 14228 - DNA, 156 bp, Homo sapiens; identical to SEQ ID NO: 1533
  misc_feature 1..156: note = chr1:39416821-39416977
  misc_feature 1..156: note = hypo
  source 1..156: mol_type = genomic DNA

SEQ ID NO: 14229 - DNA, 30 bp, Homo sapiens
  misc_feature 1..30: note = chr1:40905137-40905167
  misc_feature 1..30: note = hypo
  source 1..30: mol_type = genomic DNA
agtgccttaaattaccgtgttgtgtaactg

SEQ ID NO: 14230 - DNA, 145 bp, Homo sapiens; identical to SEQ ID NO: 4938
  misc_feature 1..145: note = chr1:41991640-41991785
  misc_feature 1..145: note = hypo
  source 1..145: mol_type = genomic DNA

SEQ ID NO: 14231 - DNA, 30 bp, Homo sapiens
  misc_feature 1..30: note = chr1:43826882-43826912
  misc_feature 1..30: note = hypo
  source 1..30: mol_type = genomic DNA
ggcctgtctgagtgccgtggatgcccattc

SEQ ID NO: 14232 - DNA, 98 bp, Homo sapiens
  misc_feature 1..98: note = chr1:43834741-43834839
  misc_feature 1..98: note = hypo
  source 1..98: mol_type = genomic DNA
aacagtagcacacaacgatctaacaactgcttgtatgattggatggtgtaagtgcggacagaattagggaatttgggctactctgggcacactgctta

SEQ ID NO: 14233 - DNA, 30 bp, Homo sapiens
  misc_feature 1..30: note = chr1:44068855-44068885
  misc_feature 1..30: note = hypo
  source 1..30: mol_type = genomic DNA
gctgtctgccccaggcgtgcggctcctggg

SEQ ID NO: 14234 - DNA, 43 bp, Homo sapiens
  misc_feature 1..43: note = chr1:44351190-44351233
  misc_feature 1..43: note = hypo
  source 1..43: mol_type = genomic DNA
ggcaagcaggtcaggcgtcccacacccccgctagtctgaccag

SEQ ID NO: 14235 - DNA, 144 bp, Homo sapiens
  misc_feature 1..144: note = chr1:44497527-44497671
  misc_feature 1..144: note = hypo
  source 1..144: mol_type = genomic DNA
ggccttctgcgcctgcgtttcccctagagagaagtcagagcaaattccattccctttggagcagagccgctagagactgtgggcattgctgggtaaggcctaggtcctactccttggaactggagggctcggggtagccctttc

SEQ ID NO: 14236 - DNA, 313 bp, Homo sapiens
  misc_feature 1..313: note = chr1:44726955-44727268
  misc_feature 1..313: note = hypo
  source 1..313: mol_type = genomic DNA
cagcgcggaggaaggcgcgagtcagtctggagtgctccccatttatcaagctcacgcaggccgccagccgagcgagtctttctatcattacacctctcaaaatccgattcataccactaatcctgccttcattctcccagattaataacatctctttcaaccttcacagtgtgataaatagacaaagagagaacaaaaggagagacagaagagagagaaagagctggagcaagtccccataatagagagagctgagaaagaggagagggaaaaaaggagagcgaacgagagcaggcagcggccagagactgca

SEQ ID NO: 14237 - DNA, 77 bp, Homo sapiens
  misc_feature 1..77: note = chr1:45280503-45280580
  misc_feature 1..77: note = hypo
  source 1..77: mol_type = genomic DNA
gtgtgcgccaccatgcccggcctcagctccttctttcattccagacctgcccccctggagatcgctccctgaatgcc

SEQ ID NO: 14238 - DNA, 37 bp, Homo sapiens; identical to SEQ ID NO: 1534
  misc_feature 1..37: note = chr1:45645619-45645656
  misc_feature 1..37: note = hypo
  source 1..37: mol_type = genomic DNA

SEQ ID NO: 14239 - DNA, 38 bp, Homo sapiens
  misc_feature 1..38: note = chr1:46079131-46079169
  misc_feature 1..38: note = hypo
  source 1..38: mol_type = genomic DNA
ctgtagcttacctagtttaggcacgattattatttttt

SEQ ID NO: 14240 - DNA, 20 bp, Homo sapiens
  misc_feature 1..20: note = chr1:53129144-53129164
  misc_feature 1..20: note = hypo
  source 1..20: mol_type = genomic DNA
acatgtggccgggcgcggtg

SEQ ID NO: 14241 - DNA, 30 bp, Homo sapiens
  misc_feature 1..30: note = chr1:53990562-53990592
  misc_feature 1..30: note = hypo
  source 1..30: mol_type = genomic DNA
gtaacatggggggcacgggtggggtgagtg

SEQ ID NO: 14242 - DNA, 407 bp, Homo sapiens
  misc_feature 1..407: note = chr1:54586590-54586997
  misc_feature 1..407: note = hypo
  source 1..407: mol_type = genomic DNA
gtggtggcagtggggcgagagagaaaggagtggactggagagatggtggtacgtgggcggacagagctggatgagagacctgggagagggagaaatccgaggccagcgcagaagtctgggtgtggagaggccgctcatccaaacgacaggagaggctcagggagcgccaatgattccgtgtgaggcacagggcgtggctgcgggtgggtgggagggcgactgcagcatgggaaatttcggtggagaaccagatcaggagtcaccaaataccatggagatggtaacaaagcctacagggaggcagggattgtgcggggagtctgcagcagcaaaacccctgctgggatgaggggccgggccctctctgaccccagaccaggcaaggctcccgtcgtccccactttgcc

SEQ ID NO: 14243 - DNA, 18 bp, Homo sapiens
  misc_feature 1..18: note = chr1:70599151-70599169
  misc_feature 1..18: note = hypo
  source 1..18: mol_type = genomic DNA
cctcggcctcccaaagtg

SEQ ID NO: 14244 - DNA, 90 bp, Homo sapiens; identical to SEQ ID NO: 4940
  misc_feature 1..90: note = chr1:70672837-70672927
  misc_feature 1..90: note = hypo
  source 1..90: mol_type = genomic DNA

SEQ ID NO: 14245 - DNA, 30 bp, Homo sapiens
  misc_feature 1..30: note = chr1:78244815-78244845
  misc_feature 1..30: note = hypo
  source 1..30: mol_type = genomic DNA
acattcaatattcttcggttgcctaattca

SEQ ID NO: 14246 - DNA, 98 bp, Homo sapiens; identical to SEQ ID NO: 1535
  misc_feature 1..98: note = chr1:86860851-86860949
  misc_feature 1..98: note = hypo
  source 1..98: mol_type = genomic DNA

SEQ ID NO: 14247 - DNA, 30 bp, Homo sapiens
  misc_feature 1..30: note = chr1:92494939-92494969
  misc_feature 1..30: note = hypo
  source 1..30: mol_type = genomic DNA
cggcttccagcccttcgacgaactctcagg

SEQ ID NO: 14248 - DNA, 28 bp, Homo sapiens
  misc_feature 1..28: note = chr1:94343568-94343596
  misc_feature 1..28: note = hypo
  source 1..28: mol_type = genomic DNA
aaatcaaaatttggccgggcgcggtggc

SEQ ID NO: 14249 - DNA, 98 bp, Homo sapiens
  misc_feature 1..98: note = chr1:99611990-99612088
  misc_feature 1..98: note = hypo
  source 1..98: mol_type = genomic DNA
gagccctgccctcctcggaagggctgcagctgcccaaattgcagttgtggatccagcctctctgtgctcttgggggcctgggggaacctgtgctctcg

SEQ ID NO: 14250 - DNA, 38 bp, Homo sapiens
  misc_feature 1..38: note = chr1:99612148-99612186
  misc_feature 1..38: note = hypo
  source 1..38: mol_type = genomic DNA
tcttagggcattgtcctgctgcgcgttgggggtgatga

SEQ ID NO: 14251 - DNA, 86 bp, Homo sapiens; identical to SEQ ID NO: 4943
  misc_feature 1..86: note = chr1:100437183-100437269
  misc_feature 1..86: note = hypo
  source 1..86: mol_type = genomic DNA

SEQ ID NO: 14252 - DNA, 26 bp, Homo sapiens
  misc_feature 1..26: note = chr1:100814757-100814783
  misc_feature 1..26: note = hypo
  source 1..26: mol_type = genomic DNA
aaaaaaaaaggcgttgttttcaaact

SEQ ID NO: 14253 - DNA, 20 bp, Homo sapiens
  misc_feature 1..20: note = chr1:109076917-109076937
  misc_feature 1..20: note = hypo
  source 1..20: mol_type = genomic DNA
ttcaccgtgttagccaggat

SEQ ID NO: 14254 - DNA, 41 bp, Homo sapiens; identical to SEQ ID NO: 4944
  misc_feature 1..41: note = chr1:109585463-109585504
  misc_feature 1..41: note = hypo
  source 1..41: mol_type = genomic DNA

SEQ ID NO: 14255 - DNA, 22 bp, Homo sapiens
  misc_feature 1..22: note = chr1:109593505-109593527
  misc_feature 1..22: note = hypo
  source 1..22: mol_type = genomic DNA
tcaagggccaggcaccgcggct

SEQ ID NO: 14256 - DNA, 79 bp, Homo sapiens
  misc_feature 1..79: note = chr1:110726679-110726758
  misc_feature 1..79: note = hypo
  source 1..79: mol_type = genomic DNA
aaagcacgctgtttccgacgatcagtgaggcaattatacaagcctgttttttctgtttttgttggttttttttgacgga

SEQ ID NO: 14257 - DNA, 30 bp, Homo sapiens
  misc_feature 1..30: note = chr1:110883605-110883635
  misc_feature 1..30: note = hypo
  source 1..30: mol_type = genomic DNA
gccgacaccgaacatcgttaccagcagcag

SEQ ID NO: 14258 - DNA, 30 bp, Homo sapiens
  misc_feature 1..30: note = chr1:110884166-110884196
  misc_feature 1..30: note = hypo
  source 1..30: mol_type = genomic DNA
ggtgacaagcgagaccgtaaaaactctgca

SEQ ID NO: 14259 - DNA, 180 bp, Homo sapiens
  misc_feature 1..180: note = chr1:112084890-112085070
  misc_feature 1..180: note = hypo
  source 1..180: mol_type = genomic DNA
caggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagc

SEQ ID NO: 14260 - DNA, 30 bp, Homo sapiens
  misc_feature 1..30: note = chr1:113751257-113751287
  misc_feature 1..30: note = hypo
  source 1..30: mol_type = genomic DNA
agatccactgaggggcgtggcctctcttcc

SEQ ID NO: 14261 - DNA, 30 bp, Homo sapiens
  misc_feature 1..30: note = chr1:116214288-116214318
  misc_feature 1..30: note = hypo
  source 1..30: mol_type = genomic DNA
cccaggcaggggaggcgcagtgcaggttgg

SEQ ID NO: 14262 - DNA, 30 bp, Homo sapiens
  misc_feature 1..30: note = chr1:116574202-116574232
  misc_feature 1..30: note = hypo
  source 1..30: mol_type = genomic DNA
gtaattatactaaggcgtgttctgttgctc

SEQ ID NO: 14263 - DNA, 30 bp, Homo sapiens
  misc_feature 1..30: note = chr1:150602992-150603022
  misc_feature 1..30: note = hypo
  source 1..30: mol_type = genomic DNA
aacatttggtaaatacggttaatactagtt

SEQ ID NO: 14264 - DNA, 30 bp, Homo sapiens
  misc_feature 1..30: note = chr1:150850705-150850735
  misc_feature 1..30: note = hypo
  source 1..30: mol_type = genomic DNA
taatcctcacaacaacgatgaggtaggttc

SEQ ID NO: 14265 - DNA, 79 bp, Homo sapiens; identical to SEQ ID NO: 1537
  misc_feature 1..79: note = chr1:151170062-151170141
  misc_feature 1..79: note = hypo
  source 1..79: mol_type = genomic DNA

SEQ ID NO: 14266 - DNA, 102 bp, Homo sapiens; identical to SEQ ID NO: 1538
  misc_feature 1..102: note = chr1:151252684-151252786
  misc_feature 1..102: note = hypo
  source 1..102: mol_type = genomic DNA

SEQ ID NO: 14267 - DNA, 30 bp, Homo sapiens
  misc_feature 1..30: note = chr1:151300888-151300918
  misc_feature 1..30: note = hypo
  source 1..30: mol_type = genomic DNA
aaataaacaaaaacacgccatgcaaatggg

SEQ ID NO: 14268 - DNA, 109 bp, Homo sapiens
  misc_feature 1..109: note = chr1:153539476-153539585
  misc_feature 1..109: note = hypo
  source 1..109: mol_type = genomic DNA
ccttggcacagccaccgagtgtcccttgctcccctcagtacttgaacccctcatgctacttgtcttcccatcgaggcctacttcaagtagaactcggaataaaaaccct

SEQ ID NO: 14269 - DNA, 195 bp, Homo sapiens
  misc_feature 1..195: note = chr1:153540047-153540242
  misc_feature 1..195: note = hypo
  source 1..195: mol_type = genomic DNA
ctcggcctgctgctgcgtgtcccttaaacacaccggcacatgcaactagtgtggccaagaccctcggcttgcgctgacccctctgttcagaacgtgcccacacatgcccatgccctctatcctgctgaaatccaacccccccttcaaaggccactgcagggagccttcccagggcccaaccggattcagtgtcta

SEQ ID NO: 14270 - DNA, 45 bp, Homo sapiens; identical to SEQ ID NO: 1539
  misc_feature 1..45: note = chr1:153937124-153937169
  misc_feature 1..45: note = hypo
  source 1..45: mol_type = genomic DNA

SEQ ID NO: 14271 - DNA, 98 bp, Homo sapiens
  misc_feature 1..98: note = chr1:155160925-155161023
  misc_feature 1..98: note = hypo
  source 1..98: mol_type = genomic DNA
ccctggcagaggtgccgttgtgcaccagagtagaagctgagcctgatgcagagcctgaggccgaggtgacattgtggactggaggggcggtggagccc

SEQ ID NO: 14272 - DNA, 26 bp, Homo sapiens
  misc_feature 1..26: note = chr1:155578901-155578927
  misc_feature 1..26: note = hypo
  source 1..26: mol_type = genomic DNA
actaccgcacccggcccttgccttgt

SEQ ID NO: 14273 - DNA, 44 bp, Homo sapiens
  misc_feature 1..44: note = chr1:155826292-155826336
  misc_feature 1..44: note = hypo
  source 1..44: mol_type = genomic DNA
ctaggattagaggcgtgagccaccgcgcccgacctacagttagt

SEQ ID NO: 14274 - DNA, 40 bp, Homo sapiens; identical to SEQ ID NO: 1540
  misc_feature 1..40: note = chr1:156030121-156030161
  misc_feature 1..40: note = hypo
  source 1..40: mol_type = genomic DNA

SEQ ID NO: 14275 - DNA, 23 bp, Homo sapiens
  misc_feature 1..23: note = chr1:156031582-156031605
  misc_feature 1..23: note = hypo
  source 1..23: mol_type = genomic DNA
tttttttttctgagacggagtct

SEQ ID NO: 14276 - DNA, 47 bp, Homo sapiens
  misc_feature 1..47: note = chr1:156433495-156433542
  misc_feature 1..47: note = hypo
  source 1..47: mol_type = genomic DNA
agaaaccaaaacccacgccgaagtatcagaaacgtgtattctttttc

SEQ ID NO: 14277 - DNA, 89 bp, Homo sapiens
  misc_feature 1..89: note = chr1:156843312-156843401
  misc_feature 1..89: note = hypo
  source 1..89: mol_type = genomic DNA
cctgccctttgatttcgggttctactcgctttgcccgtggacttgtcgggtgtgtgccaggctccctccagctgcgccctgacctcctg

SEQ ID NO: 14278 - DNA, 116 bp, Homo sapiens
  misc_feature 1..116: note = chr1:157247347-157247463
  misc_feature 1..116: note = hypo
  source 1..116: mol_type = genomic DNA
agtggcctttatgaccgcatttgaaacgggagtcaggtggaggtggattattaggaggcttccatgtagagccgcggcccagtggcctgcagggcctctgacggcagaggcaagca

SEQ ID NO: 14279 - DNA, 143 bp, Homo sapiens
  misc_feature 1..143: note = chr1:157458773-157458916
  misc_feature 1..143: note = hypo
  source 1..143: mol_type = genomic DNA
gacttggcaaccagccggacactgattccattcctgcttctaccgctaagctctgtcatccagcagatcctcaatggcctcatctggaaaatgggataatacttcctctgcagggttgctgggaggactaaatagatagaaga

SEQ ID NO: 14280 - DNA, 28 bp, Homo sapiens
  misc_feature 1..28: note = chr1:157791984-157792012
  misc_feature 1..28: note = hypo
  source 1..28: mol_type = genomic DNA
aacttgaacataaggcgggcggatcacg

SEQ ID NO: 14281 - DNA, 78 bp, Homo sapiens
  misc_feature 1..78: note = chr1:157895413-157895491
  misc_feature 1..78: note = hypo
  source 1..78: mol_type = genomic DNA
ttagaccagcaggtgcgaggtgcgacgtgggaaagagtccagggccggcggggtgctatgaggcgaggacttcctgag

SEQ ID NO: 14282 - DNA, 141 bp, Homo sapiens
  misc_feature 1..141: note = chr1:158169208-158169349
  misc_feature 1..141: note = hypo
  source 1..141: mol_type = genomic DNA
aactttctagtcttacgtattcttgtggtgcctgggaacagagttctgctcctactgattcaaaaggtaaaacgcaggtccaagacacactaggctccaggattgaacattgataagatcaaagacattaggctttggagg

SEQ ID NO: 14283 - DNA, 30 bp, Homo sapiens
  misc_feature 1..30: note = chr1:158237112-158237142
  misc_feature 1..30: note = hypo
  source 1..30: mol_type = genomic DNA
cccggtggtgcagaacgtgtgtgccaggtg

SEQ ID NO: 14284 - DNA, 20 bp, Homo sapiens
  misc_feature 1..20: note = chr1:158366698-158366718
  misc_feature 1..20: note = hypo
  source 1..20: mol_type = genomic DNA
tattttggccaggggcggtg

SEQ ID NO: 14285 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 14286 - DNA, 15 bp, Homo sapiens
  misc_feature 1..15: note = chr1:158591932-158591947
  misc_feature 1..15: note = hypo
  source 1..15: mol_type = genomic DNA
cgtgagccactgcac

SEQ ID NO: 14287 - DNA, 30 bp, Homo sapiens
  misc_feature 1..30: note = chr1:158639324-158639354
  misc_feature 1..30: note = hypo
  source 1..30: mol_type = genomic DNA
tcacgtagggcatcccgccgggctaacagc

SEQ ID NO: 14288 - DNA, 17 bp, Homo sapiens
  misc_feature 1..17: note = chr1:158730575-158730592
  misc_feature 1..17: note = hypo
  source 1..17: mol_type = genomic DNA
ctgggtgcagtggctcg

SEQ ID NO: 14289 - DNA, 23 bp, Homo sapiens
  misc_feature 1..23: note = chr1:158748794-158748817
  misc_feature 1..23: note = hypo
  source 1..23: mol_type = genomic DNA
cgagactgcgtctcaaaaaaaaa

SEQ ID NO: 14290 - DNA, 169 bp, Homo sapiens
  misc_feature 1..169: note = chr1:159883486-159883655
  misc_feature 1..169: note = hypo
  source 1..169: mol_type = genomic DNA
acatattattctccacggaaccatgtacaaacacacagatgcctacacacgcaggacaaacacctctctgcacccattatccccaatccttggtaaacacatactcataggcagcctccacacacagtcacagattatctcctcccacctgcaccgcaccccaccccct

SEQ ID NO: 14291 - DNA, 30 bp, Homo sapiens
  misc_feature 1..30: note = chr1:159932029-159932059
  misc_feature 1..30: note = hypo
  source 1..30: mol_type = genomic DNA
tattgccaatgatttcgttttaagagtgga

SEQ ID NO: 14292 - DNA, 26 bp, Homo sapiens
  misc_feature 1..26: note = chr1:160451209-160451235
  misc_feature 1..26: note = hypo
  source 1..26: mol_type = genomic DNA
ctgttcctattcggccatcttggctg

SEQ ID NO: 14293 - DNA, 38 bp, Homo sapiens; identical to SEQ ID NO: 4953
  misc_feature 1..38: note = chr1:160693915-160693953
  misc_feature 1..38: note = hypo
  source 1..38: mol_type = genomic DNA

SEQ ID NO: 14294 - DNA, 30 bp, Homo sapiens
  misc_feature 1..30: note = chr1:160853373-160853403
  misc_feature 1..30: note = hypo
  source 1..30: mol_type = genomic DNA
ctatcactagtcccacgctcattccaccac

SEQ ID NO: 14295 - DNA, 35 bp, Homo sapiens
  misc_feature 1..35: note = chr1:160880659-160880694
  misc_feature 1..35: note = hypo
  source 1..35: mol_type = genomic DNA
ttctactcttgagtgcgagttaaagaaacaactta

SEQ ID NO: 14296 - DNA, 36 bp, Homo sapiens
  misc_feature 1..36: note = chr1:160992336-160992372
  misc_feature 1..36: note = hypo
  source 1..36: mol_type = genomic DNA
cttaatagtcttggccgggtgcgtggcacacgccta

SEQ ID NO: 14297 - DNA, 57 bp, Homo sapiens
  misc_feature 1..57: note = chr1:161007705-161007762
  misc_feature 1..57: note = hypo
  source 1..57: mol_type = genomic DNA
gtgtatccaagactccgggccagctgcgtggcctggaggccccgcttgcccatctga

SEQ ID NO: 14298 - DNA, 28 bp, Homo sapiens
  misc_feature 1..28: note = chr1:161367768-161367796
  misc_feature 1..28: note = hypo
  source 1..28: mol_type = genomic DNA
gcgtgaaacaccgcgcctggccaaaaaa

SEQ ID NO: 14299 - DNA, 52 bp, Homo sapiens
  misc_feature 1..52: note = chr1:161442419-161442471
  misc_feature 1..52: note = hypo
  source 1..52: mol_type = genomic DNA
cggcgggcagtctctcgaccctgggcggcagagaaagcgcaagatgggacga

SEQ ID NO: 14300 - DNA, 36 bp, Homo sapiens
  misc_feature 1..36: note = chr1:161471743-161471779
  misc_feature 1..36: note = hypo
  source 1..36: mol_type = genomic DNA
gcttgagccaccgcacctggccggttctcttgaatc

SEQ ID NO: 14301 - DNA, 30 bp, Homo sapiens
  misc_feature 1..30: note = chr1:161913509-161913539
  misc_feature 1..30: note = hypo
  source 1..30: mol_type = genomic DNA
aatcaccttttcacacgcacacaaaaagcc

SEQ ID NO: 14302 - DNA, 19 bp, Homo sapiens
  misc_feature 1..19: note = chr1:167789093-167789112
  misc_feature 1..19: note = hypo
  source 1..19: mol_type = genomic DNA
cgcccggcatgattttcta

SEQ ID NO: 14303 - DNA, 95 bp, Homo sapiens
  misc_feature 1..95: note = chr1:167823347-167823442
  misc_feature 1..95: note = hypo
  source 1..95: mol_type = genomic DNA
atttaggcgtgagccaccgcgcccggccatagttagacaatctttagccgagtccagtgagtcccaggcaatgttaagttcgcttacaatctgga

SEQ ID NO: 14304 - DNA, 30 bp, Homo sapiens
  misc_feature 1..30: note = chr1:168150766-168150796
  misc_feature 1..30: note = hypo
  source 1..30: mol_type = genomic DNA
tctgtgacaaattgccgattggtgcaaaag

SEQ ID NO: 14305 - DNA, 18 bp, Homo sapiens
  misc_feature 1..18: note = chr1:171625525-171625543
  misc_feature 1..18: note = hypo
  source 1..18: mol_type = genomic DNA
acactgacccttggccgg

SEQ ID NO: 14306 - DNA, 30 bp, Homo sapiens
  misc_feature 1..30: note = chr1:173993077-173993107
  misc_feature 1..30: note = hypo
  source 1..30: mol_type = genomic DNA
tttcaattaaaaatacgttaaaggacagat

SEQ ID NO: 14307 - DNA, 36 bp, Homo sapiens
  misc_feature 1..36: note = chr1:175365715-175365751
  misc_feature 1..36: note = hypo
  source 1..36: mol_type = genomic DNA
tgttgctaatgacagcgtagacgctgatgttgtagg

SEQ ID NO: 14308 - DNA, 78 bp, Homo sapiens
  misc_feature 1..78: note = chr1:175372494-175372572
  misc_feature 1..78: note = hypo
  source 1..78: mol_type = genomic DNA
cacagacacactccccgtccacgcagagcccccgggagctgcagtctgttgggcaccggagttcggaacagtcatccc

SEQ ID NO: 14309 - DNA, 30 bp, Homo sapiens
  misc_feature 1..30: note = chr1:179849955-179849985
  misc_feature 1..30: note = hypo
  source 1..30: mol_type = genomic DNA
aacatagtacacagtcgggcagggtggctc

SEQ ID NO: 14310 - DNA, 30 bp, Homo sapiens
  misc_feature 1..30: note = chr1:180235694-180235724
  misc_feature 1..30: note = hypo
  source 1..30: mol_type = genomic DNA
gtgcaaggaagactacgagacagccaagca

SEQ ID NO: 14311 - DNA, 150 bp, Homo sapiens
  misc_feature 1..150: note = chr1:183129382-183129532
  misc_feature 1..150: note = hypo
  source 1..150: mol_type = genomic DNA
caaaggaagaaagagcgcctgaagcatgtgttcaccgggcaactatgaatggcttgactgggtggagccttcagtatctttttagttaagccttttagtctcaaaaatggaagaggcaaagctcaattcttaaagatcacttcttttttt

SEQ ID NO: 14312 - DNA, 199 bp, Homo sapiens; identical to SEQ ID NO: 1543
  misc_feature 1..199: note = chr1:195732322-195732521
  misc_feature 1..199: note = hypo
  source 1..199: mol_type = genomic DNA

SEQ ID NO: 14313 - DNA, 30 bp, Homo sapiens
  misc_feature 1..30: note = chr1:200519350-200519380
  misc_feature 1..30: note = hypo
  source 1..30: mol_type = genomic DNA
ataagccactgcacccgacttgagtttagt

SEQ ID NO: 14314 - DNA, 30 bp, Homo sapiens
  misc_feature 1..30: note = chr1:200864028-200864058
  misc_feature 1..30: note = hypo
  source 1..30: mol_type = genomic DNA
gcagcctgggagggacggcaaggtaggcag

SEQ ID NO: 14315 - DNA, 30 bp, Homo sapiens
  misc_feature 1..30: note = chr1:201244396-201244426
  misc_feature 1..30: note = hypo
  source 1..30: mol_type = genomic DNA
atggggtaatgcagacgggaggctctgcca

SEQ ID NO: 14316 - DNA, 30 bp, Homo sapiens
  misc_feature 1..30: note = chr1:201797425-201797455
  misc_feature 1..30: note = hypo
  source 1..30: mol_type = genomic DNA
tgctaggattagaggcgtgagccactgcgc

SEQ ID NO: 14317 - DNA, 42 bp, Homo sapiens
  misc_feature 1..42: note = chr1:201982442-201982484
  misc_feature 1..42: note = hypo
  source 1..42: mol_type = genomic DNA
cgtgggtcctccctgcgccgggctgagcggcttcctggggca

SEQ ID NO: 14318 - DNA, 45 bp, Homo sapiens
  misc_feature 1..45: note = chr1:201983186-201983231
  misc_feature 1..45: note = hypo
  source 1..45: mol_type = genomic DNA
ggacatggggacaggcgctcacactcccaccgccctctttctggc

SEQ ID NO: 14319 - DNA, 36 bp, Homo sapiens; identical to SEQ ID NO: 4956
  misc_feature 1..36: note = chr1:202081768-202081804
  misc_feature 1..36: note = hypo
  source 1..36: mol_type = genomic DNA

SEQ ID NO: 14320 - DNA, 132 bp, Homo sapiens
  misc_feature 1..132: note = chr1:202312002-202312134
  misc_feature 1..132: note = hypo
  source 1..132: mol_type = genomic DNA
taaaccatcttccaacgctagatgcatggtactttctgaacaaggaagaacctgtttatagttaagccaaccttaacttctcagagctgcctctgccagaggccaatgcttcatgagcgctgaaagatggca

SEQ ID NO: 14321 - DNA, 30 bp, Homo sapiens
  misc_feature 1..30: note = chr1:202995301-202995331
  misc_feature 1..30: note = hypo
  source 1..30: mol_type = genomic DNA
tgacaattacaaggccgagactaaggccaa

SEQ ID NO: 14322 - DNA, 62 bp, Homo sapiens
  misc_feature 1..62: note = chr1:204588321-204588383
  misc_feature 1..62: note = hypo
  source 1..62: mol_type = genomic DNA
ctaggaacttgagcccgggcacctgttccagtgcccgcctgggcacccgggccagctggttg

SEQ ID NO: 14323 - DNA, 46 bp, Homo sapiens
  misc_feature 1..46: note = chr1:204721217-204721263
  misc_feature 1..46: note = hypo
  source 1..46: mol_type = genomic DNA
tgtagccgcccaacccgcagctacagacccacgcctcctgctgtat

SEQ ID NO: 14324 - DNA, 104 bp, Homo sapiens
  misc_feature 1..104: note = chr1:205310685-205310789
  misc_feature 1..104: note = hypo
  source 1..104: mol_type = genomic DNA
actacaagcctgggtcgacagcaccggctcagtgccttctgttaccctattccatcaccctaattgccacctgttactgaataatctttgtttctttttctttt

SEQ ID NO: 14325 - DNA, 30 bp, Homo sapiens
  misc_feature 1..30: note = chr1:207656486-207656516
  misc_feature 1..30: note = hypo
  source 1..30: mol_type = genomic DNA
actctcaggtagctccgagtggggagatga

SEQ ID NO: 14326 - DNA, 77 bp, Homo sapiens
  misc_feature 1..77: note = chr1:207991495-207991572
  misc_feature 1..77: note = hypo
  source 1..77: mol_type = genomic DNA
tgtccctctgccccacgctccagcagagggggtagagaagagaaaggggaggacggtttgtccgcattcagtggcag

SEQ ID NO: 14327 - DNA, 175 bp, Homo sapiens
  misc_feature 1..175: note = chr1:209601406-209601581
  misc_feature 1..175: note = hypo
  source 1..175: mol_type = genomic DNA
agttgcgcatggaagcgggggtggggtaaaataatcaagtttatagaccgccctctttaaagttactaatgagcttgccttctctttccttaatttcccctcgcagtgtggtcttttccccacccccagacatgaaagggaagcaggtcacaaagcctttcggattataaaagaa

SEQ ID NO: 14328 - DNA, 154 bp, Homo sapiens
  misc_feature 1..154: note = chr1:209999773-209999927
  misc_feature 1..154: note = hypo
  source 1..154: mol_type = genomic DNA
agaactgacaagaatcgcattctaatggttttattacaacttctatggtgtgacacagtatcagggaaaacccaaatttcccacagtagcactccaatagcagagctattattttgcttctcatttctctcattttggacgctcctgttttacc

SEQ ID NO: 14329 - DNA, 31 bp, Homo sapiens; identical to SEQ ID NO: 4957
  misc_feature 1..31: note = chr1:212963970-212964001
  misc_feature 1..31: note = hypo
  source 1..31: mol_type = genomic DNA

SEQ ID NO: 14330 - DNA, 84 bp, Homo sapiens; identical to SEQ ID NO: 4958
  misc_feature 1..84: note = chr1:213189757-213189841
  misc_feature 1..84: note = hypo
  source 1..84: mol_type = genomic DNA

SEQ ID NO: 14331 - DNA, 20 bp, Homo sapiens
  misc_feature 1..20: note = chr1:223907539-223907559
  misc_feature 1..20: note = hypo
  source 1..20: mol_type = genomic DNA
gcgcgcgtataatgcagtat

SEQ ID NO: 14332 - DNA, 30 bp, Homo sapiens
  misc_feature 1..30: note = chr1:224267844-224267874
  misc_feature 1..30: note = hypo
  source 1..30: mol_type = genomic DNA
aattagaaggcttcccggagaagagtagat

SEQ ID NO: 14333 - DNA, 121 bp, Homo sapiens
  misc_feature 1..121: note = chr1:226062878-226062999
  misc_feature 1..121: note = hypo
  source 1..121: mol_type = genomic DNA
ggcagcaaggcaccacgagaacctgtgctcgggctggcttggcctccgtaagctgggacacctcagcaagcttgtgtccaatggcaacctcagggctggactaagccgcttagctctagac

SEQ ID NO: 14334 - DNA, 93 bp, Homo sapiens
  misc_feature 1..93: note = chr1:226163122-226163215
  misc_feature 1..93: note = hypo
  source 1..93: mol_type = genomic DNA
acaaaaataaagacatggttgtatacacagacactgaaattcctctagcggaaaacaacagcaaatgattaaagataacgttgtttgttgagg

SEQ ID NO: 14335 - DNA, 42 bp, Homo sapiens
  misc_feature 1..42: note = chr1:227750829-227750871
  misc_feature 1..42: note = hypo
  source 1..42: mol_type = genomic DNA
ggacagttccacaggcgcaccggaatgcgcctcccctttcca

SEQ ID NO: 14336 - DNA, 30 bp, Homo sapiens
  misc_feature 1..30: note = chr1:227921541-227921571
  misc_feature 1..30: note = hypo
  source 1..30: mol_type = genomic DNA
ctgggcctcccagtccgttctgtcaccagg

SEQ ID NO: 14337 - DNA, 284 bp, Homo sapiens
  misc_feature 1..284: note = chr1:228528888-228529172
  misc_feature 1..284: note = hypo
  source 1..284: mol_type = genomic DNA
atctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggaggg

SEQ ID NO: 14338 - DNA, 30 bp, Homo sapiens
  misc_feature 1..30: note = chr1:228536492-228536522
  misc_feature 1..30: note = hypo
  source 1..30: mol_type = genomic DNA
atacaaatcataagtcggtgctggttgtga

SEQ ID NO: 14339 - DNA, 30 bp, Homo sapiens
  misc_feature 1..30: note = chr1:228552593-228552623
  misc_feature 1..30: note = hypo
  source 1..30: mol_type = genomic DNA
cctgtggcaggcatccgtcccactcgtcca

SEQ ID NO: 14340 - DNA, 539 bp, Homo sapiens
  misc_feature 1..539: note = chr1:228558699-228559238
  misc_feature 1..539: note = hypo
  source 1..539: mol_type = genomic DNA
ctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatgga

SEQ ID NO: 14341 - DNA, 30 bp, Homo sapiens
  misc_feature 1..30: note = chr1:228919370-228919400
  misc_feature 1..30: note = hypo
  source 1..30: mol_type = genomic DNA
ccactgcacacagaccgggtgctgggtatt

SEQ ID NO: 14342 - DNA, 30 bp, Homo sapiens
  misc_feature 1..30: note = chr1:230404233-230404263
  misc_feature 1..30: note = hypo
  source 1..30: mol_type = genomic DNA
gcctctgctggaaagcgacacaccttacgc

SEQ ID NO: 14343 - DNA, 53 bp, Homo sapiens
  misc_feature 1..53: note = chr1:230453632-230453685
  misc_feature 1..53: note = hypo
  source 1..53: mol_type = genomic DNA
cacaatcaagtctcccgcaggagtctcctcattacgaccgtgtatacatgggt

SEQ ID NO: 14344 - DNA, 30 bp, Homo sapiens
  misc_feature 1..30: note = chr1:231163109-231163139
  misc_feature 1..30: note = hypo
  source 1..30: mol_type = genomic DNA
aatacagcgcagccccgcacacacctatta

SEQ ID NO: 14345 - DNA, 23 bp, Homo sapiens
  misc_feature 1..23: note = chr1:231475814-231475837
  misc_feature 1..23: note = hypo
  source 1..23: mol_type = genomic DNA
aaggcttctaggggccgggcacg

SEQ ID NO: 14346 - DNA, 30 bp, Homo sapiens
  misc_feature 1..30: note = chr1:234621166-234621196
  misc_feature 1..30: note = hypo
  source 1..30: mol_type = genomic DNA
cttcagtctagctcacgtatcccttacacc

SEQ ID NO: 14347 - DNA, 30 bp, Homo sapiens
  misc_feature 1..30: note = chr1:234882549-234882579
  misc_feature 1..30: note = hypo
  source 1..30: mol_type = genomic DNA
tgtgtttctcatggtcggtccctgactcat

SEQ ID NO: 14348 - DNA, 30 bp, Homo sapiens
  misc_feature 1..30: note = chr1:234959409-234959439
  misc_feature 1..30: note = hypo
  source 1..30: mol_type = genomic DNA
tgagtcactgtgcagcgagggctggagggc

SEQ ID NO: 14349 - DNA, 30 bp, Homo sapiens
  misc_feature 1..30: note = chr1:235267149-235267179
  misc_feature 1..30: note = hypo
  source 1..30: mol_type = genomic DNA
ttaagtgccccagtacgctgcacatttaga

SEQ ID NO: 14350 - DNA, 96 bp, Homo sapiens
  misc_feature 1..96: note = chr1:235325416-235325512
  misc_feature 1..96: note = hypo
  source 1..96: mol_type = genomic DNA
agaaaagaaattagacgggcaccttcgcgctcggcgcctgtagtcccagcactttgagaggctcgggcaagaggatcccttgagccctggaaggtc

SEQ ID NO: 14351 - DNA, 169 bp, Homo sapiens
  misc_feature 1..169: note = chr1:240463082-240463251
  misc_feature 1..169: note = hypo
  source 1..169: mol_type = genomic DNA
agataatgcatactgcgatgaacccaagatggacctaagattacagaactagtagtagtttattttttggtgcacaaagcggaacaagtttttccatgttttcagttgctaatagactgcatttttacgcaagactagtaggaataaggtggcgcgctgtatgaaggca

SEQ ID NO: 14352 - DNA, 177 bp, Homo sapiens
  misc_feature 1..177: note = chr1:242286750-242286927
  misc_feature 1..177: note = hypo
  source 1..177: mol_type = genomic DNA
aggaggacatcccatcgcagagcacactcacacacacattcacactcgcttacactgggaccactcacacacacattcacactcgctcacactgggaccacacagatctgccagttcattccacttgcacagctctgagatgtgggaggaaacagcagtacccggcaaaagccaaca

SEQ ID NO: 14353 - DNA, 30 bp, Homo sapiens
  misc_feature 1..30: note = chr1:243057075-243057105
  misc_feature 1..30: note = hypo
  source 1..30: mol_type = genomic DNA
ggtgcggttaccgctcgctcacacctgtaa

SEQ ID NO: 14354 - DNA, 30 bp, Homo sapiens
  misc_feature 1..30: note = chr1:244143029-244143059
  misc_feature 1..30: note = hypo
  source 1..30: mol_type = genomic DNA
gacggaaggtacccacgagggtggcgggtg

SEQ ID NO: 14355 - DNA, 143 bp, Homo sapiens; identical to SEQ ID NO: 4959
  misc_feature 1..143: note = chr1:245135719-245135862
  misc_feature 1..143: note = hypo
  source 1..143: mol_type = genomic DNA

SEQ ID NO: 14356 - DNA, 197 bp, Homo sapiens
  misc_feature 1..197: note = chr1:245772643-245772840
  misc_feature 1..197: note = hypo
  source 1..197: mol_type = genomic DNA
cttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgctt

SEQ ID NO: 14357 - DNA, 30 bp, Homo sapiens
  misc_feature 1..30: note = chr1:245986707-245986737
  misc_feature 1..30: note = hypo
  source 1..30: mol_type = genomic DNA
tgcaccttgggaaggcgatgaaatgaaaga

SEQ ID NO: 14358 - DNA, 30 bp, Homo sapiens
  misc_feature 1..30: note = chr1:246172269-246172299
  misc_feature 1..30: note = hypo
  source 1..30: mol_type = genomic DNA
accgcttgctagcagcgtggccttgggcaa

SEQ ID NO: 14359 - DNA, 30 bp, Homo sapiens
  misc_feature 1..30: note = chr1:247589929-247589959
  misc_feature 1..30: note = hypo
  source 1..30: mol_type = genomic DNA
gactgcccacagggccgcagtggtggtgaa

SEQ ID NO: 14360 - DNA, 172 bp, Homo sapiens
  misc_feature 1..172: note = chr1:247709336-247709508
  misc_feature 1..172: note = hypo
  source 1..172: mol_type = genomic DNA
ggtagcataaatgtacgcatatgtccaaactcatcaaattatgtacattaattatattcacgttcttttatatcaatatatcaacaaagctaggaaagaaagaaataaatttttgtttgttcgttttgttttgttttgtctaatgatgggacggtttcgctctgttgctcag

SEQ ID NO: 14361 - DNA, 180 bp, Homo sapiens
  misc_feature 1..180: note = chr1:247752018-247752198
  misc_feature 1..180: note = hypo
  source 1..180: mol_type = genomic DNA
gtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcat

SEQ ID NO: 14362 - DNA, 30 bp, Homo sapiens
  misc_feature 1..30: note = chr1:248028015-248028045
  misc_feature 1..30: note = hypo
  source 1..30: mol_type = genomic DNA
gaaatgcagaggcagcgcttcagattggag

SEQ ID NO: 14363 - DNA, 47 bp, Homo sapiens
  misc_feature 1..47: note = chr1:248074880-248074927
  misc_feature 1..47: note = hypo
  source 1..47: mol_type = genomic DNA
gcagagggtgtacaccgcctctgtaatatccacgggggaaaaggatg

SEQ ID NO: 14364 - DNA, 87 bp, Homo sapiens
  misc_feature 1..87: note = chr1:248099843-248099930
  misc_feature 1..87: note = hypo
  source 1..87: mol_type = genomic DNA
tcactgacttctcatcgctcctgtgctcgctgtagacggtgtttaactcagaatccacatgcaggatgttctcggttttcaggtgtg

SEQ ID NO: 14365 - DNA, 151 bp, Homo sapiens
  misc_feature 1..151: note = chr1:248328690-248328841
  misc_feature 1..151: note = hypo
  source 1..151: mol_type = genomic DNA
gctccgtctgagacccgtgctaggctcgctctgtccctgcgttccctcgcctctctctccagttgtttttcccattctcacaccagcactgcaccaaggtgagaggagccccgctggaaaggaaacattcggactccggtttcagcacctc

SEQ ID NO: 14366 - DNA, 100 bp, Homo sapiens
  misc_feature 1..100: note = chr2:314569-314669
  misc_feature 1..100: note = hypo
  source 1..100: mol_type = genomic DNA
ctacgctcacagctgcggacgtgcacgcgctgccagcaactgcaccgagcactcagcgcacacctgctcccacgcgccacgcactcgtgcaggtgccggg

SEQ ID NO: 14367 - DNA, 30 bp, Homo sapiens
  misc_feature 1..30: note = chr2:484928-484958
  misc_feature 1..30: note = hypo
  source 1..30: mol_type = genomic DNA
tgctgagactgcaggcgcttcatggcgcgt

SEQ ID NO: 14368 - DNA, 44 bp, Homo sapiens
  misc_feature 1..44: note = chr2:496214-496258
  misc_feature 1..44: note = hypo
  source 1..44: mol_type = genomic DNA
gaagctacaggaggccgagcggctgttgacgcccaggaccgtgg

SEQ ID NO: 14369 - DNA, 61 bp, Homo sapiens
  misc_feature 1..61: note = chr2:720836-720897
  misc_feature 1..61: note = hypo
  source 1..61: mol_type = genomic DNA
ctcagtgcttctgtgcgtgactcagtgactttggcaacgcggccgccgacaaactcacatt

SEQ ID NO: 14370 - DNA, 30 bp, Homo sapiens
  misc_feature 1..30: note = chr2:1893031-1893061
  misc_feature 1..30: note = hypo
  source 1..30: mol_type = genomic DNA
tcctcgtctatcctccggggtttcattttg

SEQ ID NO: 14371 - DNA, 189 bp, Homo sapiens
  misc_feature 1..189: note = chr2:2522670-2522859
  misc_feature 1..189: note = hypo
  source 1..189: mol_type = genomic DNA
ttcaagtcccagctccgccactgctgaggaactggctcttaggaaagtcattgaaacttcagcttcatgaagttcacatggaaaacagaaatagccgcatctattgctgtaaggctgctgtgaaagtttaagcctgtcgtgcatacagtggcccttggcatgcaccaaacctgccggtggaaacacagt

SEQ ID NO: 14372 - DNA, 64 bp, Homo sapiens
  misc_feature 1..64: note = chr2:2725048-2725112
  misc_feature 1..64: note = hypo
  source 1..64: mol_type = genomic DNA
tgcatctccacaccccggccatgccatcggcacctgcacctccacaccccggccacgccaccag

SEQ ID NO: 14373 - DNA, 30 bp, Homo sapiens
  misc_feature 1..30: note = chr2:3331786-3331816
  misc_feature 1..30: note = hypo
  source 1..30: mol_type = genomic DNA
gtaaaaaagagctcccgatgtgtagacaag

SEQ ID NO: 14374 - DNA, 61 bp, Homo sapiens
  misc_feature 1..61: note = chr2:3833825-3833886
  misc_feature 1..61: note = hypo
  source 1..61: mol_type = genomic DNA
tgtcccgcctgtgcacggaacctctgatgtggatgtttcccgcccccgccctccacgtgca

SEQ ID NO: 14375 - DNA, 57 bp, Homo sapiens
  misc_feature 1..57: note = chr2:5704308-5704365
  misc_feature 1..57: note = hypo
  source 1..57: mol_type = genomic DNA
cacctgtgtgacacccgggtactccaccacctgtgcgacacccgggcactccaccac

SEQ ID NO: 14376 - DNA, 30 bp, Homo sapiens
  misc_feature 1..30: note = chr2:7036178-7036208
  misc_feature 1..30: note = hypo
  source 1..30: mol_type = genomic DNA
tgattttctgctgcacgtggcatctgatta

SEQ ID NO: 14377 - DNA, 272 bp, Homo sapiens
  misc_feature 1..272: note = chr2:7172487-7172759
  misc_feature 1..272: note = hypo
  source 1..272: mol_type = genomic DNA
ccttgcagctctgctcgaatccgcgccccttgcagctctgctctggctgctgtgacaaagcgctgcagactgggtggctcagaacagcagaaatgtattggctcagtcctggagctcagaattctgaaatcgaggtgtcagcagggccctgcctgctctgaaacctgtaggagagtccctccggccttgtccagcttctgtggttcgccagccatctgcggcattcctggacagatcgatgcgtcactgcaatcctccgtcttcctccggct

SEQ ID NO: 14378 - DNA, 171 bp, Homo sapiens
  misc_feature 1..171: note = chr2:8833973-8834144
  misc_feature 1..171: note = hypo
  source 1..171: mol_type = genomic DNA
ctctctctgagagctcggggggtttctgtctcctgacggggccctgactggtaccccaggctccatgagagcaccgtggacaacaggagcagccgaacacgcagaatctgcgggaaggggaatcgggcagtgggtgcggcccgtgcaaaggcccggcggcagcagccatcc

SEQ ID NO: 14379 - DNA, 30 bp, Homo sapiens
  misc_feature 1..30: note = chr2:8834800-8834830
  misc_feature 1..30: note = hypo
  source 1..30: mol_type = genomic DNA
gcaacggaaattattcgtagtaattattaa

SEQ ID NO: 14380 - DNA, 24 bp, Homo sapiens
  misc_feature 1..24: note = chr2:8835577-8835601
  misc_feature 1..24: note = hypo
  source 1..24: mol_type = genomic DNA
gattccaggcgtgaccccctgcgc

SEQ ID NO: 14381 - DNA, 92 bp, Homo sapiens
  misc_feature 1..92: note = chr2:8978147-8978239
  misc_feature 1..92: note = hypo
  source 1..92: mol_type = genomic DNA
cttgctgccaacaagcgtcaatcttgatttttgaaaaggtccaaggatgattacgacgtgcgtaggttgcgaaccatcgaaaagcacccacc

SEQ ID NO: 14382 - DNA, 30 bp, Homo sapiens; identical to SEQ ID NO: 4960
  misc_feature 1..30: note = chr2:9134404-9134434
  misc_feature 1..30: note = hypo
  source 1..30: mol_type = genomic DNA

SEQ ID NO: 14383 - DNA, 180 bp, Homo sapiens
  misc_feature 1..180: note = chr2:9352635-9352815
  misc_feature 1..180: note = hypo
  source 1..180: mol_type = genomic DNA
aggtggtggccagctcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatga

SEQ ID NO: 14384 - DNA, 420 bp, Homo sapiens; identical to SEQ ID NO: 4961
  misc_feature 1..420: note = chr2:10153023-10153443
  misc_feature 1..420: note = hypo
  source 1..420: mol_type = genomic DNA

SEQ ID NO: 14385 - DNA, 240 bp, Homo sapiens; identical to SEQ ID NO: 4962
  misc_feature 1..240: note = chr2:10153898-10154138
  misc_feature 1..240: note = hypo
  source 1..240: mol_type = genomic DNA

SEQ ID NO: 14386 - DNA, 120 bp, Homo sapiens; identical to SEQ ID NO: 4963
  misc_feature 1..120: note = chr2:10154318-10154438
  misc_feature 1..120: note = hypo
  source 1..120: mol_type = genomic DNA

SEQ ID NO: 14387 - DNA, 120 bp, Homo sapiens; identical to SEQ ID NO: 4964
  misc_feature 1..120: note = chr2:10154918-10155038
  misc_feature 1..120: note = hypo
  source 1..120: mol_type = genomic DNA

SEQ ID NO: 14388 - DNA, 80 bp, Homo sapiens; identical to SEQ ID NO: 1544
  misc_feature 1..80: note = chr2:10156306-10156386
  misc_feature 1..80: note = hypo
  source 1..80: mol_type = genomic DNA

SEQ ID NO: 14389 - DNA, 77 bp, Homo sapiens
  misc_feature 1..77: note = chr2:10344641-10344718
  misc_feature 1..77: note = hypo
  source 1..77: mol_type = genomic DNA
cactggctgtgaccccgccagccctgctcagcgctgtgcccagccctgggtgcagggaggtgcggtttgctctcaga

SEQ ID NO: 14390 - DNA, 136 bp, Homo sapiens
  misc_feature 1..136: note = chr2:10924927-10925063
  misc_feature 1..136: note = hypo
  source 1..136: mol_type = genomic DNA
ctcttaaaaggcccacgggtgcaccagggctgaggtctgatgggaaggacttgactccaggtgcagagatgcacaggctcaagagagtaaaccaggactgctgcccgcacagcttccctcccgggcactcacctcg

SEQ ID NO: 14391 - DNA, 30 bp, Homo sapiens
  misc_feature 1..30: note = chr2:11538637-11538667
  misc_feature 1..30: note = hypo
  source 1..30: mol_type = genomic DNA
cagtcaatagttctccgttctggaaaccga

SEQ ID NO: 14392 - DNA, 30 bp, Homo sapiens
  misc_feature 1..30: note = chr2:18453289-18453319
  misc_feature 1..30: note = hypo
  source 1..30: mol_type = genomic DNA
cgtgtagcaagaggccggggtctggtctgc

SEQ ID NO: 14393 - DNA, 23 bp, Homo sapiens
  misc_feature 1..23: note = chr2:20253274-20253297
  misc_feature 1..23: note = hypo
  source 1..23: mol_type = genomic DNA
taagatcaggggagccgggcgcg

SEQ ID NO: 14394 - DNA, 42 bp, Homo sapiens
  misc_feature 1..42: note = chr2:20431336-20431378
  misc_feature 1..42: note = hypo
  source 1..42: mol_type = genomic DNA
tacgtaaacagctagcgtcagaggggccgaatcagtgtgtaa

SEQ ID NO: 14395 - DNA, 142 bp, Homo sapiens
  misc_feature 1..142: note = chr2:20432683-20432825
  misc_feature 1..142: note = hypo
  source 1..142: mol_type = genomic DNA
ggagattctaaagcccgcaggggagaatctgggctgggctctgaagagattcctgagctcaccgcagccaggatgtataagtcatagtgttatgtcagcgctcatacctgtgtgtagcacatgtgcacgcaccttcacgcac

SEQ ID NO: 14396 - DNA, 30 bp, Homo sapiens
  misc_feature 1..30: note = chr2:20456198-20456228
  misc_feature 1..30: note = hypo
  source 1..30: mol_type = genomic DNA
tgtatgttgaaacaacgtagtgatgctgaa

SEQ ID NO: 14397 - DNA, 39 bp, Homo sapiens; identical to SEQ ID NO: 1545
  misc_feature 1..39: note = chr2:20642609-20642648
  misc_feature 1..39: note = hypo
  source 1..39: mol_type = genomic DNA

SEQ ID NO: 14398 - DNA, 30 bp, Homo sapiens
  misc_feature 1..30: note = chr2:25241776-25241806
  misc_feature 1..30: note = hypo
  source 1..30: mol_type = genomic DNA
gacttttcaactttacgatggtgcaaaagc

SEQ ID NO: 14399 - DNA, 42 bp, Homo sapiens
  misc_feature 1..42: note = chr2:27090590-27090632
  misc_feature 1..42: note = hypo
  source 1..42: mol_type = genomic DNA
gggattacaggcgtgagccaccgcgcccggcccccaattgtt

SEQ ID NO: 14400 - DNA, 141 bp, Homo sapiens
  misc_feature 1..141: note = chr2:27887525-27887666
  misc_feature 1..141: note = hypo
  source 1..141: mol_type = genomic DNA
gaatctcccactcagcgattacgaaagtgaaggaatcaagtctggcctatcatcttcagacggctgtacacattgctatatttctgaaagtcatgttcacaatcccgaactctaaaataacttgtttggccaggcgcggtg

SEQ ID NO: 14401 - DNA, 22 bp, Homo sapiens
  misc_feature 1..22: note = chr2:32263988-32264010
  misc_feature 1..22: note = hypo
  source 1..22: mol_type = genomic DNA
tgataggcgtgggccatcgcgc

SEQ ID NO: 14402 - DNA, 40 bp, Homo sapiens
  misc_feature 1..40: note = chr2:32504305-32504345
  misc_feature 1..40: note = hypo
  source 1..40: mol_type = genomic DNA
ctgggattaccggcgtgagccaccgcgccccggccatttt

SEQ ID NO: 14403 - DNA, 27 bp, Homo sapiens
  misc_feature 1..27: note = chr2:32551637-32551664
  misc_feature 1..27: note = hypo
  source 1..27: mol_type = genomic DNA
tgtgagccaccgcgcccagcctaccct

SEQ ID NO: 14404 - DNA, 45 bp, Homo sapiens
  misc_feature 1..45: note = chr2:33313226-33313271
  misc_feature 1..45: note = hypo
  source 1..45: mol_type = genomic DNA
atatggacagtgagccgggcgcggtggctcacgcctgtaatccca

SEQ ID NO: 14405 - DNA, 34 bp, Homo sapiens
  misc_feature 1..34: note = chr2:36824207-36824241
  misc_feature 1..34: note = hypo
  source 1..34: mol_type = genomic DNA
ccccaccagaccatgcgatcgttaccatcagtaa

SEQ ID NO: 14406 - DNA, 189 bp, Homo sapiens; identical to SEQ ID NO: 4967
  misc_feature 1..189: note = chr2:43408168-43408357
  misc_feature 1..189: note = hypo
  source 1..189: mol_type = genomic DNA

SEQ ID NO: 14407 - DNA, 39 bp, Homo sapiens
  misc_feature 1..39: note = chr2:43412683-43412722
  misc_feature 1..39: note = hypo
  source 1..39: mol_type = genomic DNA
ttagaaaaaggtggccgggcgtggtgactcacgcctata

SEQ ID NO: 14408 - DNA, 40 bp, Homo sapiens
  misc_feature 1..40: note = chr2:43824353-43824393
  misc_feature 1..40: note = hypo
  source 1..40: mol_type = genomic DNA
ctgggattacaggcgtgagccatggcgcccggaccgtaat

SEQ ID NO: 14409 - DNA, 34 bp, Homo sapiens
  misc_feature 1..34: note = chr2:44224213-44224247
  misc_feature 1..34: note = hypo
  source 1..34: mol_type = genomic DNA
caaaacaaaaaaaccacgtcgctgccttcacagg

SEQ ID NO: 14410 - DNA, 240 bp, Homo sapiens; identical to SEQ ID NO: 1546
  misc_feature 1..240: note = chr2:47598278-47598518
  misc_feature 1..240: note = hypo
  source 1..240: mol_type = genomic DNA

SEQ ID NO: 14411 - DNA, 42 bp, Homo sapiens; identical to SEQ ID NO: 1547
  misc_feature 1..42: note = chr2:47598578-47598620
  misc_feature 1..42: note = hypo
  source 1..42: mol_type = genomic DNA

SEQ ID NO: 14412 - DNA, 36 bp, Homo sapiens
  misc_feature 1..36: note = chr2:55669245-55669281
  misc_feature 1..36: note = hypo
  source 1..36: mol_type = genomic DNA
tggagccaagatggccgaataggaacagctccggtc

SEQ ID NO: 14413 - DNA, 30 bp, Homo sapiens
  misc_feature 1..30: note = chr2:60442223-60442253
  misc_feature 1..30: note = hypo
  source 1..30: mol_type = genomic DNA
gtgggttttcttccccgaaatcattttccc

SEQ ID NO: 14414 - DNA, 110 bp, Homo sapiens
  misc_feature 1..110: note = chr2:60705907-60706017
  misc_feature 1..110: note = hypo
  source 1..110: mol_type = genomic DNA
ggcctcctcccatgacggcaagtccttctttcagaaaacaggcctctgcccggggcatgctgcagctgcttctctgcagtgcctcagcaccttcccgcctcccaggcaca

SEQ ID NO: 14415 - DNA, 30 bp, Homo sapiens
  misc_feature 1..30: note = chr2:60887794-60887824
  misc_feature 1..30: note = hypo
  source 1..30: mol_type = genomic DNA
agtctcgcctgtgcccgggagacaatgggc

SEQ ID NO: 14416 - DNA, 30 bp, Homo sapiens
  misc_feature 1..30: note = chr2:61406196-61406226
  misc_feature 1..30: note = hypo
  source 1..30: mol_type = genomic DNA
ccgcggcgagatcaacgagttgaagcaggt

SEQ ID NO: 14417 - DNA, 86 bp, Homo sapiens; identical to SEQ ID NO: 4970
  misc_feature 1..86: note = chr2:62589799-62589885
  misc_feature 1..86: note = hypo
  source 1..86: mol_type = genomic DNA

SEQ ID NO: 14418 - DNA, 76 bp, Homo sapiens
  misc_feature 1..76: note = chr2:64835557-64835633
  misc_feature 1..76: note = hypo
  source 1..76: mol_type = genomic DNA
gctggggatagaacacgggtggctacgccgggcatggtggtgcgcacctgcagtcctggctgctggagaagctgag

SEQ ID NO: 14419 - DNA, 24 bp, Homo sapiens
  misc_feature 1..24: note = chr2:67625740-67625764
  misc_feature 1..24: note = hypo
  source 1..24: mol_type = genomic DNA
tacagccaccgcgcccggccacct

SEQ ID NO: 14420 - DNA, 20 bp, Homo sapiens
  misc_feature 1..20: note = chr2:69720191-69720211
  misc_feature 1..20: note = hypo
  source 1..20: mol_type = genomic DNA
gaggcaggagaatggcgtga

SEQ ID NO: 14421 - DNA, 48 bp, Homo sapiens
  misc_feature 1..48: note = chr2:70364215-70364263
  misc_feature 1..48: note = hypo
  source 1..48: mol_type = genomic DNA
tgttttaattttctccgtagcacttgtcactatcgacatactagatag

SEQ ID NO: 14422 - DNA, 30 bp, Homo sapiens
  misc_feature 1..30: note = chr2:70367818-70367848
  misc_feature 1..30: note = hypo
  source 1..30: mol_type = genomic DNA
agacaccgtgcccagcgacaagataatttt

SEQ ID NO: 14423 - DNA, 75 bp, Homo sapiens
  misc_feature 1..75: note = chr2:72778920-72778995
  misc_feature 1..75: note = hypo
  source 1..75: mol_type = genomic DNA
ggccattaaaatcttaatagcttataaaaactagcatacacacagtgatgagatacaatgcggtcatactataat

SEQ ID NO: 14424 - DNA, 88 bp, Homo sapiens
  misc_feature 1..88: note = chr2:74010538-74010626
  misc_feature 1..88: note = hypo
  source 1..88: mol_type = genomic DNA
gtcaacgaactttgccgttcaaccaagttacaaaagaaggctctttaatcccttctttggcccttaaaagcggcagcagggccgggcg

SEQ ID NO: 14425 - DNA, 160 bp, Homo sapiens; identical to SEQ ID NO: 1549
  misc_feature 1..160: note = chr2:74454159-74454319
  misc_feature 1..160: note = hypo
  source 1..160: mol_type = genomic DNA

SEQ ID NO: 14426 - DNA, 25 bp, Homo sapiens
  misc_feature 1..25: note = chr2:74700453-74700478
  misc_feature 1..25: note = hypo
  source 1..25: mol_type = genomic DNA
tttctttttttgagacgaagttttg

SEQ ID NO: 14427 - DNA, 28 bp, Homo sapiens
  misc_feature 1..28: note = chr2:85838295-85838323
  misc_feature 1..28: note = hypo
  source 1..28: mol_type = genomic DNA
actccagcctgggcgacagagacctagt

SEQ ID NO: 14428 - DNA, 43 bp, Homo sapiens; identical to SEQ ID NO: 4973
  misc_feature 1..43: note = chr2:86423726-86423769
  misc_feature 1..43: note = hypo
  source 1..43: mol_type = genomic DNA

SEQ ID NO: 14429 - DNA, 140 bp, Homo sapiens; identical to SEQ ID NO: 4974
  misc_feature 1..140: note = chr2:88990189-88990329
  misc_feature 1..140: note = hypo
  source 1..140: mol_type = genomic DNA

SEQ ID NO: 14430 - DNA, 30 bp, Homo sapiens
  misc_feature 1..30: note = chr2:95742145-95742175
  misc_feature 1..30: note = hypo
  source 1..30: mol_type = genomic DNA
acaatcggtcgggagcggtggctcacgcct

SEQ ID NO: 14431 - DNA, 70 bp, Homo sapiens
  misc_feature 1..70: note = chr2:95941782-95941852
  misc_feature 1..70: note = hypo
  source 1..70: mol_type = genomic DNA
cggcgctgcgggggacgagtgaagacagagcacaaggcgctggcctgtgagcgcgcggccctcatggtct

SEQ ID NO: 14432 - DNA, 24 bp, Homo sapiens
  misc_feature 1..24: note = chr2:96872240-96872264
  misc_feature 1..24: note = hypo
  source 1..24: mol_type = genomic DNA
cttaaaagtggaacacggccgggc

SEQ ID NO: 14433 - DNA, 92 bp, Homo sapiens; identical to SEQ ID NO: 1550
  misc_feature 1..92: note = chr2:97427763-97427855
  misc_feature 1..92: note = hypo
  source 1..92: mol_type = genomic DNA

SEQ ID NO: 14434 - DNA, 30 bp, Homo sapiens
  misc_feature 1..30: note = chr2:97428063-97428093
  misc_feature 1..30: note = hypo
  source 1..30: mol_type = genomic DNA
gcttctataaccacccggtgcactttgtct

SEQ ID NO: 14435 - DNA, 30 bp, Homo sapiens
  misc_feature 1..30: note = chr2:98025687-98025717
  misc_feature 1..30: note = hypo
  source 1..30: mol_type = genomic DNA
gtgcttattgggccccgcttctggagaaac

SEQ ID NO: 14436 - DNA, 100 bp, Homo sapiens; identical to SEQ ID NO: 1551
  misc_feature 1..100: note = chr2:99798646-99798746
  misc_feature 1..100: note = hypo
  source 1..100: mol_type = genomic DNA

SEQ ID NO: 14437 - DNA, 28 bp, Homo sapiens
  misc_feature 1..28: note = chr2:101835069-101835097
  misc_feature 1..28: note = hypo
  source 1..28: mol_type = genomic DNA
gcatgagccaccgcgcccagcctagtca

SEQ ID NO: 14438 - DNA, 157 bp, Homo sapiens
  misc_feature 1..157: note = chr2:105972350-105972507
  misc_feature 1..157: note = hypo
  source 1..157: mol_type = genomic DNA
gccagcaaaccaatgcgtaaatgaacatacatggctgtgtttgaataaaacttttttgttaagaaaacagaccaggtgtgatgactcatgctggtaatcccagcgttttggaatgccaagatggggggaatcgcttgagcccaggagtttgagacca

SEQ ID NO: 14439 - DNA, 191 bp, Homo sapiens
  misc_feature 1..191: note = chr2:106016141-106016332
  misc_feature 1..191: note = hypo
  source 1..191: mol_type = genomic DNA
cccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtgga

SEQ ID NO: 14440 - DNA, 177 bp, Homo sapiens
  misc_feature 1..177: note = chr2:106060615-106060792
  misc_feature 1..177: note = hypo
  source 1..177: mol_type = genomic DNA
ttttaggagggagtgcgtggaccgataccattttttgtaagctgaaaagagtgtagaccaaggaaagtgttgtttttctggactggaaagtcctcagatgcagaaccagtgtgtgttggggtgcagaggatgagtggtttgtgaaccgcgttgcctaccaagcgcctgtctgcagaa

SEQ ID NO: 14441 - DNA, 30 bp, Homo sapiens
  misc_feature 1..30: note = chr2:106672847-106672877
  misc_feature 1..30: note = hypo
  source 1..30: mol_type = genomic DNA
gtctatccttagtgtcgactgttaagttgc

SEQ ID NO: 14442 - DNA, 169 bp, Homo sapiens
  misc_feature 1..169: note = chr2:106959338-106959507
  misc_feature 1..169: note = hypo
  source 1..169: mol_type = genomic DNA
acactccctgcctctcgaggactctgcttgttcctcatcacagcacggttgctctcgcacccaaggcggtgtccccccagcgcctcaccacgatcgcggcagagatctcctgcagggcgtccgggccttgggaaggcatcgccatctcccgcagcgccctcccggacta

SEQ ID NO: 14443 - DNA, 127 bp, Homo sapiens
  misc_feature 1..127: note = chr2:106959916-106960043
  misc_feature 1..127: note = hypo
  source 1..127: mol_type = genomic DNA
gggctctggatccagcggtcacggtttcactgagagggcgcctcccaggggctgctccggcccagggcagggcattgcaggggtgatgggacagccctgcttttgagaggcgcggcactctgccaag

SEQ ID NO: 14444 - DNA, 183 bp, Homo sapiens
  misc_feature 1..183: note = chr2:107460171-107460354
  misc_feature 1..183: note = hypo
  source 1..183: mol_type = genomic DNA
aaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatga

SEQ ID NO: 14445 - DNA, 30 bp, Homo sapiens
  misc_feature 1..30: note = chr2:108160895-108160925
  misc_feature 1..30: note = hypo
  source 1..30: mol_type = genomic DNA
cggtgcactgagaagcggatgtgaaactga

SEQ ID NO: 14446 - DNA, 33 bp, Homo sapiens
  misc_feature 1..33: note = chr2:109335133-109335166
  misc_feature 1..33: note = hypo
  source 1..33: mol_type = genomic DNA
ctggaaccaatcccccgccgagatgactgttta

SEQ ID NO: 14447 - DNA, 30 bp, Homo sapiens
  misc_feature 1..30: note = chr2:113013287-113013317
  misc_feature 1..30: note = hypo
  source 1..30: mol_type = genomic DNA
attccttagaaatagcgtttcacatgttag

SEQ ID NO: 14448 - DNA, 30 bp, Homo sapiens
  misc_feature 1..30: note = chr2:113103393-113103423
  misc_feature 1..30: note = hypo
  source 1..30: mol_type = genomic DNA
gcatcccgggcagagcgcagctgcgcagca

SEQ ID NO: 14449 - DNA, 31 bp, Homo sapiens
  misc_feature 1..31: note = chr2:114515528-114515559
  misc_feature 1..31: note = hypo
  source 1..31: mol_type = genomic DNA
aaaaaccaaccaggccggtcgcggtggctca

SEQ ID NO: 14450 - DNA, 396 bp, Homo sapiens
  misc_feature 1..396: note = chr2:120980096-120980492
  misc_feature 1..396: note = hypo
  source 1..396: mol_type = genomic DNA
ctgcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgcgggcccaaacgcccgcgcccacggaggcgcctgcgacgactagaagcttccacagccatatgggggcaaagacggcccagtagctccattggatgatgccgtccaggcggaggggcagcagcaccgagaagagcagcag

SEQ ID NO: 14451 - DNA, 223 bp, Homo sapiens; identical to SEQ ID NO: 4978
  misc_feature 1..223: note = chr2:122495312-122495535
  misc_feature 1..223: note = hypo
  source 1..223: mol_type = genomic DNA

SEQ ID NO: 14452 - DNA, 135 bp, Homo sapiens
  misc_feature 1..135: note = chr2:127422944-127423079
  misc_feature 1..135: note = hypo
  source 1..135: mol_type = genomic DNA
tttatcatagttattcgcatataggaaaactatcatgtatgtaaggttcagtcgtatctctggtttcaggcatccgctgggggtcttggaaagcatcccccataggtaagggggaaccaccgattcatgggacag

SEQ ID NO: 14453 - DNA, 45 bp, Homo sapiens
  misc_feature 1..45: note = chr2:127423305-127423350
  misc_feature 1..45: note = hypo
  source 1..45: mol_type = genomic DNA
cactctgccctgctccgcacctagtgaggacgtgtaacacacaca

SEQ ID NO: 14454 - DNA, 59 bp, Homo sapiens; identical to SEQ ID NO: 4979
  misc_feature 1..59: note = chr2:127428985-127429044
  misc_feature 1..59: note = hypo
  source 1..59: mol_type = genomic DNA

SEQ ID NO: 14455 - DNA, 40 bp, Homo sapiens
  misc_feature 1..40: note = chr2:127435251-127435291
  misc_feature 1..40: note = hypo
  source 1..40: mol_type = genomic DNA
gtatgtgttgcctgccgtaatccttcgctagggatgagca

SEQ ID NO: 14456 - DNA, 30 bp, Homo sapiens
  misc_feature 1..30: note = chr2:127438110-127438140
  misc_feature 1..30: note = hypo
  source 1..30: mol_type = genomic DNA
aaagtctgtggccagcggccctgtgattcc

SEQ ID NO: 14457 - DNA, 30 bp, Homo sapiens
  misc_feature 1..30: note = chr2:127438702-127438732
  misc_feature 1..30: note = hypo
  source 1..30: mol_type = genomic DNA
aaaccactcctaacccgtctacttcttaaa

SEQ ID NO: 14458 - DNA, 63 bp, Homo sapiens
  misc_feature 1..63: note = chr2:127801172-127801235
  misc_feature 1..63: note = hypo
  source 1..63: mol_type = genomic DNA
aggagcaaacctgcccggctgcattccgccctcccgctgccctaggcccgctataggctggat

SEQ ID NO: 14459 - DNA, 21 bp, Homo sapiens
  misc_feature 1..21: note = chr2:128616617-128616638
  misc_feature 1..21: note = hypo
  source 1..21: mol_type = genomic DNA
aaaaatgaattgtgccgggca

SEQ ID NO: 14460 - DNA, 39 bp, Homo sapiens; identical to SEQ ID NO: 1553
  misc_feature 1..39: note = chr2:128847684-128847723
  misc_feature 1..39: note = hypo
  source 1..39: mol_type = genomic DNA

SEQ ID NO: 14461 - DNA, 22 bp, Homo sapiens
  misc_feature 1..22: note = chr2:131114462-131114484
  misc_feature 1..22: note = hypo
  source 1..22: mol_type = genomic DNA
tataaagattctaaacgtgggc

SEQ ID NO: 14462 - DNA, 151 bp, Homo sapiens
  misc_feature 1..151: note = chr2:131477785-131477936
  misc_feature 1..151: note = hypo
  source 1..151: mol_type = genomic DNA
caggcagaggggcagcgcgtgggtggactctgggctgggcatgggcggggtgtgctgagcagaggacagtgggtggggcagctgccgccctgcagggagggtagccacagggctttgcagaccaggacaccagctgcgatgactttaatta

SEQ ID NO: 14463 - DNA, 261 bp, Homo sapiens
  misc_feature 1..261: note = chr2:131967115-131967376
  misc_feature 1..261: note = hypo
  source 1..261: mol_type = genomic DNA
gctcttaagtgtgggcgtttggtaaccggcatggctgctacctgtttctggctggagcctcggacactggctcactgcagttggtggtgtccacagagcggtaggagggcaactagtagcgggagcttctcctgccaggcaggaagacgagtagaagggagcagcaccgacgcatgctggaggctggagcctgagcccctggggctcgccttgctgtgtttggtggtgacgtgggacactgcagctcggccagagtggtag

SEQ ID NO: 14464 - DNA, 19 bp, Homo sapiens
  misc_feature 1..19: note = chr2:145167762-145167781
  misc_feature 1..19: note = hypo
  source 1..19: mol_type = genomic DNA
accgcgcccagccataaaa

SEQ ID NO: 14465 - DNA, 98 bp, Homo sapiens
  misc_feature 1..98: note = chr2:148776775-148776873
  misc_feature 1..98: note = hypo
  source 1..98: mol_type = genomic DNA
gcaatgatgcataaacggggtccactgcccaaacttacagaaagcaaaacgtggaaaattagtaactttaactgatagtgtacacctaaagaacctac

SEQ ID NO: 14466 - DNA, 34 bp, Homo sapiens
  misc_feature 1..34: note = chr2:152266037-152266071
  misc_feature 1..34: note = hypo
  source 1..34: mol_type = genomic DNA
aggtgtgagtcaccgcgcccggccagctcttagt

SEQ ID NO: 14467 - DNA, 66 bp, Homo sapiens
  misc_feature 1..66: note = chr2:170282975-170283041
  misc_feature 1..66: note = hypo
  source 1..66: mol_type = genomic DNA
tggcccagagccaggcgggagcgtcagtaccgcgcactgttaacagcggcccgacaaacccagcaa

SEQ ID NO: 14468 - DNA, 41 bp, Homo sapiens; identical to SEQ ID NO: 4982
  misc_feature 1..41: note = chr2:170551801-170551842
  misc_feature 1..41: note = hypo
  source 1..41: mol_type = genomic DNA

SEQ ID NO: 14469 - DNA, 27 bp, Homo sapiens
  misc_feature 1..27: note = chr2:170681885-170681912
  misc_feature 1..27: note = hypo
  source 1..27: mol_type = genomic DNA
agaggcagggcgcggcggctcacgcct

SEQ ID NO: 14470 - DNA, 27 bp, Homo sapiens
  misc_feature 1..27: note = chr2:170682152-170682179
  misc_feature 1..27: note = hypo
  source 1..27: mol_type = genomic DNA
agagcgagactccgtctcaaaaaaaaa

SEQ ID NO: 14471 - DNA, 74 bp, Homo sapiens
  misc_feature 1..74: note = chr2:172367021-172367095
  misc_feature 1..74: note = hypo
  source 1..74: mol_type = genomic DNA
tctcattagctcagacgcatgcagggaggcggggtctgggaaatgtaaagtccagtttacgtgacaccatacaa

SEQ ID NO: 14472 - DNA, 30 bp, Homo sapiens
  misc_feature 1..30: note = chr2:172411136-172411166
  misc_feature 1..30: note = hypo
  source 1..30: mol_type = genomic DNA
agaccgcaatggaaacgtcctaaggagcca

SEQ ID NO: 14473 - DNA, 20 bp, Homo sapiens
  misc_feature 1..20: note = chr2:173036684-173036704
  misc_feature 1..20: note = hypo
  source 1..20: mol_type = genomic DNA
caccgcgcccagcccaataa

SEQ ID NO: 14474 - DNA, 38 bp, Homo sapiens
  misc_feature 1..38: note = chr2:177498112-177498150
  misc_feature 1..38: note = hypo
  source 1..38: mol_type = genomic DNA
gtgagtgtatggctccgggcttttcttttctttttttt

SEQ ID NO: 14475 - DNA, 38 bp, Homo sapiens; identical to SEQ ID NO: 4985
  misc_feature 1..38: note = chr2:179317019-179317057
  misc_feature 1..38: note = hypo
  source 1..38: mol_type = genomic DNA

SEQ ID NO: 14476 - DNA, 32 bp, Homo sapiens
  misc_feature 1..32: note = chr2:180886813-180886845
  misc_feature 1..32: note = hypo
  source 1..32: mol_type = genomic DNA
atatcacacccacatcgcggggggtgggaggg

SEQ ID NO: 14477 - DNA, 30 bp, Homo sapiens
  misc_feature 1..30: note = chr2:188236072-188236102
  misc_feature 1..30: note = hypo
  source 1..30: mol_type = genomic DNA
aataaatggacgtaccgtgagttaagagag

SEQ ID NO: 14478 - DNA, 30 bp, Homo sapiens
  misc_feature 1..30: note = chr2:200524640-200524670
  misc_feature 1..30: note = hypo
  source 1..30: mol_type = genomic DNA
tatgctgatgctcctcggagtcagtaataa

SEQ ID NO: 14479 - DNA, 30 bp, Homo sapiens
  misc_feature 1..30: note = chr2:203129332-203129362
  misc_feature 1..30: note = hypo
  source 1..30: mol_type = genomic DNA
ttaacaaaataatatcgtgaagtttttccc

SEQ ID NO: 14480 - DNA, 23 bp, Homo sapiens
  misc_feature 1..23: note = chr2:203484340-203484363
  misc_feature 1..23: note = hypo
  source 1..23: mol_type = genomic DNA
tgccatatcgggtgcaccagtta

SEQ ID NO: 14481 - DNA, 86 bp, Homo sapiens
  misc_feature 1..86: note = chr2:207557814-207557900
  misc_feature 1..86: note = hypo
  source 1..86: mol_type = genomic DNA
agaaagattgctggccggttaccataacacccagggcccttggtggctgctctgtgggatcagccaatcctcgcagccactcacct

SEQ ID NO: 14482 - DNA, 30 bp, Homo sapiens
  misc_feature 1..30: note = chr2:220316287-220316317
  misc_feature 1..30: note = hypo
  source 1..30: mol_type = genomic DNA
gagattctcagtgggcgcctgtgggccgtg

SEQ ID NO: 14483 - DNA, 30 bp, Homo sapiens
  misc_feature 1..30: note = chr2:223764711-223764741
  misc_feature 1..30: note = hypo
  source 1..30: mol_type = genomic DNA
agccctcaccaaagacggagtcgctctggt

SEQ ID NO: 14484 - DNA, 30 bp, Homo sapiens
  misc_feature 1..30: note = chr2:230795535-230795565
  misc_feature 1..30: note = hypo
  source 1..30: mol_type = genomic DNA
tgctggagccctcctcgaggtgtgctgtgg

SEQ ID NO: 14485 - DNA, 30 bp, Homo sapiens
  misc_feature 1..30: note = chr2:232485651-232485681
  misc_feature 1..30: note = hypo
  source 1..30: mol_type = genomic DNA
cgttgttcctcatagcggcatctccgcagt

SEQ ID NO: 14486 - DNA, 30 bp, Homo sapiens
  misc_feature 1..30: note = chr2:233750505-233750535
  misc_feature 1..30: note = hypo
  source 1..30: mol_type = genomic DNA
gtgacacatggggcccggcacagggccagg

SEQ ID NO: 14487 - DNA, 30 bp, Homo sapiens
  misc_feature 1..30: note = chr2:233960620-233960650
  misc_feature 1..30: note = hypo
  source 1..30: mol_type = genomic DNA
taaataggataataccgtatacactgttct

SEQ ID NO: 14488 - DNA, 123 bp, Homo sapiens
  misc_feature 1..123: note = chr2:234109988-234110111
  misc_feature 1..123: note = hypo
  source 1..123: mol_type = genomic DNA
cttggtgcataacaacgagcacacagcttggtgggagcatgctccccacagccccatggtgacagctgcagacaggctgccatccacgggcaaggggcccccagggtacgcttctaactcact

SEQ ID NO: 14489 - DNA, 165 bp, Homo sapiens
  misc_feature 1..165: note = chr2:234369732-234369897
  misc_feature 1..165: note = hypo
  source 1..165: mol_type = genomic DNA
agccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggt

SEQ ID NO: 14490 - DNA, 67 bp, Homo sapiens
  misc_feature 1..67: note = chr2:239051088-239051155
  misc_feature 1..67: note = hypo
  source 1..67: mol_type = genomic DNA
gcagtgactgcttaccggccgttcctaagacagccagcatttcccactgagccgggacaccctcgtg

SEQ ID NO: 14491 - DNA, 161 bp, Homo sapiens
  misc_feature 1..161: note = chr2:239957287-239957448
  misc_feature 1..161: note = hypo
  source 1..161: mol_type = genomic DNA
tcctgcgggctcccccgtgggccaagtctcctaaactgggccagcctggagtcaggtgcgtgcagccctgccactctacctccttgcagcgaggcctggagggcgttccacgcgtgggcaccgcggccttcggaggcctccagagtcggcctcagtgggcg

SEQ ID NO: 14492 - DNA, 48 bp, Homo sapiens
  misc_feature 1..48: note = chr2:239997539-239997587
  misc_feature 1..48: note = hypo
  source 1..48: mol_type = genomic DNA
ctccccttggtttcccgggaaacaaagctgggccgggatagcaggtgg

SEQ ID NO: 14493 - DNA, 30 bp, Homo sapiens
  misc_feature 1..30: note = chr2:240103944-240103974
  misc_feature 1..30: note = hypo
  source 1..30: mol_type = genomic DNA
atctcctcgtcatggcgagcccctcccctc

SEQ ID NO: 14494 - DNA, 298 bp, Homo sapiens; identical to SEQ ID NO: 4986
  misc_feature 1..298: note = chr2:240168811-240169109
  misc_feature 1..298: note = hypo
  source 1..298: mol_type = genomic DNA

SEQ ID NO: 14495 - DNA, 32 bp, Homo sapiens
  misc_feature 1..32: note = chr2:240658352-240658384
  misc_feature 1..32: note = hypo
  source 1..32: mol_type = genomic DNA
ctgtgtttgggtcaacgcgcccctgtgtgctc

SEQ ID NO: 14496 - DNA, 30 bp, Homo sapiens
  misc_feature 1..30: note = chr2:240658886-240658916
  misc_feature 1..30: note = hypo
  source 1..30: mol_type = genomic DNA
ggtcgcagcagggcacggggggcagggagt

SEQ ID NO: 14497 - DNA, 126 bp, Homo sapiens
  misc_feature 1..126: note = chr2:240809527-240809653
  misc_feature 1..126: note = hypo
  source 1..126: mol_type = genomic DNA
ggacacctgtcactccgacggagaatcctggacaggcagcctcacccgggacacctgtcattccgaaggagaatcctggacatgcagcctcacctgggacacctgtcactccgatggagaatcctg

SEQ ID NO: 14498 - DNA, 148 bp, Homo sapiens
  misc_feature 1..148: note = chr2:241095637-241095785
  misc_feature 1..148: note = hypo
  source 1..148: mol_type = genomic DNA
ccttacacaaaaagccgtcgccgtctgcctcttgttctgattctttgttcccaccttacaaaacctgctgttctgccattgcctggtgggagttctcattgtgttttgtagaaacagaatcggagctctgccccgattcatgaagagt

SEQ ID NO: 14499 - DNA, 30 bp, Homo sapiens
  misc_feature 1..30: note = chr2:241544980-241545010
  misc_feature 1..30: note = hypo
  source 1..30: mol_type = genomic DNA
ttctggggtgagtgtcgagatcctgtgtcc

SEQ ID NO: 14500 - DNA, 58 bp, Homo sapiens
  misc_feature 1..58: note = chr2:241722184-241722242
  misc_feature 1..58: note = hypo
  source 1..58: mol_type = genomic DNA
cagggccgcccttcccgggcccaggcctgggctgcctgctgcacggggccaactgtgg

SEQ ID NO: 14501 - DNA, 247 bp, Homo sapiens
  misc_feature 1..247: note = chr2:241864987-241865234
  misc_feature 1..247: note = hypo
  source 1..247: mol_type = genomic DNA
gtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatatgaagaaggccaatgacgcgctgggccgggagctggccggg

SEQ ID NO: 14502 - DNA, 46 bp, Homo sapiens
  misc_feature 1..46: note = chr2:242004922-242004968
  misc_feature 1..46: note = hypo
  source 1..46: mol_type = genomic DNA
ggcctacaacatctccgtcttctcagtgaagcgaaacagtaacaac

SEQ ID NO: 14503 - DNA, 43 bp, Homo sapiens
  misc_feature 1..43: note = chr2:242009609-242009652
  misc_feature 1..43: note = hypo
  source 1..43: mol_type = genomic DNA
atcacctgtgagtgccgtgggccctgcgcgtgggcggggccag

SEQ ID NO: 14504 - DNA, 30 bp, Homo sapiens
  misc_feature 1..30: note = chr2:242436356-242436386
  misc_feature 1..30: note = hypo
  source 1..30: mol_type = genomic DNA
tgagcctcctgtcaccgggtgtcacccacc

SEQ ID NO: 14505 - DNA, 53 bp, Homo sapiens; identical to SEQ ID NO: 4987
  misc_feature 1..53: note = chr2:242524008-242524061
  misc_feature 1..53: note = hypo
  source 1..53: mol_type = genomic DNA

SEQ ID NO: 14506 - DNA, 120 bp, Homo sapiens; identical to SEQ ID NO: 4988
  misc_feature 1..120: note = chr2:242636861-242636981
  misc_feature 1..120: note = hypo
  source 1..120: mol_type = genomic DNA

SEQ ID NO: 14507 - DNA, 91 bp, Homo sapiens; identical to SEQ ID NO: 4989
  misc_feature 1..91: note = chr2:242637041-242637132
  misc_feature 1..91: note = hypo
  source 1..91: mol_type = genomic DNA

SEQ ID NO: 14508 - DNA, 33 bp, Homo sapiens
  misc_feature 1..33: note = chr2:242672951-242672984
  misc_feature 1..33: note = hypo
  source 1..33: mol_type = genomic DNA
aggacaaatccagctcgccggttttctgtgtga

SEQ ID NO: 14509 - DNA, 430 bp, Homo sapiens
  misc_feature 1..430: note = chr2:242756110-242756540
  misc_feature 1..430: note = hypo
  source 1..430: mol_type = genomic DNA
ggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctccc

SEQ ID NO: 14510 - DNA, 52 bp, Homo sapiens
  misc_feature 1..52: note = chr2:242757509-242757561
  misc_feature 1..52: note = hypo
  source 1..52: mol_type = genomic DNA
cttcgccttctacagcgatgaccacggccgcacctggcgctgtggaggcctc

SEQ ID NO: 14511 - DNA, 36 bp, Homo sapiens
  misc_feature 1..36: note = chr2:242794906-242794942
  misc_feature 1..36: note = hypo
  source 1..36: mol_type = genomic DNA
ggcagttgtgtgacacggaagcggcagtcctggccg

SEQ ID NO: 14512 - DNA, 207 bp, Homo sapiens
  misc_feature 1..207: note = chr2:242832984-242833191
  misc_feature 1..207: note = hypo
  source 1..207: mol_type = genomic DNA
caccaacagtccctgcggggacctttcccggacacccggccttctcggcggtgaggcaggtggcggcaccgacaggcccgggggggacctttcccggacacccagcctcctcggtggcgaggcaggtggcggcaccgacaggcccggcggggacctttcccggacacctggcctccttggcaaggcaggtggcggcaccaacaggcc

SEQ ID NO: 14513 - DNA, 63 bp, Homo sapiens
  misc_feature 1..63: note = chr2:242833525-242833588
  misc_feature 1..63: note = hypo
  source 1..63: mol_type = genomic DNA
caggagctcagaccccggcatcagaccggcctccgcagggaggagctgcggtgcccaggccag

SEQ ID NO: 14514 - DNA, 32 bp, Homo sapiens
  misc_feature 1..32: note = chr2:242833797-242833829
  misc_feature 1..32: note = hypo
  source 1..32: mol_type = genomic DNA
ctgcccaggtcttcacgcgcctaactgagcgt

SEQ ID NO: 14515 - DNA, 39 bp, Homo sapiens
  misc_feature 1..39: note = chr2:242836486-242836525
  misc_feature 1..39: note = hypo
  source 1..39: mol_type = genomic DNA
gagcctggggcagggcgataatttcggcattgtgagtca

SEQ ID NO: 14516 - DNA, 145 bp, Homo sapiens; identical to SEQ ID NO: 4990
  misc_feature 1..145: note = chr2:242925496-242925641
  misc_feature 1..145: note = hypo
  source 1..145: mol_type = genomic DNA

SEQ ID NO: 14517 - DNA, 47 bp, Homo sapiens
  misc_feature 1..47: note = chr2:242985116-242985163
  misc_feature 1..47: note = hypo
  source 1..47: mol_type = genomic DNA
aggactgagcaggtgcggctgttacctgaggacggagcaggtgcggc

SEQ ID NO: 14518 - DNA, 30 bp, Homo sapiens
  misc_feature 1..30: note = chr3:3167687-3167717
  misc_feature 1..30: note = hypo
  source 1..30: mol_type = genomic DNA
gaggcctggggaacacgaggtcaggagttc

SEQ ID NO: 14519 - DNA, 49 bp, Homo sapiens
  misc_feature 1..49: note = chr3:10182868-10182917
  misc_feature 1..49: note = hypo
  source 1..49: mol_type = genomic DNA
ttcccgtgtgagatgcgccaccctcgaaccttgttacgacgtcggcaca

SEQ ID NO: 14520 - DNA, 30 bp, Homo sapiens
  misc_feature 1..30: note = chr3:12586227-12586257
  misc_feature 1..30: note = hypo
  source 1..30: mol_type = genomic DNA
ttttgtttatgctagcgctctcagcaagag

SEQ ID NO: 14521 - DNA, 72 bp, Homo sapiens
  misc_feature 1..72: note = chr3:13679132-13679204
  misc_feature 1..72: note = hypo
  source 1..72: mol_type = genomic DNA
agctcaacttccagacgggcctcctggtgcctgcgcatatcttccgcattggccccgcgccagccttcacgg

SEQ ID NO: 14522 - DNA, 30 bp, Homo sapiens
  misc_feature 1..30: note = chr3:13680779-13680809
  misc_feature 1..30: note = hypo
  source 1..30: mol_type = genomic DNA
cttgccggaagcctgcggtgggggccctct

SEQ ID NO: 14523 - DNA, 30 bp, Homo sapiens
  misc_feature 1..30: note = chr3:17001303-17001333
  misc_feature 1..30: note = hypo
  source 1..30: mol_type = genomic DNA
tgtaagaaggtccaccgggtgctgtggctc

SEQ ID NO: 14524 - DNA, 66 bp, Homo sapiens
  misc_feature 1..66: note = chr3:17499802-17499868
  misc_feature 1..66: note = hypo
  source 1..66: mol_type = genomic DNA
tggtaattgttgcagcgcttctgacaaaatatagctttgttccagagtccacgtggagattattcc

SEQ ID NO: 14525 - DNA, 95 bp, Homo sapiens
  misc_feature 1..95: note = chr3:32151324-32151419
  misc_feature 1..95: note = hypo
  source 1..95: mol_type = genomic DNA
catggaagataagaccgaaggaattgccaagtggaatggagtaactgctctgttacactttaaatcgtgtttctttttttgtttgtttgtttttg

SEQ ID NO: 14526 - DNA, 163 bp, Homo sapiens
  misc_feature 1..163: note = chr3:33841159-33841322
  misc_feature 1..163: note = hypo
  source 1..163: mol_type = genomic DNA
taagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaag

SEQ ID NO: 14527 - DNA, 37 bp, Homo sapiens
  misc_feature 1..37: note = chr3:40501058-40501095
  misc_feature 1..37: note = hypo
  source 1..37: mol_type = genomic DNA
tatgttggccgggcgcggtggctcacgcctataatcc

SEQ ID NO: 14528 - DNA, 45 bp, Homo sapiens; identical to SEQ ID NO: 4991
  misc_feature 1..45: note = chr3:42640855-42640900
  misc_feature 1..45: note = hypo
  source 1..45: mol_type = genomic DNA

SEQ ID NO: 14529 - DNA, 21 bp, Homo sapiens
  misc_feature 1..21: note = chr3:43664372-43664393
  misc_feature 1..21: note = hypo
  source 1..21: mol_type = genomic DNA
tttgagatagagcctcgcaat

SEQ ID NO: 14530 - DNA, 30 bp, Homo sapiens
  misc_feature 1..30: note = chr3:45885052-45885082
  misc_feature 1..30: note = hypo
  source 1..30: mol_type = genomic DNA
agggaatgaaaggagcgtgtgtataatgca

SEQ ID NO: 14531 - DNA, 22 bp, Homo sapiens
  misc_feature 1..22: note = chr3:47555871-47555893
  misc_feature 1..22: note = hypo
  source 1..22: mol_type = genomic DNA
gccgacacggaattatatcttg

SEQ ID NO: 14532 - DNA, 33 bp, Homo sapiens; identical to SEQ ID NO: 4992
  misc_feature 1..33: note = chr3:48236539-48236572
  misc_feature 1..33: note = hypo
  source 1..33: mol_type = genomic DNA

SEQ ID NO: 14533 - DNA, 170 bp, Homo sapiens
  misc_feature 1..170: note = chr3:48636676-48636846
  misc_feature 1..170: note = hypo
  source 1..170: mol_type = genomic DNA
cacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggt

SEQ ID NO: 14534 - DNA, 30 bp, Homo sapiens
  misc_feature 1..30: note = chr3:48948476-48948506
  misc_feature 1..30: note = hypo
  source 1..30: mol_type = genomic DNA
tcactggggaaggagcgtagatggaagaga

SEQ ID NO: 14535 - DNA, 19 bp, Homo sapiens
  misc_feature 1..19: note = chr3:49056918-49056937
  misc_feature 1..19: note = hypo
  source 1..19: mol_type = genomic DNA
tttttttttttgagacgga

SEQ ID NO: 14536 - DNA, 378 bp, Homo sapiens
  misc_feature 1..378: note = chr3:49939931-49940309
  misc_feature 1..378: note = hypo
  source 1..378: mol_type = genomic DNA
tggggaaggcacagacgacagagttggggcccacgccaggaccaccatccttgccagtcacaaagaccccaaatagtacttcctggccctcggcgatgctcagctcagtggcaagttgggcacccactggagcggagtgggccacccgcagcacagggtagggctgtccgccttctggggccccccggcgcctgcgttttggagcaaatctgcagtcgaggaccagctcccgatagtcacccaactctggctcagtggcgctaagccgtgccaggcgtgtgtgcagggcactaggatcatctgtcacgctggccggctgtacagtcaggaagtatacgaaggctcccgtgtggaagctgtgcacgtattcaatactgt

SEQ ID NO: 14537 - DNA, 44 bp, Homo sapiens
  misc_feature 1..44: note = chr3:49940550-49940594
  misc_feature 1..44: note = hypo
  source 1..44: mol_type = genomic DNA
gaagaggcaggctggcgctgccagatgcacggctgtcccttggg

SEQ ID NO: 14538 - DNA, 30 bp, Homo sapiens
  misc_feature 1..30: note = chr3:50395506-50395536
  misc_feature 1..30: note = hypo
  source 1..30: mol_type = genomic DNA
ctgattttgtctttccggatgtgccccaat

SEQ ID NO: 14539 - DNA, 30 bp, Homo sapiens
  misc_feature 1..30: note = chr3:50425383-50425413
  misc_feature 1..30: note = hypo
  source 1..30: mol_type = genomic DNA
gacggagaacagagccgagtttgggcagga

SEQ ID NO: 14540 - DNA, 173 bp, Homo sapiens
  misc_feature 1..173: note = chr3:50433950-50434123
  misc_feature 1..173: note = hypo
  source 1..173: mol_type = genomic DNA
acaaatgcctgcccacgccgaccccaaacccagggatggatgaggcccccaattcataagcctgcagtgaccttgtgtagagggcattactgtgtgacttgtacggttcgcaatgcttgtcaccagtgttaggcgagcacctgcagtacagcaggtgccgagctcagtaactt

SEQ ID NO: 14541 - DNA, 28 bp, Homo sapiens
  misc_feature 1..28: note = chr3:50575602-50575630
  misc_feature 1..28: note = hypo
  source 1..28: mol_type = genomic DNA
ggggctcaagcaatacgactccagccag

SEQ ID NO: 14542 - DNA, 84 bp, Homo sapiens
  misc_feature 1..84: note = chr3:52552577-52552661
  misc_feature 1..84: note = hypo
  source 1..84: mol_type = genomic DNA
gcctttcaccatcttcgtgccgcacgcagatctaatgagcaacctgtcgcaggtatgcagcccccagagcgaggctgggcaggg

SEQ ID NO: 14543 - DNA, 240 bp, Homo sapiens
  misc_feature 1..240: note = chr3:52553207-52553447
  misc_feature 1..240: note = hypo
  source 1..240: mol_type = genomic DNA
ctccacctcaggccccgatagcttccgagcaccccacctatctgcttcatcagccccgtgccccgcccccagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgagggtatgacaagcacgggcctgggagctg

SEQ ID NO: 14544 - DNA, 30 bp, Homo sapiens
  misc_feature 1..30: note = chr3:52900819-52900849
  misc_feature 1..30: note = hypo
  source 1..30: mol_type = genomic DNA
gtcaaaaaacacaggcgttggaagggatat

SEQ ID NO: 14545 - DNA, 567 bp, Homo sapiens
  misc_feature 1..567: note = chr3:53032798-53033365
  misc_feature 1..567: note = hypo
  source 1..567: mol_type = genomic DNA
gggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcc

SEQ ID NO: 14546 - DNA, 30 bp, Homo sapiens
  misc_feature 1..30: note = chr3:53033605-53033635
  misc_feature 1..30: note = hypo
  source 1..30: mol_type = genomic DNA
cagaagacaggagttcgtgtccttgcccct

SEQ ID NO: 14547 - DNA, 83 bp, Homo sapiens
  misc_feature 1..83: note = chr3:69740999-69741082
  misc_feature 1..83: note = hypo
  source 1..83: mol_type = genomic DNA
tttctgggcttgatcttgttataatgtcaccatttctcagatgagaattcagaggctcagaagcacatcgcgagagaatgtgg

SEQ ID NO: 14548 - DNA, 21 bp, Homo sapiens
  misc_feature 1..21: note = chr3:70083716-70083737
  misc_feature 1..21: note = hypo
  source 1..21: mol_type = genomic DNA
aggcgtggtggctcacgctta

SEQ ID NO: 14549 - DNA, 91 bp, Homo sapiens; identical to SEQ ID NO: 4993
  misc_feature 1..91: note = chr3:73045514-73045605
  misc_feature 1..91: note = hypo
  source 1..91: mol_type = genomic DNA

SEQ ID NO: 14550 - DNA, 17 bp, Homo sapiens
  misc_feature 1..17: note = chr3:86960228-86960245
  misc_feature 1..17: note = hypo
  source 1..17: mol_type = genomic DNA
tgaaagttgacacttcg

SEQ ID NO: 14551 - DNA, 163 bp, Homo sapiens
  misc_feature 1..163: note = chr3:87782694-87782857
  misc_feature 1..163: note = hypo
  source 1..163: mol_type = genomic DNA
aataaaattaataatcgctagacatgaggaacatttcctgtcccaatgcaaaaccaaacaccactgagggccatttagcatcactaggattcttggctttggttcctaataaatatgttaaatatactggagcaggaagagccgcagacaaaacccctcagta

SEQ ID NO: 14552 - DNA, 143 bp, Homo sapiens; identical to SEQ ID NO: 1556
  misc_feature 1..143: note = chr3:101230961-101231104
  misc_feature 1..143: note = hypo
  source 1..143: mol_type = genomic DNA

SEQ ID NO: 14553 - DNA, 37 bp, Homo sapiens
  misc_feature 1..37: note = chr3:101354369-101354406
  misc_feature 1..37: note = hypo
  source 1..37: mol_type = genomic DNA
ggagtctttttagaacgcctccaggaggcctatcgaa

SEQ ID NO: 14554 - DNA, 105 bp, Homo sapiens; identical to SEQ ID NO: 4995
  misc_feature 1..105: note = chr3:101397240-101397345
  misc_feature 1..105: note = hypo
  source 1..105: mol_type = genomic DNA

SEQ ID NO: 14555 - DNA, 30 bp, Homo sapiens
  misc_feature 1..30: note = chr3:107833994-107834024
  misc_feature 1..30: note = hypo
  source 1..30: mol_type = genomic DNA
aaaaaatcttcataacggcaaggtcgcaat

SEQ ID NO: 14556 - DNA, 22 bp, Homo sapiens
  misc_feature 1..22: note = chr3:113557437-113557459
  misc_feature 1..22: note = hypo
  source 1..22: mol_type = genomic DNA
aagtttccgagcaattcacctt

SEQ ID NO: 14557 - DNA, 49 bp, Homo sapiens
  misc_feature 1..49: note = chr3:115752446-115752495
  misc_feature 1..49: note = hypo
  source 1..49: mol_type = genomic DNA
ctccgtaacatgctgcggggccagagcactctagcgaatgatttctgtg

SEQ ID NO: 14558 - DNA, 37 bp, Homo sapiens
  misc_feature 1..37: note = chr3:118976384-118976421
  misc_feature 1..37: note = hypo
  source 1..37: mol_type = genomic DNA
tgtagcaggacaagccgcagacaaaacctctcagaca

SEQ ID NO: 14559 - DNA, 120 bp, Homo sapiens
  misc_feature 1..120: note = chr3:119815773-119815893
  misc_feature 1..120: note = hypo
  source 1..120: mol_type = genomic DNA
accgggccggttgaaatttatctttaaaatagtgcacctttaatcctttttttatttctgtgtgtatcttataatgtgcatatcatgttagctcaagatcaagagtttatggacaagcca

SEQ ID NO: 14560 - DNA, 18 bp, Homo sapiens
  misc_feature 1..18: note = chr3:119817451-119817469
  misc_feature 1..18: note = hypo
  source 1..18: mol_type = genomic DNA
aaacgctaggattactgg

SEQ ID NO: 14561 - DNA, 25 bp, Homo sapiens
  misc_feature 1..25: note = chr3:121265940-121265965
  misc_feature 1..25: note = hypo
  source 1..25: mol_type = genomic DNA
aaataaaagagatctcgccggccgt

SEQ ID NO: 14562 - DNA, 19 bp, Homo sapiens
  misc_feature 1..19: note = chr3:122234242-122234261
  misc_feature 1..19: note = hypo
  source 1..19: mol_type = genomic DNA
aaaataattaagggccggg

SEQ ID NO: 14563 - DNA, 79 bp, Homo sapiens; identical to SEQ ID NO: 4998
  misc_feature 1..79: note = chr3:122234561-122234640
  misc_feature 1..79: note = hypo
  source 1..79: mol_type = genomic DNA

SEQ ID NO: 14564 - DNA, 29 bp, Homo sapiens
  misc_feature 1..29: note = chr3:122573648-122573677
  misc_feature 1..29: note = hypo
  source 1..29: mol_type = genomic DNA
gactcaaaggctgggcgcggtggctcacg

SEQ ID NO: 14565 - DNA, 30 bp, Homo sapiens
  misc_feature 1..30: note = chr3:122702282-122702312
  misc_feature 1..30: note = hypo
  source 1..30: mol_type = genomic DNA
aaatcatccgcggggcggggacggggcggg

SEQ ID NO: 14566 - DNA, 102 bp, Homo sapiens
  misc_feature 1..102: note = chr3:125456444-125456546
  misc_feature 1..102: note = hypo
  source 1..102: mol_type = genomic DNA
tgtgaaattagtagtgaactcccgctgggatattacgaattttttgacagggtctccacgccctgacacattagtagtcacgttttccgagaatatgacgaa

SEQ ID NO: 14567 - DNA, 39 bp, Homo sapiens
  misc_feature 1..39: note = chr3:125785793-125785832
  misc_feature 1..39: note = hypo
  source 1..39: mol_type = genomic DNA
tatgaatttcgccggcgtatggggcgatgctgcagactc

SEQ ID NO: 14568 - DNA, 130 bp, Homo sapiens
  misc_feature 1..130: note = chr3:126195886-126196016
  misc_feature 1..130: note = hypo
  source 1..130: mol_type = genomic DNA
cccccacccctcccccgcaccccacctctttttcccagttcatccagcaagccaagctggttccagcctcagagacttggcgcagctgatctctgattcctctgggaggactctgcgccccttctgatcc

SEQ ID NO: 14569 - DNA, 28 bp, Homo sapiens
  misc_feature 1..28: note = chr3:130519901-130519929
  misc_feature 1..28: note = hypo
  source 1..28: mol_type = genomic DNA
tgtaaattggccaggcgtcgtggctcat

SEQ ID NO: 14570 - DNA, 30 bp, Homo sapiens
  misc_feature 1..30: note = chr3:134320427-134320457
  misc_feature 1..30: note = hypo
  source 1..30: mol_type = genomic DNA
tagctgttatgcctccggggcctttgtgca

SEQ ID NO: 14571 - DNA, 120 bp, Homo sapiens
  misc_feature 1..120: note = chr3:136582942-136583062
  misc_feature 1..120: note = hypo
  source 1..120: mol_type = genomic DNA
aaaaaaataaataaaatgtgtatttatttttctaggcattatcctttgtccaggtttctgcagtgctttcaggtccatctaaataaaatttgaaacctacgtgtaatgttggccgggctc

SEQ ID NO: 14572 - DNA, 32 bp, Homo sapiens
  misc_feature 1..32: note = chr3:137561189-137561221
  misc_feature 1..32: note = hypo
  source 1..32: mol_type = genomic DNA
agtctagctattggccgggcaccgtggctcac

SEQ ID NO: 14573 - DNA, 57 bp, Homo sapiens
  misc_feature 1..57: note = chr3:137717830-137717887
  misc_feature 1..57: note = hypo
  source 1..57: mol_type = genomic DNA
acagctgttttcaactaccaggggctgtggcgctcctgtgtccgagagagctctggc

SEQ ID NO: 14574 - DNA, 133 bp, Homo sapiens; identical to SEQ ID NO: 5000
  misc_feature 1..133: note = chr3:141174349-141174482
  misc_feature 1..133: note = hypo
  source 1..133: mol_type = genomic DNA

SEQ ID NO: 14575 - DNA, 99 bp, Homo sapiens
  misc_feature 1..99: note = chr3:141482007-141482106
  misc_feature 1..99: note = hypo
  source 1..99: mol_type = genomic DNA
ggatgaaaaatatgggcttggattcttcccatacctcatgcttcaaatagccgttgatgaccctgaagccatagtgctgtgtttcggtcaaacaacagc

SEQ ID NO: 14576 - DNA, 28 bp, Homo sapiens
  misc_feature 1..28: note = chr3:142791151-142791179
  misc_feature 1..28: note = hypo
  source 1..28: mol_type = genomic DNA
atattaagactgtcacgcgcgttcgtgt

SEQ ID NO: 14577 - DNA, 35 bp, Homo sapiens; identical to SEQ ID NO: 5001
  misc_feature 1..35: note = chr3:142913215-142913250
  misc_feature 1..35: note = hypo
  source 1..35: mol_type = genomic DNA

SEQ ID NO: 14578 - DNA, 21 bp, Homo sapiens
  misc_feature 1..21: note = chr3:142977041-142977062
  misc_feature 1..21: note = hypo
  source 1..21: mol_type = genomic DNA
acagagcgatactccatctca

SEQ ID NO: 14579 - DNA, 45 bp, Homo sapiens
  misc_feature 1..45: note = chr3:143092973-143093018
  misc_feature 1..45: note = hypo
  source 1..45: mol_type = genomic DNA
atggaggccagaggccgggtgtggtggctcacacctctaatccca

SEQ ID NO: 14580 - DNA, 22 bp, Homo sapiens
  misc_feature 1..22: note = chr3:143210840-143210862
  misc_feature 1..22: note = hypo
  source 1..22: mol_type = genomic DNA
cacctaccacttggccgggtgt

SEQ ID NO: 14581 - DNA, 32 bp, Homo sapiens
  misc_feature 1..32: note = chr3:146187946-146187978
  misc_feature 1..32: note = hypo
  source 1..32: mol_type = genomic DNA
tttaatttttcaggacgcgcctttgatttttc

SEQ ID NO: 14582 - DNA, 27 bp, Homo sapiens
  misc_feature 1..27: note = chr3:148802983-148803010
  misc_feature 1..27: note = hypo
  source 1..27: mol_type = genomic DNA
actacaattatgggccggatgcggtgg

SEQ ID NO: 14583 - DNA, 26 bp, Homo sapiens
  misc_feature 1..26: note = chr3:148803250-148803276
  misc_feature 1..26: note = hypo
  source 1..26: mol_type = genomic DNA
ggacgacagagcgagactccatgtca

SEQ ID NO: 14584 - DNA, 161 bp, Homo sapiens
  misc_feature 1..161: note = chr3:150135175-150135336
  misc_feature 1..161: note = hypo
  source 1..161: mol_type = genomic DNA
ctttgcttggcataccgtctacctagtctttgaagacaaaacaaaggagggaggagctgttttgatcaaataaaaccaatagcgtgtttaattatgtgttaacatatgtgaatgaccattacagagacagtagagtcagacatacccgggctaaaatctaa

SEQ ID NO: 14585 - DNA, 76 bp, Homo sapiens
  misc_feature 1..76: note = chr3:150237920-150237996
  misc_feature 1..76: note = hypo
  source 1..76: mol_type = genomic DNA
ccgcctcggcatcccaaagtgcactccaggttttaattacctctcgggtgattgtggtgcacgctcaagtttgaga

SEQ ID NO: 14586 - DNA, 19 bp, Homo sapiens
  misc_feature 1..19: note = chr3:152744869-152744888
  misc_feature 1..19: note = hypo
  source 1..19: mol_type = genomic DNA
actccgtctcaaataaata

SEQ ID NO: 14587 - DNA, 27 bp, Homo sapiens
  misc_feature 1..27: note = chr3:152829598-152829625
  misc_feature 1..27: note = hypo
  source 1..27: mol_type = genomic DNA
ggcgtgagcgaccgcacccagctgata

SEQ ID NO: 14588 - DNA, 126 bp, Homo sapiens; identical to SEQ ID NO: 5002
  misc_feature 1..126: note = chr3:169540047-169540173
  misc_feature 1..126: note = hypo
  source 1..126: mol_type = genomic DNA

SEQ ID NO: 14589 - DNA, 235 bp, Homo sapiens; identical to SEQ ID NO: 1557
  misc_feature 1..235: note = chr3:169540374-169540609
  misc_feature 1..235: note = hypo
  source 1..235: mol_type = genomic DNA

SEQ ID NO: 14590 - DNA, 58 bp, Homo sapiens
  misc_feature 1..58: note = chr3:172384961-172385019
  misc_feature 1..58: note = hypo
  source 1..58: mol_type = genomic DNA
attttagtctcaatgcgtcccatcagcagggaaaacggccattcggttcctatgtatt

SEQ ID NO: 14591 - DNA, 31 bp, Homo sapiens
  misc_feature 1..31: note = chr3:172425686-172425717
  misc_feature 1..31: note = hypo
  source 1..31: mol_type = genomic DNA
taaacactgctaagaacgttcatctcccaga

SEQ ID NO: 14592 - DNA, 37 bp, Homo sapiens
  misc_feature 1..37: note = chr3:172470190-172470227
  misc_feature 1..37: note = hypo
  source 1..37: mol_type = genomic DNA
tacaagtgtgagccaccgcgtccggcctttcaaatgg

SEQ ID NO: 14593 - DNA, 23 bp, Homo sapiens
  misc_feature 1..23: note = chr3:179171196-179171219
  misc_feature 1..23: note = hypo
  source 1..23: mol_type = genomic DNA
accgatcccggccccatattctt

SEQ ID NO: 14594 - DNA, 23 bp, Homo sapiens
  misc_feature 1..23: note = chr3:179367897-179367920
  misc_feature 1..23: note = hypo
  source 1..23: mol_type = genomic DNA
acccgcctcggcctcccaaagtg

SEQ ID NO: 14595 - DNA, 25 bp, Homo sapiens
  misc_feature 1..25: note = chr3:182812783-182812808
  misc_feature 1..25: note = hypo
  source 1..25: mol_type = genomic DNA
tgccctggccaggcacggtggctca

SEQ ID NO: 14596 - DNA, 18 bp, Homo sapiens
  misc_feature 1..18: note = chr3:182816009-182816027
  misc_feature 1..18: note = hypo
  source 1..18: mol_type = genomic DNA
ccccgccaacttccaaca

SEQ ID NO: 14597 - DNA, 38 bp, Homo sapiens
  misc_feature 1..38: note = chr3:182987877-182987915
  misc_feature 1..38: note = hypo
  source 1..38: mol_type = genomic DNA
cctgaaaactatgatcgacgttccggaattagaaggac

SEQ ID NO: 14598 - DNA, 22 bp, Homo sapiens
  misc_feature 1..22: note = chr3:183183665-183183687
  misc_feature 1..22: note = hypo
  source 1..22: mol_type = genomic DNA
ttacaggcgtgagccactgccc

SEQ ID NO: 14599 - DNA, 48 bp, Homo sapiens
  misc_feature 1..48: note = chr3:183622035-183622083
  misc_feature 1..48: note = hypo
  source 1..48: mol_type = genomic DNA
cacccatggccatgacgctgctgaggcgctgcacgtcatggaggacag

SEQ ID NO: 14600 - DNA, 30 bp, Homo sapiens
  misc_feature 1..30: note = chr3:183648152-183648182
  misc_feature 1..30: note = hypo
  source 1..30: mol_type = genomic DNA
cgcttggaacatgctcgcttctcactaccc

SEQ ID NO: 14601 - DNA, 171 bp, Homo sapiens
  misc_feature 1..171: note = chr3:183684023-183684194
  misc_feature 1..171: note = hypo
  source 1..171: mol_type = genomic DNA
aacaccctcacacagcgtgtacacacacaggtgtacctacgtacaccacaaactggtagcattctgatgtgcacttcaaagggttcagaagtccccagggggtctactgtggaaagccggcacttctggctgctgcacaaacaccgcacattgcagcgctatcaacagatg

SEQ ID NO: 14602 - DNA, 30 bp, Homo sapiens; identical to SEQ ID NO: 5005
  misc_feature 1..30: note = chr3:183965921-183965951
  misc_feature 1..30: note = hypo
  source 1..30: mol_type = genomic DNA

SEQ ID NO: 14603 - DNA, 30 bp, Homo sapiens
  misc_feature 1..30: note = chr3:184018038-184018068
  misc_feature 1..30: note = hypo
  source 1..30: mol_type = genomic DNA
ttgtctgagccctgtcgtctcttgatcagg

SEQ ID NO: 14604 - DNA, 42 bp, Homo sapiens
  misc_feature 1..42: note = chr3:184200659-184200701
  misc_feature 1..42: note = hypo
  source 1..42: mol_type = genomic DNA
taaagtgagtgcctccgtgggtctccccgaggcatgaaggtg

SEQ ID NO: 14605 - DNA, 59 bp, Homo sapiens
  misc_feature 1..59: note = chr3:184785167-184785226
  misc_feature 1..59: note = hypo
  source 1..59: mol_type = genomic DNA
aacacaaaagggagccgtacacagccctgccctcaggcacctgccggctggggaaggac

SEQ ID NO: 14606 - DNA, 21 bp, Homo sapiens
  misc_feature 1..21: note = chr3:185001914-185001935
  misc_feature 1..21: note = hypo
  source 1..21: mol_type = genomic DNA
tacgcgcggccactttccttt

SEQ ID NO: 14607 - DNA, 23 bp, Homo sapiens
  misc_feature 1..23: note = chr3:185270882-185270905
  misc_feature 1..23: note = hypo
  source 1..23: mol_type = genomic DNA
aaaagaaaaacaggccggcacgg

SEQ ID NO: 14608 - DNA, 90 bp, Homo sapiens; identical to SEQ ID NO: 1558
  misc_feature 1..90: note = chr3:185271296-185271386
  misc_feature 1..90: note = hypo
  source 1..90: mol_type = genomic DNA

SEQ ID NO: 14609 - DNA, 30 bp, Homo sapiens
  misc_feature 1..30: note = chr3:185278325-185278355
  misc_feature 1..30: note = hypo
  source 1..30: mol_type = genomic DNA
ctcatgcttttaattcggcaggaatgtcct

SEQ ID NO: 14610 - DNA, 89 bp, Homo sapiens
  misc_feature 1..89: note = chr3:185363216-185363305
  misc_feature 1..89: note = hypo
  source 1..89: mol_type = genomic DNA
tctttggtttgctcccgatctggctggctgcgtttggtctcattctgtcaggtgttggaagggctacattcatccgttgttttgctggt

SEQ ID NO: 14611 - DNA, 25 bp, Homo sapiens
  misc_feature 1..25: note = chr3:185551925-185551950
  misc_feature 1..25: note = hypo
  source 1..25: mol_type = genomic DNA
atcccaggctgggtgcggtggctca

SEQ ID NO: 14612 - DNA, 36 bp, Homo sapiens
  misc_feature 1..36: note = chr3:185643324-185643360
  misc_feature 1..36: note = hypo
  source 1..36: mol_type = genomic DNA
ctgtaagacctgctacgtgatcgtctatgggagcgg

SEQ ID NO: 14613 - DNA, 80 bp, Homo sapiens; identical to SEQ ID NO: 5008
  misc_feature 1..80: note = chr3:193312128-193312208
  misc_feature 1..80: note = hypo
  source 1..80: mol_type = genomic DNA

SEQ ID NO: 14614 - DNA, 174 bp, Homo sapiens; identical to SEQ ID NO: 5009
  misc_feature 1..174: note = chr3:193548530-193548704
  misc_feature 1..174: note = hypo
  source 1..174: mol_type = genomic DNA

SEQ ID NO: 14615 - DNA, 30 bp, Homo sapiens
  misc_feature 1..30: note = chr3:193588129-193588159
  misc_feature 1..30: note = hypo
  source 1..30: mol_type = genomic DNA
aaatggaggccgagacgtgggaatgcttta

SEQ ID NO: 14616 - DNA, 36 bp, Homo sapiens
  misc_feature 1..36: note = chr3:193922775-193922811
  misc_feature 1..36: note = hypo
  source 1..36: mol_type = genomic DNA
ggctattattttcctcgattacgttgacattgcctg

SEQ ID NO: 14617 - DNA, 30 bp, Homo sapiens
  misc_feature 1..30: note = chr3:194048863-194048893
  misc_feature 1..30: note = hypo
  source 1..30: mol_type = genomic DNA
cgcgcatccgcagagcgcacctgtcccagc

SEQ ID NO: 14618 - DNA, 30 bp, Homo sapiens
  misc_feature 1..30: note = chr3:195536686-195536716
  misc_feature 1..30: note = hypo
  source 1..30: mol_type = genomic DNA
gtcaggaggtccaaccgttcaccactgctt

SEQ ID NO: 14619 - DNA, 38 bp, Homo sapiens
  misc_feature 1..38: note = chr3:195587080-195587118
  misc_feature 1..38: note = hypo
  source 1..38: mol_type = genomic DNA
aagccggctcgtgcccgccgcctcggctgcagggccct

SEQ ID NO: 14620 - DNA, 59 bp, Homo sapiens
  misc_feature 1..59: note = chr3:195597490-195597549
  misc_feature 1..59: note = hypo
  source 1..59: mol_type = genomic DNA
catggccaggaggtgcgggagaggctgggccacctgtcctgctccggatccaccctccg

SEQ ID NO: 14621 - DNA, 68 bp, Homo sapiens
  misc_feature 1..68: note = chr3:195599772-195599840
  misc_feature 1..68: note = hypo
  source 1..68: mol_type = genomic DNA
cttgatttcactcctcggctgggttccaggagttctgagaggtgcgggggtgccgggggacacctagg

SEQ ID NO: 14622 - DNA, 77 bp, Homo sapiens
  misc_feature 1..77: note = chr3:195600494-195600571
  misc_feature 1..77: note = hypo
  source 1..77: mol_type = genomic DNA
gtcccagggccaaagcgtgaagaagggctcctctgaaacccagccaggccggggagagaggacggaggaggtggcga

SEQ ID NO: 14623 - DNA, 110 bp, Homo sapiens
  misc_feature 1..110: note = chr3:195600916-195601026
  misc_feature 1..110: note = hypo
  source 1..110: mol_type = genomic DNA
gcacacagcctcccacggcggcccgtagaggaggaaccccggcaccggctgggctgcggctctcccgctacacccacgggctccccggtggctgccgcgggccagacgcc

SEQ ID NO: 14624 - DNA, 36 bp, Homo sapiens
  misc_feature 1..36: note = chr3:195637307-195637343
  misc_feature 1..36: note = hypo
  source 1..36: mol_type = genomic DNA
ggcagccctgggcagcgggcgcgtggagcccaaggg

SEQ ID NO: 14625 - DNA, 30 bp, Homo sapiens
  misc_feature 1..30: note = chr3:195648737-195648767
  misc_feature 1..30: note = hypo
  source 1..30: mol_type = genomic DNA
cgtcacccaggaacacggctctgatcaagg

SEQ ID NO: 14626 - DNA, 136 bp, Homo sapiens; identical to SEQ ID NO: 5010
  misc_feature 1..136: note = chr3:196069836-196069972
  misc_feature 1..136: note = hypo
  source 1..136: mol_type = genomic DNA

SEQ ID NO: 14627 - DNA, 30 bp, Homo sapiens
  misc_feature 1..30: note = chr3:196256292-196256322
  misc_feature 1..30: note = hypo
  source 1..30: mol_type = genomic DNA
tggagcttctgaggccgggcacggtggctc

SEQ ID NO: 14628 - DNA, 30 bp, Homo sapiens
  misc_feature 1..30: note = chr3:196294577-196294607
  misc_feature 1..30: note = hypo
  source 1..30: mol_type = genomic DNA
ggccacctaggaaatcgtagtataatcaaa

SEQ ID NO: 14629 - DNA, 495 bp, Homo sapiens
  misc_feature 1..495: note = chr3:196387158-196387653
  misc_feature 1..495: note = hypo
  source 1..495: mol_type = genomic DNA
caacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccga

SEQ ID NO: 14630 - DNA, 60 bp, Homo sapiens; identical to SEQ ID NO: 5011
  misc_feature 1..60: note = chr3:196388383-196388443
  misc_feature 1..60: note = hypo
  source 1..60: mol_type = genomic DNA

SEQ ID NO: 14631 - DNA, 30 bp, Homo sapiens
  misc_feature 1..30: note = chr3:196731283-196731313
  misc_feature 1..30: note = hypo
  source 1..30: mol_type = genomic DNA
ggtgggattcctgagcgttctgctaggcct

SEQ ID NO: 14632 - DNA, 30 bp, Homo sapiens
  misc_feature 1..30: note = chr3:196754516-196754546
  misc_feature 1..30: note = hypo
  source 1..30: mol_type = genomic DNA
ccgggcctggcagggcgaggtcggctcctt

SEQ ID NO: 14633 - DNA, 34 bp, Homo sapiens
  misc_feature 1..34: note = chr3:197313900-197313934
  misc_feature 1..34: note = hypo
  source 1..34: mol_type = genomic DNA
tataagaacccaacacggcgaaaccccgtctcta

SEQ ID NO: 14634 - DNA, 38 bp, Homo sapiens; identical to SEQ ID NO: 5012
  misc_feature 1..38: note = chr3:197327004-197327042
  misc_feature 1..38: note = hypo
  source 1..38: mol_type = genomic DNA

SEQ ID NO: 14635 - DNA, 34 bp, Homo sapiens
  misc_feature 1..34: note = chr3:197327804-197327838
  misc_feature 1..34: note = hypo
  source 1..34: mol_type = genomic DNA
ccagctggttacacacgagcgcgcgacatgtcca

SEQ ID NO: 14636 - DNA, 32 bp, Homo sapiens
  misc_feature 1..32: note = chr3:197402171-197402203
  misc_feature 1..32: note = hypo
  source 1..32: mol_type = genomic DNA
cccctggggaggccccgcgaggtgctgagtgg

SEQ ID NO: 14637 - DNA, 61 bp, Homo sapiens
  misc_feature 1..61: note = chr4:619541-619602
  misc_feature 1..61: note = hypo
  source 1..61: mol_type = genomic DNA
gactgcgacagcctccgggacctctgccaggtggaggagagcacggcgctgctggagctgg

SEQ ID NO: 14638 - DNA, 30 bp, Homo sapiens
  misc_feature 1..30: note = chr4:628444-628474
  misc_feature 1..30: note = hypo
  source 1..30: mol_type = genomic DNA
ctctttcctctcttgcggcagtgccctcac

SEQ ID NO: 14639 - DNA, 402 bp, Homo sapiens
  misc_feature 1..402: note = chr4:650912-651314
  misc_feature 1..402: note = hypo
  source 1..402: mol_type = genomic DNA
gtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtccaggggtcacc

SEQ ID NO: 14640 - DNA, 137 bp, Homo sapiens
  misc_feature 1..137: note = chr4:660921-661058
  misc_feature 1..137: note = hypo
  source 1..137: mol_type = genomic DNA
atggagggggagactcgatggggcaggggtctgaccgtggggccctgtgtgatgcccataagagccagctgcctccggccacactccctggtgatggaatccacgccccaaggaggatgccacgggttccacatgaa

SEQ ID NO: 14641 - DNA, 59 bp, Homo sapiens
  misc_feature 1..59: note = chr4:718181-718240
  misc_feature 1..59: note = hypo
  source 1..59: mol_type = genomic DNA
caccctggtggacagcggtgctgtgggggccatggaccagaaggcggagcccatgctgt

SEQ ID NO: 14642 - DNA, 102 bp, Homo sapiens
  misc_feature 1..102: note = chr4:738388-738490
  misc_feature 1..102: note = hypo
  source 1..102: mol_type = genomic DNA
tgaaaccaaagcagacgacagttcaaacaaagaggccgcggaggagaagccggaggaggacaacgactaccaccgcagcgacgagcaggtgggcggggcccg

SEQ ID NO: 14643 - DNA, 82 bp, Homo sapiens
  misc_feature 1..82: note = chr4:828978-829060
  misc_feature 1..82: note = hypo
  source 1..82: mol_type = genomic DNA
gcacccactgcagctcgcctgcggtaggacagtcggggtctgctgccacctggggcttctggggggacgtggagtcctcagc

SEQ ID NO: 14644 - DNA, 52 bp, Homo sapiens
  misc_feature 1..52: note = chr4:829611-829663
  misc_feature 1..52: note = hypo
  source 1..52: mol_type = genomic DNA
cagacacccggactgcgtcctcaggagtggagctccccgaggaaagagtgcc

SEQ ID NO: 14645 - DNA, 33 bp, Homo sapiens
  misc_feature 1..33: note = chr4:955421-955454
  misc_feature 1..33: note = hypo
  source 1..33: mol_type = genomic DNA
gcctgcccatggccccgccgggcagagcctctg

SEQ ID NO: 14646 - DNA, 450 bp, Homo sapiens
  misc_feature 1..450: note = chr4:955885-956335
  misc_feature 1..450: note = hypo
  source 1..450: mol_type = genomic DNA
tcatctcccaggacccggccgccctcaccaggccccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagca

SEQ ID NO: 14647 - DNA, 179 bp, Homo sapiens
  misc_feature 1..179: note = chr4:956578-956757
  misc_feature 1..179: note = hypo
  source 1..179: mol_type = genomic DNA
ggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatc

SEQ ID NO: 14648 - DNA, 42 bp, Homo sapiens
  misc_feature 1..42: note = chr4:1016960-1017002
  misc_feature 1..42: note = hypo
  source 1..42: mol_type = genomic DNA
ggacattccacagcacgccctgcccctcggcattgtgtggaa

SEQ ID NO: 14649 - DNA, 36 bp, Homo sapiens
  misc_feature 1..36: note = chr4:1024375-1024411
  misc_feature 1..36: note = hypo
  source 1..36: mol_type = genomic DNA
cccaggggccgcactcgccaccgttggcctcctctg

SEQ ID NO: 14650 - DNA, 262 bp, Homo sapiens
  misc_feature 1..262: note = chr4:1025875-1026137
  misc_feature 1..262: note = hypo
  source 1..262: mol_type = genomic DNA
cctgggcacgcaggccgacatggattctgtggctgaggccgtcagcgtgtgaaagccacagacacaggcgggcccggagtgcctgtccaccccgaggcgcctgccctggcccggcctctccttcctgggtgtcggaagaccttcatctatgcccctgccctgtacccgctcagtgggctgagcacgggcagggtgtggttctgaggggcaaccccaccagcctgcttgggccccagcgtcttctcagcgtctgcctcctgtg

SEQ ID NO: 14651 - DNA, 117 bp, Homo sapiens
  misc_feature 1..117: note = chr4:1036393-1036510
  misc_feature 1..117: note = hypo
  source 1..117: mol_type = genomic DNA
atccaccccccacaccgacacacacctacagtgacacccgcacactgacacacacccactcctgcacactgacacccactcctgcacactgacacacacccccgcacagacacacac

SEQ ID NO: 14652 - DNA, 108 bp, Homo sapiens
  misc_feature 1..108: note = chr4:1299074-1299182
  misc_feature 1..108: note = hypo
  source 1..108: mol_type = genomic DNA
tgcactaggtgagcccggccctggtgagggtgccttgtgagtggagcctgcttgtgctgctgtgccccgctgcttccaggcggcgcggccctccgtctgattgctgga

SEQ ID NO: 14653 - DNA, 30 bp, Homo sapiens; identical to SEQ ID NO: 5013
  misc_feature 1..30: note = chr4:1299450-1299480
  misc_feature 1..30: note = hypo
  source 1..30: mol_type = genomic DNA

SEQ ID NO: 14654 - DNA, 88 bp, Homo sapiens
  misc_feature 1..88: note = chr4:1332572-1332660
  misc_feature 1..88: note = hypo
  source 1..88: mol_type = genomic DNA
cagggctgtgtggggcgggcagggcagcggggccaggctggcacacgtcgccattgggacagggctgtcctctcgccccaccctgcct

SEQ ID NO: 14655 - DNA, 178 bp, Homo sapiens
  misc_feature 1..178: note = chr4:1332886-1333064
  misc_feature 1..178: note = hypo
  source 1..178: mol_type = genomic DNA
ataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttg

SEQ ID NO: 14656 - DNA, 91 bp, Homo sapiens
  misc_feature 1..91: note = chr4:1338688-1338779
  misc_feature 1..91: note = hypo
  source 1..91: mol_type = genomic DNA
ctggcagaagcttcccggcagagggatccgctccccagaggccgtgtggcagcaagagcaggctggagaagtcaaccggtgggatgcaggg

SEQ ID NO: 14657 - DNA, 138 bp, Homo sapiens
  misc_feature 1..138: note = chr4:1504936-1505074
  misc_feature 1..138: note = hypo
  source 1..138: mol_type = genomic DNA
gagctggcctgcccacggggcatcgctgcacgtggtagggggtgacctgggccgaaggaggataccgggcctctgctagggcagggaggccaagggagtttgggccggaggggacaccctgagcgccccacctgcctc

SEQ ID NO: 14658 - DNA, 54 bp, Homo sapiens
  misc_feature 1..54: note = chr4:1512344-1512398
  misc_feature 1..54: note = hypo
  source 1..54: mol_type = genomic DNA
tgcggttttaacctgcgttttcctgataattagcaatgtcgagcatcttttcat

SEQ ID NO: 14659 - DNA, 81 bp, Homo sapiens
  misc_feature 1..81: note = chr4:1556398-1556479
  misc_feature 1..81: note = hypo
  source 1..81: mol_type = genomic DNA
tgtccacccccagaccgccttctgcctgtgcagccacggcccccaccagcctcgacctgcccgtcccgtcatccatttatt

SEQ ID NO: 14660 - DNA, 30 bp, Homo sapiens
  misc_feature 1..30: note = chr4:1562145-1562175
  misc_feature 1..30: note = hypo
  source 1..30: mol_type = genomic DNA
atccactgcaaaatgcgtcatttcttgttg

SEQ ID NO: 14661 - DNA, 30 bp, Homo sapiens
  misc_feature 1..30: note = chr4:1576463-1576493
  misc_feature 1..30: note = hypo
  source 1..30: mol_type = genomic DNA
aggtgggcctggagccggtgggtggggctg

SEQ ID NO: 14662 - DNA, 276 bp, Homo sapiens
  misc_feature 1..276: note = chr4:1616600-1616876
  misc_feature 1..276: note = hypo
  source 1..276: mol_type = genomic DNA
ggggtgccccatggccgtcctatgctgacggacaccagatggcatttcagcaccgggcacaggggccgctttaaacagcaaaatcaccaaagggacacgagagcaaaaacatggcacacgcaaaccacaaaaaaggacatttacagatgagcagagacagaaggcaggatgcggccacgcccaccccacctgggcacacagaaggcaggacacgaccacgcccacctcacctggggacacaagggaggcaggatgcagccacgcccaccccacctg

SEQ ID NO: 14663 - DNA, 235 bp, Homo sapiens
  misc_feature 1..235: note = chr4:1687244-1687479
  misc_feature 1..235: note = hypo
  source 1..235: mol_type = genomic DNA
tgctgggggaggcatcggggctcccaggggtcaggctggggcctcccaacaggttctgggcctggtaaggctagtccggtgcaggctgcgaagccaggccagctgacaccaggactggctggagtcagcctcacctgtctggaagagtgggagtcccagcggggctggggaggggagaagggctggagcaggcgtccaggccattctcttcgctggggtccggtaatcccccacc

SEQ ID NO: 14664 - DNA, 82 bp, Homo sapiens
  misc_feature 1..82: note = chr4:1803282-1803364
  misc_feature 1..82: note = hypo
  source 1..82: mol_type = genomic DNA
tctgggcctggcaggcgcggtggttgctgcctccgctcactcacccgcccgcgtcccggtgcagctgcggcatcagcagtgg

SEQ ID NO: 14665 - DNA, 147 bp, Homo sapiens
  misc_feature 1..147: note = chr4:1807505-1807652
  misc_feature 1..147: note = hypo
  source 1..147: mol_type = genomic DNA
gccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtac

SEQ ID NO: 14666 - DNA, 61 bp, Homo sapiens
  misc_feature 1..61: note = chr4:1977033-1977094
  misc_feature 1..61: note = hypo
  source 1..61: mol_type = genomic DNA
ttttaactacaacctcgattgtctgggcaatgaaaaaacggtctgccggtgtggagcctcc

SEQ ID NO: 14667 - DNA, 298 bp, Homo sapiens
  misc_feature 1..298: note = chr4:1993830-1994128
  misc_feature 1..298: note = hypo
  source 1..298: mol_type = genomic DNA
gagcaggcaggtgcccggcacagcagagcgcaggagcagggtggagtcacctgccgcgggggtgtgtgcctgggcagcagggggtggggcctgggacctggggcagcacccgtgacagctgagctggtgcctagtcaccatctaggcagggacggctgcctctgggtctggacggcgctgggagttggcgctcgtggagcctggaggtggccccgggatctggagtgaggccagggccttggggaggccatgggcgacgtgcgtggaggaagcaggcgcaccccgtgctccctcaata

SEQ ID NO: 14668 - DNA, 74 bp, Homo sapiens
  misc_feature 1..74: note = chr4:1994756-1994830
  misc_feature 1..74: note = hypo
  source 1..74: mol_type = genomic DNA
gaagcgctgcgcacacgctgcctctggcagccgcacagcccggctgtttccagccagtgcggcctctccacagc

SEQ ID NO: 14669 - DNA, 33 bp, Homo sapiens
  misc_feature 1..33: note = chr4:2065634-2065667
  misc_feature 1..33: note = hypo
  source 1..33: mol_type = genomic DNA
gaaggtgctggagttcgccgtggtgcacaacta

SEQ ID NO: 14670 - DNA, 151 bp, Homo sapiens; identical to SEQ ID NO: 5014
  misc_feature 1..151: note = chr4:2066114-2066265
  misc_feature 1..151: note = hypo
  source 1..151: mol_type = genomic DNA

SEQ ID NO: 14671 - DNA, 236 bp, Homo sapiens; identical to SEQ ID NO: 5015
  misc_feature 1..236: note = chr4:2305682-2305918
  misc_feature 1..236: note = hypo
  source 1..236: mol_type = genomic DNA

SEQ ID NO: 14672 - DNA, 35 bp, Homo sapiens
  misc_feature 1..35: note = chr4:2527902-2527937
  misc_feature 1..35: note = hypo
  source 1..35: mol_type = genomic DNA
aaacttcattgtaaaatgaacgggaaagaaaactt

SEQ ID NO: 14673 - DNA, 36 bp, Homo sapiens
  misc_feature 1..36: note = chr4:2932947-2932983
  misc_feature 1..36: note = hypo
  source 1..36: mol_type = genomic DNA
gctcaccatagccagcgaccacggaggacaggcagg

SEQ ID NO: 14674 - DNA, 30 bp, Homo sapiens
  misc_feature 1..30: note = chr4:3310521-3310551
  misc_feature 1..30: note = hypo
  source 1..30: mol_type = genomic DNA
ttcagggctgggagccgctctgtcaggatt

SEQ ID NO: 14675 - DNA, 47 bp, Homo sapiens
  misc_feature 1..47: note = chr4:3445894-3445941
  misc_feature 1..47: note = hypo
  source 1..47: mol_type = genomic DNA
tgggcctcggaggtccgcaggggtccaggggccggagcaagtccccg

SEQ ID NO: 14676 - DNA, 304 bp, Homo sapiens
  misc_feature 1..304: note = chr4:3446463-3446767
  misc_feature 1..304: note = hypo
  source 1..304: mol_type = genomic DNA
agtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggat

SEQ ID NO: 14677 - DNA, 158 bp, Homo sapiens; identical to SEQ ID NO: 5016
  misc_feature 1..158: note = chr4:3447821-3447979
  misc_feature 1..158: note = hypo
  source 1..158: mol_type = genomic DNA

SEQ ID NO: 14678 - DNA, 82 bp, Homo sapiens
  misc_feature 1..82: note = chr4:4256159-4256241
  misc_feature 1..82: note = hypo
  source 1..82: mol_type = genomic DNA
ggtttctcacagaagcgaagtcaacgtgagcacaacagctgtctgctgcactggcagaaaagggccgcgagtgagcctctaa

SEQ ID NO: 14679 - DNA, 47 bp, Homo sapiens
  misc_feature 1..47: note = chr4:6670153-6670200
  misc_feature 1..47: note = hypo
  source 1..47: mol_type = genomic DNA
acgtgcaagacaccacgttttactgccccgcccggctagcagtggac

SEQ ID NO: 14680 - DNA, 37 bp, Homo sapiens
  misc_feature 1..37: note = chr4:6719869-6719906
  misc_feature 1..37: note = hypo
  source 1..37: mol_type = genomic DNA
gcatggtatatttctttcctctcgaaatggatagtta

SEQ ID NO: 14681 - DNA, 153 bp, Homo sapiens
  misc_feature 1..153: note = chr4:6748421-6748574
  misc_feature 1..153: note = hypo
  source 1..153: mol_type = genomic DNA
ctctgtgtgcccctgcggggagaatcgcccctgccgaagccccggctggtccaaaaccacgccagccgctttaggggtgtctgtggacccaggaccacacagcctcaagagccaagagtcccgagtgtgtgcacctgtcggcctgggtctgga

SEQ ID NO: 14682 - DNA, 30 bp, Homo sapiens
  misc_feature 1..30: note = chr4:6957585-6957615
  misc_feature 1..30: note = hypo
  source 1..30: mol_type = genomic DNA
tcggacacgtaagtccgagtcgcagctctg

SEQ ID NO: 14683 - DNA, 110 bp, Homo sapiens
  misc_feature 1..110: note = chr4:7047093-7047203
  misc_feature 1..110: note = hypo
  source 1..110: mol_type = genomic DNA
gggagcctccttgttcgttattccccctccaccccattcccctattccacacaccataaccggagcgagctttggaagcacaaagcgcctcacaccggcctcagtggctt

SEQ ID NO: 14684 - DNA, 214 bp, Homo sapiens
  misc_feature 1..214: note = chr4:7647740-7647954
  misc_feature 1..214: note = hypo
  source 1..214: mol_type = genomic DNA
tgccctagagtcaaacgtgttcattcggtcagcaaatgggccttgcgcacccggcagccacggattccgggctaccgctggtgccgcaggtgagcgaggcaggtgtgtgcccccgggctgtgagcggcttagccgaggagcaggagataaactcccaggacgcaaggaagtcagcaaacagctgtgcaggcgtgagctccgcacagcgcacacg

SEQ ID NO: 14685 - DNA, 179 bp, Homo sapiens
  misc_feature 1..179: note = chr4:7741325-7741504
  misc_feature 1..179: note = hypo
  source 1..179: mol_type = genomic DNA
caggtgaaggatgggcgaggactcaggcaaggactcaggtgtgtctgggctgtgccgcgggtgctcccagccgtgtctcccggtgcccttgaggcggggcagctctgggtcctgggtcctcgacctgtctccttgactcctaaccagcccccacccgggacacccggctcaccccttgg

SEQ ID NO: 14686 - DNA, 38 bp, Homo sapiens
  misc_feature 1..38: note = chr4:8607740-8607778
  misc_feature 1..38: note = hypo
  source 1..38: mol_type = genomic DNA
caacattcatggcaacgaggtggcgggccgggagatgc

SEQ ID NO: 14687 - DNA, 33 bp, Homo sapiens
  misc_feature 1..33: note = chr4:8608618-8608651
  misc_feature 1..33: note = hypo
  source 1..33: mol_type = genomic DNA
gggtaaggtaggagccgccgctgcccatgctgg

SEQ ID NO: 14688 - DNA, 30 bp, Homo sapiens
  misc_feature 1..30: note = chr4:8615890-8615920
  misc_feature 1..30: note = hypo
  source 1..30: mol_type = genomic DNA
gaggggcgtctgtggcgagtacctgctgca

SEQ ID NO: 14689 - DNA, 55 bp, Homo sapiens
  misc_feature 1..55: note = chr4:39448324-39448379
  misc_feature 1..55: note = hypo
  source 1..55: mol_type = genomic DNA
ggtggctgaacccatcgacggccgaggccttccaggcctacgctgggctgtgctt

SEQ ID NO: 14690 - DNA, 98 bp, Homo sapiens; identical to SEQ ID NO: 5017
  misc_feature 1..98: note = chr4:39816677-39816775
  misc_feature 1..98: note = hypo
  source 1..98: mol_type = genomic DNA

SEQ ID NO: 14691 - DNA, 38 bp, Homo sapiens; identical to SEQ ID NO: 5018
  misc_feature 1..38: note = chr4:39817075-39817113
  misc_feature 1..38: note = hypo
  source 1..38: mol_type = genomic DNA

SEQ ID NO: 14692 - DNA, 30 bp, Homo sapiens
  misc_feature 1..30: note = chr4:40910280-40910310
  misc_feature 1..30: note = hypo
  source 1..30: mol_type = genomic DNA
actgtgagaaaagaacgtttctgtagttga

SEQ ID NO: 14693 - DNA, 28 bp, Homo sapiens
  misc_feature 1..28: note = chr4:74468515-74468543
  misc_feature 1..28: note = hypo
  source 1..28: mol_type = genomic DNA
caagtttcggccaggcgcggtggctcat

SEQ ID NO: 14694 - DNA, 150 bp, Homo sapiens; identical to SEQ ID NO: 5019
  misc_feature 1..150: note = chr4:75241329-75241479
  misc_feature 1..150: note = hypo
  source 1..150: mol_type = genomic DNA

SEQ ID NO: 14695 - DNA, 30 bp, Homo sapiens
  misc_feature 1..30: note = chr4:76912406-76912436
  misc_feature 1..30: note = hypo
  source 1..30: mol_type = genomic DNA
aaaattagaaactgacgcctgtaatcccag

SEQ ID NO: 14696 - DNA, 41 bp, Homo sapiens
  misc_feature 1..41: note = chr4:84169961-84170002
  misc_feature 1..41: note = hypo
  source 1..41: mol_type = genomic DNA
tggcaggctcaccaccggttctatgccgcagggctgttgta

SEQ ID NO: 14697 - DNA, 37 bp, Homo sapiens
  misc_feature 1..37: note = chr4:87899606-87899643
  misc_feature 1..37: note = hypo
  source 1..37: mol_type = genomic DNA
tataggtgtgagccaccatgcccggcctacattcact

SEQ ID NO: 14698 - DNA, 86 bp, Homo sapiens; identical to SEQ ID NO: 1559
  misc_feature 1..86: note = chr4:95127609-95127695
  misc_feature 1..86: note = hypo
  source 1..86: mol_type = genomic DNA

SEQ ID NO: 14699 - DNA, 18 bp, Homo sapiens
  misc_feature 1..18: note = chr4:95762911-95762929
  misc_feature 1..18: note = hypo
  source 1..18: mol_type = genomic DNA
attcggccatcttggctc

SEQ ID NO: 14700 - DNA, 24 bp, Homo sapiens
  misc_feature 1..24: note = chr4:110735814-110735838
  misc_feature 1..24: note = hypo
  source 1..24: mol_type = genomic DNA
accacgccccgcctacaaaggtat

SEQ ID NO: 14701 - DNA, 30 bp, Homo sapiens
  misc_feature 1..30: note = chr4:113154853-113154883
  misc_feature 1..30: note = hypo
  source 1..30: mol_type = genomic DNA
ttttcatggggtctccgtagagtacggcat

SEQ ID NO: 14702 - DNA, 35 bp, Homo sapiens
  misc_feature 1..35: note = chr4:113559151-113559186
  misc_feature 1..35: note = hypo
  source 1..35: mol_type = genomic DNA
tattaaaacattttgcgaggctgggcacggtggct

SEQ ID NO: 14703 - DNA, 34 bp, Homo sapiens
  misc_feature 1..34: note = chr4:113559426-113559460
  misc_feature 1..34: note = hypo
  source 1..34: mol_type = genomic DNA
gggccactgagagaggctgcgtctccaaacaaac

SEQ ID NO: 14704 - DNA, 89 bp, Homo sapiens
  misc_feature 1..89: note = chr4:123866964-123867053
  misc_feature 1..89: note = hypo
  source 1..89: mol_type = genomic DNA
tttactgtctagtggcagaaagtaaatatgtgaaaataatataaaggtttggcactaagtcacttatatactaacgtgttagtaatttt

SEQ ID NO: 14705 - DNA, 27 bp, Homo sapiens
  misc_feature 1..27: note = chr4:128984288-128984315
  misc_feature 1..27: note = hypo
  source 1..27: mol_type = genomic DNA
aaagtaaaaatgggccggcgcggtggc

SEQ ID NO: 14706 - DNA, 135 bp, Homo sapiens
  misc_feature 1..135: note = chr4:154216763-154216898
  misc_feature 1..135: note = hypo
  source 1..135: mol_type = genomic DNA
gcggcagaccatcatcgggcagcccatgtccgtcaccatcaccaccaaggacaaagacggtgagctgtgcaaaaccggcaacgcctacctcaccgccgaactgagcacccccgacgggagcgtggcagacgggga

SEQ ID NO: 14707 - DNA, 65 bp, Homo sapiens
  misc_feature 1..65: note = chr4:154540165-154540230
  misc_feature 1..65: note = hypo
  source 1..65: mol_type = genomic DNA
tctttgtcatactcacggagaactctttgatgcttctggtcaccgagtcccgcctctcagtagtc

SEQ ID NO: 14708 - DNA, 67 bp, Homo sapiens
  misc_feature 1..67: note = chr4:170484641-170484708
  misc_feature 1..67: note = hypo
  source 1..67: mol_type = genomic DNA
aatgctgcttcaccacgattttctaggtaggtaatcatatcaaatgtaaatacgatatgtctatgtt

SEQ ID NO: 14709 - DNA, 30 bp, Homo sapiens
  misc_feature 1..30: note = chr4:184375696-184375726
  misc_feature 1..30: note = hypo
  source 1..30: mol_type = genomic DNA
gccaccacgcccggccgatcctgcttcttt

SEQ ID NO: 14710 - DNA, 164 bp, Homo sapiens
  misc_feature 1..164: note = chr5:480880-481044
  misc_feature 1..164: note = hypo
  source 1..164: mol_type = genomic DNA
caagcaaacacagatcgctcagaaaatgggaacccagggcaaattgtatgtgctccttactgggtttattataagtgtcacatgttttttataataaaacataggtgatttcaccttaatggacaaactcttttttttattttgggacgaagtctcgctctgtc

SEQ ID NO: 14711 - DNA, 30 bp, Homo sapiens
  misc_feature 1..30: note = chr5:488962-488992
  misc_feature 1..30: note = hypo
  source 1..30: mol_type = genomic DNA
ggacgggcccggagccgggacacacagcac

SEQ ID NO: 14712 - DNA, 420 bp, Homo sapiens; identical to SEQ ID NO: 5022
  misc_feature 1..420: note = chr5:491335-491755
  misc_feature 1..420: note = hypo
  source 1..420: mol_type = genomic DNA

SEQ ID NO: 14713 - DNA, 32 bp, Homo sapiens
  misc_feature 1..32: note = chr5:492064-492096
  misc_feature 1..32: note = hypo
  source 1..32: mol_type = genomic DNA
cgtcagtgtgaaggacgcgatgtggtcggccg

SEQ ID NO: 14714 - DNA, 265 bp, Homo sapiens
  misc_feature 1..265: note = chr5:538686-538951
  misc_feature 1..265: note = hypo
  source 1..265: mol_type = genomic DNA
cctgtgcctgcctgacgatgccgcctcagccgcccagggctccctcagggaaaacgtcgccaagcaccgacggctcaagggagtaaccgcgcctctgggagatggcgtccctgacttggctgtggcaccaggctggccaggggactgttggaacatttgcggaggagcacagttgccatttccttcatgccacacctgccccagcttgtgtctgtgtgtgatggcacggtttgggctggcaggaggggcacgggtgcttgggtgt

SEQ ID NO: 14715 - DNA, 617 bp, Homo sapiens; identical to SEQ ID NO: 5023
  misc_feature 1..617: note = chr5:554299-554916
  misc_feature 1..617: note = hypo
  source 1..617: mol_type = genomic DNA

SEQ ID NO: 14716 - DNA, 17 bp, Homo sapiens
  misc_feature 1..17: note = chr5:555156-555173
  misc_feature 1..17: note = hypo
  source 1..17: mol_type = genomic DNA
aacgggggggtgggtca

SEQ ID NO: 14717 - DNA, 94 bp, Homo sapiens
  misc_feature 1..94: note = chr5:556211-556305
  misc_feature 1..94: note = hypo
  source 1..94: mol_type = genomic DNA
ccttggctccacctgcgcttctggtctcggctgccctgacagccactgggctccaggcaggcctgggtggtgaggacggcgctgggctgcggcc

SEQ ID NO: 14718 - DNA, 140 bp, Homo sapiens; identical to SEQ ID NO: 5025
  misc_feature 1..140: note = chr5:677883-678023
  misc_feature 1..140: note = hypo
  source 1..140: mol_type = genomic DNA

SEQ ID NO: 14719 - DNA, 30 bp, Homo sapiens
  misc_feature 1..30: note = chr5:1003129-1003159
  misc_feature 1..30: note = hypo
  source 1..30: mol_type = genomic DNA
cgcccgggtgtgcttcgaactgagaagcca

SEQ ID NO: 14720 - DNA, 38 bp, Homo sapiens
  misc_feature 1..38: note = chr5:1021444-1021482
  misc_feature 1..38: note = hypo
  source 1..38: mol_type = genomic DNA
cccctttgctcctcccgctgacccggccccccgcccct

SEQ ID NO: 14721 - DNA, 260 bp, Homo sapiens
  misc_feature 1..260: note = chr5:1034370-1034630
  misc_feature 1..260: note = hypo
  source 1..260: mol_type = genomic DNA
gtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttcacgtgtgtttctgggccgagcctgcgccgcc

SEQ ID NO: 14722 - DNA, 82 bp, Homo sapiens
  misc_feature 1..82: note = chr5:1073600-1073682
  misc_feature 1..82: note = hypo
  source 1..82: mol_type = genomic DNA
tgagctcaaagccaccgccacggctaaaacacagcagcgccacgcacagcaccgtgttgacacgctgcgatgaggacatgcc

SEQ ID NO: 14723 - DNA, 136 bp, Homo sapiens
  misc_feature 1..136: note = chr5:1073918-1074054
  misc_feature 1..136: note = hypo
  source 1..136: mol_type = genomic DNA
gcagccagggtggggcggctgttaccacggcaacgcttaccagggcacggcccatcaacaggcagggcagatgggacgggcggggcacacgacacaggtgggacgggagatacatgacaggcgggacaggggacaa

SEQ ID NO: 14724 - DNA, 125 bp, Homo sapiens; identical to SEQ ID NO: 5026
  misc_feature 1..125: note = chr5:1174263-1174388
  misc_feature 1..125: note = hypo
  source 1..125: mol_type = genomic DNA

SEQ ID NO: 14725 - DNA, 32 bp, Homo sapiens
  misc_feature 1..32: note = chr5:1189595-1189627
  misc_feature 1..32: note = hypo
  source 1..32: mol_type = genomic DNA
ctgtgctggacacaacgcggcaagacaagaaa

SEQ ID NO: 14726 - DNA, 71 bp, Homo sapiens
  misc_feature 1..71: note = chr5:1193902-1193973
  misc_feature 1..71: note = hypo
  source 1..71: mol_type = genomic DNA
ctggagcaggcacagcgagccagggtgcgaggcccggacagctctgagcggaacagcgagccacctgcagc

SEQ ID NO: 14727 - DNA, 30 bp, Homo sapiens
  misc_feature 1..30: note = chr5:1221181-1221211
  misc_feature 1..30: note = hypo
  source 1..30: mol_type = genomic DNA
gttcgggtagcagaacgtacagaaagctta

SEQ ID NO: 14728 - DNA, 30 bp, Homo sapiens
  misc_feature 1..30: note = chr5:1223271-1223301
  misc_feature 1..30: note = hypo
  source 1..30: mol_type = genomic DNA
tctctgcgttctggccgcttcccggcttaa

SEQ ID NO: 14729 - DNA, 30 bp, Homo sapiens
  misc_feature 1..30: note = chr5:1233049-1233079
  misc_feature 1..30: note = hypo
  source 1..30: mol_type = genomic DNA
aggcatgtgctgcagcgtgtccagcatcag

SEQ ID NO: 14730 - DNA, 836 bp, Homo sapiens; identical to SEQ ID NO: 409
  misc_feature 1..836: note = chr5:1294607-1295443
  misc_feature 1..836: note = hypo
  source 1..836: mol_type = genomic DNA

SEQ ID NO: 14731 - DNA, 47 bp, Homo sapiens
  misc_feature 1..47: note = chr5:1746593-1746640
  misc_feature 1..47: note = hypo
  source 1..47: mol_type = genomic DNA
cctgcctgggctgcccggggaccctcctgctgcgtcagcacagagcc

SEQ ID NO: 14732 - DNA, 151 bp, Homo sapiens
  misc_feature 1..151: note = chr5:1747003-1747154
  misc_feature 1..151: note = hypo
  source 1..151: mol_type = genomic DNA
tgggtgctgggtccccggcgtcagggcgcaatgccgcctgctgggcgtcaccctttcccagggctgctgggacacgtggccgcagctgcttggctcaccacagcggaagtcggtctctctcatcctggagtccgcgcggctgagggcgagg

SEQ ID NO: 14733 - DNA, 30 bp, Homo sapiens
  misc_feature 1..30: note = chr5:1795233-1795263
  misc_feature 1..30: note = hypo
  source 1..30: mol_type = genomic DNA
acagccatgcccactcgcagggaggcaggg

SEQ ID NO: 14734 - DNA, 30 bp, Homo sapiens
  misc_feature 1..30: note = chr5:1865547-1865577
  misc_feature 1..30: note = hypo
  source 1..30: mol_type = genomic DNA
gaaaaacgaagccaccgcgattatgattat

SEQ ID NO: 14735 - DNA, 30 bp, Homo sapiens
  misc_feature 1..30: note = chr5:1949574-1949604
  misc_feature 1..30: note = hypo
  source 1..30: mol_type = genomic DNA
tgggatgggggtgcccgcccagggcagtgc

SEQ ID NO: 14736 - DNA, 394 bp, Homo sapiens
  misc_feature 1..394: note = chr5:1950777-1951171
  misc_feature 1..394: note = hypo
  source 1..394: mol_type = genomic DNA
ccctcggcagcttcacgacctcaccaagtgcccgccgctctcacgagagaggtggttatggttgcgcattgaatatgcttgggagaggcaaagatggatggcgtagtctctaccctcacacccagtgctgagcgcgagtcgtccgctgtgtgtgcatcatctgctgtgcgtgtgtcatctgctgtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgct

SEQ ID NO: 14737 - DNA, 150 bp, Homo sapiens
  misc_feature 1..150: note = chr5:2136920-2137070
  misc_feature 1..150: note = hypo
  source 1..150: mol_type = genomic DNA
gggcccgtgtgtgtgcgtgggcagaagtgactgggcgtgcgtgtgtggacagaagtgaccgggcgcgcctgtgtgggcgggcagaggtgactgggccagcatgcgtgggtgggcagaggtgaccgggcatgcgtgcgtgggcgggcagag

SEQ ID NO: 14738 - DNA, 30 bp, Homo sapiens
  misc_feature 1..30: note = chr5:2180638-2180668
  misc_feature 1..30: note = hypo
  source 1..30: mol_type = genomic DNA
gctcgcgtcctctcacgagatacggggctg

SEQ ID NO: 14739 - DNA, 68 bp, Homo sapiens
  misc_feature 1..68: note = chr5:2369614-2369682
  misc_feature 1..68: note = hypo
  source 1..68: mol_type = genomic DNA
atgcaaacacatgcacgggcacgcatgcacacacagacacagggcattcctcccgcctcaggcaccct

SEQ ID NO: 14740 - DNA, 149 bp, Homo sapiens
  misc_feature 1..149: note = chr5:2541481-2541630
  misc_feature 1..149: note = hypo
  source 1..149: mol_type = genomic DNA
gtgtgcctgtgtgcacgcatgcgtgtgcaggctctgctgtgtgtgtgtggtgtgtgcctgtgtgcacgcatgcatgtgcgggctctgctgtgcatgtctgtgtatcgtgtgactgcgtgcatgcttgcatgtgccgactctgatgtgcg

SEQ ID NO: 14741 - DNA, 30 bp, Homo sapiens
  misc_feature 1..30: note = chr5:3221107-3221137
  misc_feature 1..30: note = hypo
  source 1..30: mol_type = genomic DNA
tgctccaggcaaatgcgtggcatcattcat

SEQ ID NO: 14742 - DNA, 275 bp, Homo sapiens; identical to SEQ ID NO: 5028
  misc_feature 1..275: note = chr5:3324844-3325119
  misc_feature 1..275: note = hypo
  source 1..275: mol_type = genomic DNA

SEQ ID NO: 14743 - DNA, 176 bp, Homo sapiens
  misc_feature 1..176: note = chr5:3674048-3674224
  misc_feature 1..176: note = hypo
  source 1..176: mol_type = genomic DNA
ctctgccagtcactccgctccggctgctccttatgttttcctcagcacccccggcagctgggtctgggcgtgtttgtgctggtggttccttctgcacagatgctgctcccggccttcctgcagggctcatccctcagctccttcctggatgccaccttctccggtaagcatgccct

SEQ ID NO: 14744 - DNA, 30 bp, Homo sapiens
  misc_feature 1..30: note = chr5:3740976-3741006
  misc_feature 1..30: note = hypo
  source 1..30: mol_type = genomic DNA
tcgccttctctcctgcgcgcagctggcggc

SEQ ID NO: 14745 - DNA, 165 bp, Homo sapiens
  misc_feature 1..165: note = chr5:3806428-3806593
  misc_feature 1..165: note = hypo
  source 1..165: mol_type = genomic DNA
acattcaggtacccccgaatcctgcaacgatgggtgcttaggatgagttgttccatttctcaagcaaggttcactgtcgtgttcgcacatggcattttatcaaaggtttccacctaccaacgcagaaattcaaatcatgcttttgcgcaacgagagctcagttct

SEQ ID NO: 14746 - DNA, 30 bp, Homo sapiens
  misc_feature 1..30: note = chr5:4144357-4144387
  misc_feature 1..30: note = hypo
  source 1..30: mol_type = genomic DNA
atgtgttctgtgtgccgtgctcttgcgtgc

SEQ ID NO: 14747 - DNA, 32 bp, Homo sapiens
  misc_feature 1..32: note = chr5:4629575-4629607
  misc_feature 1..32: note = hypo
  source 1..32: mol_type = genomic DNA
catcctttaaccctccgcgccgtacaccaccc

SEQ ID NO: 14748 - DNA, 20 bp, Homo sapiens
  misc_feature 1..20: note = chr5:10248726-10248746
  misc_feature 1..20: note = hypo
  source 1..20: mol_type = genomic DNA
tatagcgcactgtaaactga

SEQ ID NO: 14749 - DNA, 167 bp, Homo sapiens
  misc_feature 1..167: note = chr5:10267279-10267446
  misc_feature 1..167: note = hypo
  source 1..167: mol_type = genomic DNA
ccaaaggcaaatggccgagaaagtgttgaagggcaggaaaagtggggaaaacacgacaaggtagtaaaaatataaatgtgtgtgccctatcactgctctaaatggtttatgtacattaaaactggttttcaaagtctgctccatggatccctcggggtcctgggtct

SEQ ID NO: 14750 - DNA, 30 bp, Homo sapiens
  misc_feature 1..30: note = chr5:10675402-10675432
  misc_feature 1..30: note = hypo
  source 1..30: mol_type = genomic DNA
gaacataagcctttacggtgacactgcctg

SEQ ID NO: 14751 - DNA, 30 bp, Homo sapiens
  misc_feature 1..30: note = chr5:14732034-14732064
  misc_feature 1..30: note = hypo
  source 1..30: mol_type = genomic DNA
gcccagggagctgcgcgagtgtcacgtgaa

SEQ ID NO: 14752 - DNA, 28 bp, Homo sapiens
  misc_feature 1..28: note = chr5:14774569-14774597
  misc_feature 1..28: note = hypo
  source 1..28: mol_type = genomic DNA
acagtcgcgctctgtcgcccagtctgga

SEQ ID NO: 14753 - DNA, 30 bp, Homo sapiens
  misc_feature 1..30: note = chr5:16032780-16032810
  misc_feature 1..30: note = hypo
  source 1..30: mol_type = genomic DNA
tagcatctttattaccgcactctaaaccac

SEQ ID NO: 14754 - DNA, 78 bp, Homo sapiens
  misc_feature 1..78: note = chr5:16436327-16436405
  misc_feature 1..78: note = hypo
  source 1..78: mol_type = genomic DNA
gcttgcaggccagcacgagttccgggtgggtgtggactcggcacgcccggcactcggagcctccggccatccctgccg

SEQ ID NO: 14755 - DNA, 104 bp, Homo sapiens; identical to SEQ ID NO: 5029
  misc_feature 1..104: note = chr5:17203073-17203177
  misc_feature 1..104: note = hypo
  source 1..104: mol_type = genomic DNA

SEQ ID NO: 14756 - DNA, 57 bp, Homo sapiens
  misc_feature 1..57: note = chr5:17502391-17502448
  misc_feature 1..57: note = hypo
  source 1..57: mol_type = genomic DNA
gtgcccttttgctggcggctttagtggccagggtcttcgtggcgcctgccaggcggt

SEQ ID NO: 14757 - DNA, 16 bp, Homo sapiens
  misc_feature 1..16: note = chr5:32526565-32526581
  misc_feature 1..16: note = hypo
  source 1..16: mol_type = genomic DNA
cttctccacgccgggc

SEQ ID NO: 14758 - DNA, 30 bp, Homo sapiens
  misc_feature 1..30: note = chr5:33162572-33162602
  misc_feature 1..30: note = hypo
  source 1..30: mol_type = genomic DNA
ggtgaagaattgcatcgtgctcatcgacag

SEQ ID NO: 14759 - DNA, 25 bp, Homo sapiens
  misc_feature 1..25: note = chr5:33234426-33234451
  misc_feature 1..25: note = hypo
  source 1..25: mol_type = genomic DNA
tgagctgacacgcctggctgaattt

SEQ ID NO: 14760 - DNA, 27 bp, Homo sapiens
  misc_feature 1..27: note = chr5:33298124-33298151
  misc_feature 1..27: note = hypo
  source 1..27: mol_type = genomic DNA
gcaccctgctggcgcaccctgctggcg

SEQ ID NO: 14761 - DNA, 35 bp, Homo sapiens
  misc_feature 1..35: note = chr5:37255512-37255547
  misc_feature 1..35: note = hypo
  source 1..35: mol_type = genomic DNA
accaaaacaaacattcttggcggtgggtgcaggac

SEQ ID NO: 14762 - DNA, 32 bp, Homo sapiens
  misc_feature 1..32: note = chr5:39343165-39343197
  misc_feature 1..32: note = hypo
  source 1..32: mol_type = genomic DNA
tgaacaggaacagctcgtttacagctcccagc

SEQ ID NO: 14763 - DNA, 33 bp, Homo sapiens; identical to SEQ ID NO: 1561
  misc_feature 1..33: note = chr5:43402630-43402663
  misc_feature 1..33: note = hypo
  source 1..33: mol_type = genomic DNA

SEQ ID NO: 14764 - DNA, 30 bp, Homo sapiens
  misc_feature 1..30: note = chr5:64860574-64860604
  misc_feature 1..30: note = hypo
  source 1..30: mol_type = genomic DNA
cattctaaaatcactcgagaatcggtcttg

SEQ ID NO: 14765 - DNA, 30 bp, Homo sapiens
  misc_feature 1..30: note = chr5:67840329-67840359
  misc_feature 1..30: note = hypo
  source 1..30: mol_type = genomic DNA
cttgctacagcttaacgtttcagcacattt

SEQ ID NO: 14766 - DNA, 22 bp, Homo sapiens
  misc_feature 1..22: note = chr5:68391002-68391024
  misc_feature 1..22: note = hypo
  source 1..22: mol_type = genomic DNA
gtaatagcattataacgtaact

SEQ ID NO: 14767 - DNA, 21 bp, Homo sapiens
  misc_feature 1..21: note = chr5:74536034-74536055
  misc_feature 1..21: note = hypo
  source 1..21: mol_type = genomic DNA
aatttttttttgagacggagt

SEQ ID NO: 14768 - DNA, 17 bp, Homo sapiens
  misc_feature 1..17: note = chr5:77047294-77047311
  misc_feature 1..17: note = hypo
  source 1..17: mol_type = genomic DNA
gccggccagcctgacca

SEQ ID NO: 14769 - DNA, 30 bp, Homo sapiens
  misc_feature 1..30: note = chr5:78985161-78985191
  misc_feature 1..30: note = hypo
  source 1..30: mol_type = genomic DNA
gctgctggagctcttcggagtctcagtttc

SEQ ID NO: 14770 - DNA, 31 bp, Homo sapiens; identical to SEQ ID NO: 5032
  misc_feature 1..31: note = chr5:79783240-79783271
  misc_feature 1..31: note = hypo
  source 1..31: mol_type = genomic DNA

SEQ ID NO: 14771 - DNA, 90 bp, Homo sapiens; identical to SEQ ID NO: 5033
  misc_feature 1..90: note = chr5:79947584-79947674
  misc_feature 1..90: note = hypo
  source 1..90: mol_type = genomic DNA

SEQ ID NO: 14772 - DNA, 30 bp, Homo sapiens; identical to SEQ ID NO: 5034
  misc_feature 1..30: note = chr5:79947734-79947764
  misc_feature 1..30: note = hypo
  source 1..30: mol_type = genomic DNA

SEQ ID NO: 14773 - DNA, 86 bp, Homo sapiens; identical to SEQ ID NO: 5035
  misc_feature 1..86: note = chr5:94982139-94982225
  misc_feature 1..86: note = hypo
  source 1..86: mol_type = genomic DNA

SEQ ID NO: 14774 - DNA, 30 bp, Homo sapiens
  misc_feature 1..30: note = chr5:98201074-98201104
  misc_feature 1..30: note = hypo
  source 1..30: mol_type = genomic DNA
ggcacagaaatataacggtgtgactttatt

SEQ ID NO: 14775 - DNA, 45 bp, Homo sapiens
  misc_feature 1..45: note = chr5:111987773-111987818
  misc_feature 1..45: note = hypo
  source 1..45: mol_type = genomic DNA
gctgggattacaggcgtgagccaccgcgcccggcctccaggtcac

SEQ ID NO: 14776 - DNA, 172 bp, Homo sapiens
  misc_feature 1..172: note = chr5:112198328-112198500
  misc_feature 1..172: note = hypo
  source 1..172: mol_type = genomic DNA
atcctggtcgggccacgtaatcttgttagagccgcagggggttctcttcactgcatttatttagggcttgagaacacagccaagaattggggtgcgttcctcagtgttggtgaaaccagaaaggcattaattcatagctgaagggatatttttttaacgtctcttaatgagc

SEQ ID NO: 14777 - DNA, 30 bp, Homo sapiens
  misc_feature 1..30: note = chr5:126200056-126200086
  misc_feature 1..30: note = hypo
  source 1..30: mol_type = genomic DNA
aatgagatacaataacgtagttgttttgga

SEQ ID NO: 14778 - DNA, 30 bp, Homo sapiens
  misc_feature 1..30: note = chr5:131610019-131610049
  misc_feature 1..30: note = hypo
  source 1..30: mol_type = genomic DNA
tgcccaccctgcctccgctgacttggtccc

SEQ ID NO: 14779 - DNA, 30 bp, Homo sapiens
  misc_feature 1..30: note = chr5:132083934-132083964
  misc_feature 1..30: note = hypo
  source 1..30: mol_type = genomic DNA
cactgccccaccccccgcaccttaagcagg

SEQ ID NO: 14780 - DNA, 31 bp, Homo sapiens
  misc_feature 1..31: note = chr5:137548023-137548054
  misc_feature 1..31: note = hypo
  source 1..31: mol_type = genomic DNA
tttgagacagtgtcccgctctgccctcgggc

SEQ ID NO: 14781 - DNA, 30 bp, Homo sapiens
  misc_feature 1..30: note = chr5:137769708-137769738
  misc_feature 1..30: note = hypo
  source 1..30: mol_type = genomic DNA
gtgagtcaccgtgcccgtccaacattggtg

SEQ ID NO: 14782 - DNA, 19 bp, Homo sapiens
  misc_feature 1..19: note = chr5:139556366-139556385
  misc_feature 1..19: note = hypo
  source 1..19: mol_type = genomic DNA
agacctggcctggtgcggt

SEQ ID NO: 14783 - DNA, 21 bp, Homo sapiens
  misc_feature 1..21: note = chr5:139779846-139779867
  misc_feature 1..21: note = hypo
  source 1..21: mol_type = genomic DNA
ccacggcgcccgctatagaat

SEQ ID NO: 14784 - DNA, 30 bp, Homo sapiens
  misc_feature 1..30: note = chr5:151383730-151383760
  misc_feature 1..30: note = hypo
  source 1..30: mol_type = genomic DNA
agacgcgcaagtcctcgggaggagacgcat

SEQ ID NO: 14785 - DNA, 25 bp, Homo sapiens
  misc_feature 1..25: note = chr5:154030048-154030073
  misc_feature 1..25: note = hypo
  source 1..25: mol_type = genomic DNA
tttttatttttgagacgaaatttca

SEQ ID NO: 14786 - DNA, 30 bp, Homo sapiens; identical to SEQ ID NO: 1562
  misc_feature 1..30: note = chr5:154209957-154209987
  misc_feature 1..30: note = hypo
  source 1..30: mol_type = genomic DNA

SEQ ID NO: 14787 - DNA, 19 bp, Homo sapiens
  misc_feature 1..19: note = chr5:154318148-154318167
  misc_feature 1..19: note = hypo
  source 1..19: mol_type = genomic DNA
atatgcacaagaggccggg

SEQ ID NO: 14788 - DNA, 30 bp, Homo sapiens
  misc_feature 1..30: note = chr5:157078407-157078437
  misc_feature 1..30: note = hypo
  source 1..30: mol_type = genomic DNA
cgagcctgcagtcctcgaggagtctctcgg

SEQ ID NO: 14789 - DNA, 39 bp, Homo sapiens
  misc_feature 1..39: note = chr5:158612937-158612976
  misc_feature 1..39: note = hypo
  source 1..39: mol_type = genomic DNA
tatgaaaagggcctccggccatggtagctcaagcctgta

SEQ ID NO: 14790 - DNA, 22 bp, Homo sapiens
  misc_feature 1..22: note = chr5:159672080-159672102
  misc_feature 1..22: note = hypo
  source 1..22: mol_type = genomic DNA
ggtaggggctgggtgcggtggc

SEQ ID NO: 14791 - DNA, 28 bp, Homo sapiens
  misc_feature 1..28: note = chr5:166865441-166865469
  misc_feature 1..28: note = hypo
  source 1..28: mol_type = genomic DNA
gctggagtgcagtggcgccatctcggct

SEQ ID NO: 14792 - DNA, 141 bp, Homo sapiens
  misc_feature 1..141: note = chr5:168192180-168192321
  misc_feature 1..141: note = hypo
  source 1..141: mol_type = genomic DNA
gtggctggggacagccgcctattaaatgcattttcattttaatcaaggtgagagcagcctgtagttagcaggaatcgctctcagtagtatagttagattataactggtggacctctgcaatggagccgctgacccatttta

SEQ ID NO: 14793 - DNA, 30 bp, Homo sapiens
  misc_feature 1..30: note = chr5:168268106-168268136
  misc_feature 1..30: note = hypo
  source 1..30: mol_type = genomic DNA
cctgcagcccacagccgccatgcttcaggg

SEQ ID NO: 14794 - DNA, 17 bp, Homo sapiens
  misc_feature 1..17: note = chr5:168337470-168337487
  misc_feature 1..17: note = hypo
  source 1..17: mol_type = genomic DNA
gggcgtggtggctcacg

SEQ ID NO: 14795 - DNA, 30 bp, Homo sapiens
  misc_feature 1..30: note = chr5:169157436-169157466
  misc_feature 1..30: note = hypo
  source 1..30: mol_type = genomic DNA
gatgaatttggacagcgagtcagaggctac

SEQ ID NO: 14796 - DNA, 71 bp, Homo sapiens; identical to SEQ ID NO: 5038
  misc_feature 1..71: note = chr5:169532927-169532998
  misc_feature 1..71: note = hypo
  source 1..71: mol_type = genomic DNA

SEQ ID NO: 14797 - DNA, 30 bp, Homo sapiens
  misc_feature 1..30: note = chr5:172235667-172235697
  misc_feature 1..30: note = hypo
  source 1..30: mol_type = genomic DNA
ctgcctcagccaccacgcccagcccctaaa

SEQ ID NO: 14798 - DNA, 30 bp, Homo sapiens
  misc_feature 1..30: note = chr5:175610717-175610747
  misc_feature 1..30: note = hypo
  source 1..30: mol_type = genomic DNA
ggccatcagggctggcgcttaagtgactga

SEQ ID NO: 14799 - DNA, 17 bp, Homo sapiens
  misc_feature 1..17: note = chr5:175876289-175876306
  misc_feature 1..17: note = hypo
  source 1..17: mol_type = genomic DNA
cccccaggccaggagcg

SEQ ID NO: 14800 - DNA, 17 bp, Homo sapiens
  misc_feature 1..17: note = chr5:175876606-175876623
  misc_feature 1..17: note = hypo
  source 1..17: mol_type = genomic DNA
ttcgggagatcaaatgg

SEQ ID NO: 14801 - DNA, 30 bp, Homo sapiens
  misc_feature 1..30: note = chr5:175924856-175924886
  misc_feature 1..30: note = hypo
  source 1..30: mol_type = genomic DNA
aatgcagaatcaggccgagcatgttggctc

SEQ ID NO: 14802 - DNA, 20 bp, Homo sapiens
  misc_feature 1..20: note = chr5:175971447-175971467
  misc_feature 1..20: note = hypo
  source 1..20: mol_type = genomic DNA
ctttcctttttttgacggag

SEQ ID NO: 14803 - DNA, 30 bp, Homo sapiens
  misc_feature 1..30: note = chr5:175975036-175975066
  misc_feature 1..30: note = hypo
  source 1..30: mol_type = genomic DNA
cagtctctataccaccgcctgtgctcctgg

SEQ ID NO: 14804 - DNA, 23 bp, Homo sapiens
  misc_feature 1..23: note = chr5:175978997-175979020
  misc_feature 1..23: note = hypo
  source 1..23: mol_type = genomic DNA
accgcgcccggttaatagttccc

SEQ ID NO: 14805 - DNA, 30 bp, Homo sapiens
  misc_feature 1..30: note = chr5:176225880-176225910
  misc_feature 1..30: note = hypo
  source 1..30: mol_type = genomic DNA
tctccttctaattaccggtttaattaacct

SEQ ID NO: 14806 - DNA, 92 bp, Homo sapiens
  misc_feature 1..92: note = chr5:176315380-176315472
  misc_feature 1..92: note = hypo
  source 1..92: mol_type = genomic DNA
agtgtttgttgctcccggctgtgctggaggcaggagagaacagcggccagggcggcagcacagagctgggcagcccgcgtgcacacggccgc

SEQ ID NO: 14807 - DNA, 20 bp, Homo sapiens
  misc_feature 1..20: note = chr5:177019993-177020013
  misc_feature 1..20: note = hypo
  source 1..20: mol_type = genomic DNA
ccttctgtcacttttcgtta

SEQ ID NO: 14808 - DNA, 43 bp, Homo sapiens
  misc_feature 1..43: note = chr5:177031179-177031222
  misc_feature 1..43: note = hypo
  source 1..43: mol_type = genomic DNA
gtccgggttgctctccggcggcctccctcggaagtgttccgtc

SEQ ID NO: 14809 - DNA, 43 bp, Homo sapiens
  misc_feature 1..43: note = chr5:177713462-177713505
  misc_feature 1..43: note = hypo
  source 1..43: mol_type = genomic DNA
ccccacactcagcttcgtctttaattcccgacagtcctgtcat

SEQ ID NO: 14810 - DNA, 30 bp, Homo sapiens
  misc_feature 1..30: note = chr5:177982679-177982709
  misc_feature 1..30: note = hypo
  source 1..30: mol_type = genomic DNA
cttggctccaggacacgtggagtgggacca

SEQ ID NO: 14811 - DNA, 30 bp, Homo sapiens
  misc_feature 1..30: note = chr5:178481870-178481900
  misc_feature 1..30: note = hypo
  source 1..30: mol_type = genomic DNA
tgtggtcttttgctccgcatcaccttgctt

SEQ ID NO: 14812 - DNA, 34 bp, Homo sapiens
  misc_feature 1..34: note = chr5:178565449-178565483
  misc_feature 1..34: note = hypo
  source 1..34: mol_type = genomic DNA
aaagcagacgcatcacggccgctgggttttctcc

SEQ ID NO: 14813 - DNA, 143 bp, Homo sapiens
  misc_feature 1..143: note = chr5:178576356-178576499
  misc_feature 1..143: note = hypo
  source 1..143: mol_type = genomic DNA
cagcctccaggactgcgaagaacaaggctctgttgtgtaagccacccagtctgcggtatttctgttagagcagccgaagctgaggaagatggagtgtgagctgtcctggcaccgtggaaggctgcggccggggcagactctaa

SEQ ID NO: 14814 - DNA, 155 bp, Homo sapiens
  misc_feature 1..155: note = chr5:178655753-178655908
  misc_feature 1..155: note = hypo
  source 1..155: mol_type = genomic DNA
gtggggctccagacccggggcggtgccttcaccacggcctcctcatccagcatccacaactctggagctaggaagcccggtgctccttcccagaggagggagccgaagctctgccagtctgcactgaagtctgtggtgtgcggtcacctgagaac

SEQ ID NO: 14815 - DNA, 49 bp, Homo sapiens
  misc_feature 1..49: note = chr5:178665413-178665462
  misc_feature 1..49: note = hypo
  source 1..49: mol_type = genomic DNA
gtgctctgagtatgccggagggcagtgagtgctgcgggaaggggctgga

SEQ ID NO: 14816 - DNA, 30 bp, Homo sapiens
  misc_feature 1..30: note = chr5:178878685-178878715
  misc_feature 1..30: note = hypo
  source 1..30: mol_type = genomic DNA
ggctctcagtggagccgagcccagagagaa

SEQ ID NO: 14817 - DNA, 27 bp, Homo sapiens
  misc_feature 1..27: note = chr5:178969579-178969606
  misc_feature 1..27: note = hypo
  source 1..27: mol_type = genomic DNA
agaatgggccaggtgcggtggctcacg

SEQ ID NO: 14818 - DNA, 193 bp, Homo sapiens
  misc_feature 1..193: note = chr5:179214072-179214265
  misc_feature 1..193: note = hypo
  source 1..193: mol_type = genomic DNA
aggggtggggcccagcgggatcccagcatcgtggctctggctcacccagacaaacccggatctgccacccaagtgcccaagtctccagcctgccagtgacagagaccagcgttggtctcctcaagggactgagtgaggagaccagtcaccacccggtgcaaactgagtcccttccacgcgggaaagggccacg

SEQ ID NO: 14819 - DNA, 30 bp, Homo sapiens
  misc_feature 1..30: note = chr5:180041104-180041134
  misc_feature 1..30: note = hypo
  source 1..30: mol_type = genomic DNA
ccacacgtcactctgcgtggtgtacacctt

SEQ ID NO: 14820 - DNA, 53 bp, Homo sapiens
  misc_feature 1..53: note = chr5:180057500-180057553
  misc_feature 1..53: note = hypo
  source 1..53: mol_type = genomic DNA
tgggccccagctgcccgggaccctgctccagcctggcccgcctccaagtctca

SEQ ID NO: 14821 - DNA, 33 bp, Homo sapiens
  misc_feature 1..33: note = chr5:180709002-180709035
  misc_feature 1..33: note = hypo
  source 1..33: mol_type = genomic DNA
tgtggttggtggtggcgacggagactgcatctc

SEQ ID NO: 14822 - DNA, 35 bp, Homo sapiens
  misc_feature 1..35: note = chr6:348724-348759
  misc_feature 1..35: note = hypo
  source 1..35: mol_type = genomic DNA
tgcacatgtgtgtgacgtttcgggtttgtttccat

SEQ ID NO: 14823 - DNA, 39 bp, Homo sapiens
  misc_feature 1..39: note = chr6:448927-448966
  misc_feature 1..39: note = hypo
  source 1..39: mol_type = genomic DNA
tgtgttgctgaagcccggagtgcacgcccagcgcgtggt

SEQ ID NO: 14824 - DNA, 52 bp, Homo sapiens
  misc_feature 1..52: note = chr6:3053334-3053386
  misc_feature 1..52: note = hypo
  source 1..52: mol_type = genomic DNA
gctccaggctcttcacgagttctttgaaagccgctggcgttgactccattac

SEQ ID NO: 14825 - DNA, 332 bp, Homo sapiens; identical to SEQ ID NO: 5040
  misc_feature 1..332: note = chr6:3285157-3285489
  misc_feature 1..332: note = hypo
  source 1..332: mol_type = genomic DNA

SEQ ID NO: 14826 - DNA, 30 bp, Homo sapiens; identical to SEQ ID NO: 1564
  misc_feature 1..30: note = chr6:4951289-4951319
  misc_feature 1..30: note = hypo
  source 1..30: mol_type = genomic DNA

SEQ ID NO: 14827 - DNA, 30 bp, Homo sapiens
  misc_feature 1..30: note = chr6:6045657-6045687
  misc_feature 1..30: note = hypo
  source 1..30: mol_type = genomic DNA
tataaaatcacaactcggaagcactatgaa

SEQ ID NO: 14828 - DNA, 37 bp, Homo sapiens
  misc_feature 1..37: note = chr6:6367079-6367116
  misc_feature 1..37: note = hypo
  source 1..37: mol_type = genomic DNA
agcagtggctgtaatcggcctgcggggctctctcctg

SEQ ID NO: 14829 - DNA, 61 bp, Homo sapiens
  misc_feature 1..61: note = chr6:6534792-6534853
  misc_feature 1..61: note = hypo
  source 1..61: mol_type = genomic DNA
caggcgtccaggcaccgcgcccaggagagccagctctgagcatccccggggggccactcct

SEQ ID NO: 14830 - DNA, 66 bp, Homo sapiens
  misc_feature 1..66: note = chr6:6891420-6891486
  misc_feature 1..66: note = hypo
  source 1..66: mol_type = genomic DNA
tgggggaggaggcagcggcacaacaggttcccacatcacctggagagcaggcgcattacttcctcc

SEQ ID NO: 14831 - DNA, 21 bp, Homo sapiens
  misc_feature 1..21: note = chr6:7237775-7237796
  misc_feature 1..21: note = hypo
  source 1..21: mol_type = genomic DNA
cgctcgcgttggggcttgcag

SEQ ID NO: 14832 - DNA, 16 bp, Homo sapiens
  misc_feature 1..16: note = chr6:10595805-10595821
  misc_feature 1..16: note = hypo
  source 1..16: mol_type = genomic DNA
ccggttggttgggttg

SEQ ID NO: 14833 - DNA, 186 bp, Homo sapiens; identical to SEQ ID NO: 1565
  misc_feature 1..186: note = chr6:12288517-12288703
  misc_feature 1..186: note = hypo
  source 1..186: mol_type = genomic DNA

SEQ ID NO: 14834 - DNA, 30 bp, Homo sapiens
  misc_feature 1..30: note = chr6:13293172-13293202
  misc_feature 1..30: note = hypo
  source 1..30: mol_type = genomic DNA
tgtcccctacagcatcgcaggtttgagggt

SEQ ID NO: 14835 - DNA, 38 bp, Homo sapiens
  misc_feature 1..38: note = chr6:15456030-15456068
  misc_feature 1..38: note = hypo
  source 1..38: mol_type = genomic DNA
ttacaggcatgagtcaccatgcccggcgaagccaggtt

SEQ ID NO: 14836 - DNA, 30 bp, Homo sapiens
  misc_feature 1..30: note = chr6:16197009-16197039
  misc_feature 1..30: note = hypo
  source 1..30: mol_type = genomic DNA
agtagaaaacaaaagcgggctgaaccaagc

SEQ ID NO: 14837 - DNA, 25 bp, Homo sapiens
  misc_feature 1..25: note = chr6:16218445-16218470
  misc_feature 1..25: note = hypo
  source 1..25: mol_type = genomic DNA
gcctgcacaccggggctgtaaatgg

SEQ ID NO: 14838 - DNA, 30 bp, Homo sapiens
  misc_feature 1..30: note = chr6:16293453-16293483
  misc_feature 1..30: note = hypo
  source 1..30: mol_type = genomic DNA
ggaatttgtaaaaggcgacaccaccactta

SEQ ID NO: 14839 - DNA, 30 bp, Homo sapiens
  misc_feature 1..30: note = chr6:18035850-18035880
  misc_feature 1..30: note = hypo
  source 1..30: mol_type = genomic DNA
gtcctcaccactctccgtggagaacactgg

SEQ ID NO: 14840 - DNA, 92 bp, Homo sapiens
  misc_feature 1..92: note = chr6:20239485-20239577
  misc_feature 1..92: note = hypo
  source 1..92: mol_type = genomic DNA
ccgcggggcagggctcgggatctggagcccgcctgcgcctcccccgccactccgtgggctcctgcgcggccagagcctccccgaggagcgct

SEQ ID NO: 14841 - DNA, 36 bp, Homo sapiens
  misc_feature 1..36: note = chr6:24647342-24647378
  misc_feature 1..36: note = hypo
  source 1..36: mol_type = genomic DNA
aaaaccagctgggtgcggtggctcacgcctgtaatc

SEQ ID NO: 14842 - DNA, 33 bp, Homo sapiens
  misc_feature 1..33: note = chr6:26214615-26214648
  misc_feature 1..33: note = hypo
  source 1..33: mol_type = genomic DNA
ggcgtgagccaccgcgcccggccaagagaaaaa

SEQ ID NO: 14843 - DNA, 30 bp, Homo sapiens
  misc_feature 1..30: note = chr6:33955505-33955535
  misc_feature 1..30: note = hypo
  source 1..30: mol_type = genomic DNA
cactctggaggcaggcgcttttgtcatcaa

SEQ ID NO: 14844 - DNA, 120 bp, Homo sapiens; identical to SEQ ID NO: 5043
  misc_feature 1..120: note = chr6:34170868-34170988
  misc_feature 1..120: note = hypo
  source 1..120: mol_type = genomic DNA

SEQ ID NO: 14845 - DNA, 31 bp, Homo sapiens; identical to SEQ ID NO: 5044
  misc_feature 1..31: note = chr6:34171048-34171079
  misc_feature 1..31: note = hypo
  source 1..31: mol_type = genomic DNA

SEQ ID NO: 14846 - DNA, 30 bp, Homo sapiens
  misc_feature 1..30: note = chr6:34514348-34514378
  misc_feature 1..30: note = hypo
  source 1..30: mol_type = genomic DNA
gatagcatagcttgacgaatggagcctagg

SEQ ID NO: 14847 - DNA, 23 bp, Homo sapiens
  misc_feature 1..23: note = chr6:34854786-34854809
  misc_feature 1..23: note = hypo
  source 1..23: mol_type = genomic DNA
tgggtccctgatcaccgggtgcg

SEQ ID NO: 14848 - DNA, 30 bp, Homo sapiens
  misc_feature 1..30: note = chr6:35149810-35149840
  misc_feature 1..30: note = hypo
  source 1..30: mol_type = genomic DNA
caaatgtttcttgagcgctggcaacgtgcc

SEQ ID NO: 14849 - DNA, 66 bp, Homo sapiens; identical to SEQ ID NO: 5045
  misc_feature 1..66: note = chr6:35150041-35150107
  misc_feature 1..66: note = hypo
  source 1..66: mol_type = genomic DNA

SEQ ID NO: 14850 - DNA, 37 bp, Homo sapiens
  misc_feature 1..37: note = chr6:35309524-35309561
  misc_feature 1..37: note = hypo
  source 1..37: mol_type = genomic DNA
ggcctaaggagcttgcggcctacggaaggtgtggccg

SEQ ID NO: 14851 - DNA, 30 bp, Homo sapiens
  misc_feature 1..30: note = chr6:36165619-36165649
  misc_feature 1..30: note = hypo
  source 1..30: mol_type = genomic DNA
gggtgggacaaaacacgtctgtgtagagtc

SEQ ID NO: 14852 - DNA, 30 bp, Homo sapiens
  misc_feature 1..30: note = chr6:36831576-36831606
  misc_feature 1..30: note = hypo
  source 1..30: mol_type = genomic DNA
tacttgatccacactcgatgtcacccttct

SEQ ID NO: 14853 - DNA, 251 bp, Homo sapiens; identical to SEQ ID NO: 5046
  misc_feature 1..251: note = chr6:37024382-37024633
  misc_feature 1..251: note = hypo
  source 1..251: mol_type = genomic DNA

SEQ ID NO: 14854 - DNA, 30 bp, Homo sapiens
  misc_feature 1..30: note = chr6:37053276-37053306
  misc_feature 1..30: note = hypo
  source 1..30: mol_type = genomic DNA
tgataaaacccctaccgatggctgatgact

SEQ ID NO: 14855 - DNA, 30 bp, Homo sapiens
  misc_feature 1..30: note = chr6:37391410-37391440
  misc_feature 1..30: note = hypo
  source 1..30: mol_type = genomic DNA
tacctgggtggggttcgtcatctcacgctg

SEQ ID NO: 14856 - DNA, 36 bp, Homo sapiens; identical to SEQ ID NO: 5047
  misc_feature 1..36: note = chr6:42062066-42062102
  misc_feature 1..36: note = hypo
  source 1..36: mol_type = genomic DNA

SEQ ID NO: 14857 - DNA, 23 bp, Homo sapiens
  misc_feature 1..23: note = chr6:42813507-42813530
  misc_feature 1..23: note = hypo
  source 1..23: mol_type = genomic DNA
ttatagattcctggccgggcgcg

SEQ ID NO: 14858 - DNA, 38 bp, Homo sapiens
  misc_feature 1..38: note = chr6:42846392-42846430
  misc_feature 1..38: note = hypo
  source 1..38: mol_type = genomic DNA
tttttgagactgtctcgctctgtcgcccaggctggagt

SEQ ID NO: 14859 - DNA, 37 bp, Homo sapiens
  misc_feature 1..37: note = chr6:42846610-42846647
  misc_feature 1..37: note = hypo
  source 1..37: mol_type = genomic DNA
ttacaggtgaaagccaccggcccgacctactgttttt

SEQ ID NO: 14860 - DNA, 90 bp, Homo sapiens
  misc_feature 1..90: note = chr6:43424517-43424607
  misc_feature 1..90: note = hypo
  source 1..90: mol_type = genomic DNA
ggcagaggtcaggaacgctagcgcccatctctagtccttcagattgagatttcaccatctttaaattcaaaacatcggaaggagcagtcg

SEQ ID NO: 14861 - DNA, 30 bp, Homo sapiens
  misc_feature 1..30: note = chr6:43425479-43425509
  misc_feature 1..30: note = hypo
  source 1..30: mol_type = genomic DNA
agattatcactctgtcgcccaggctggagt

SEQ ID NO: 14862 - DNA, 30 bp, Homo sapiens
  misc_feature 1..30: note = chr6:43486338-43486368
  misc_feature 1..30: note = hypo
  source 1..30: mol_type = genomic DNA
gagatgggtggaagtcgatcatcagagaag

SEQ ID NO: 14863 - DNA, 48 bp, Homo sapiens
  misc_feature 1..48: note = chr6:43748487-43748535
  misc_feature 1..48: note = hypo
  source 1..48: mol_type = genomic DNA
ggaaaggggcaaaaacgaaagcgcaagaaatcccggtataagtcctgg

SEQ ID NO: 14864 - DNA, 30 bp, Homo sapiens
  misc_feature 1..30: note = chr6:44241078-44241108
  misc_feature 1..30: note = hypo
  source 1..30: mol_type = genomic DNA
catgagctgcagcaccgtgttgatgtgagc

SEQ ID NO: 14865 - DNA, 41 bp, Homo sapiens
  misc_feature 1..41: note = chr6:44437145-44437186
  misc_feature 1..41: note = hypo
  source 1..41: mol_type = genomic DNA
aaattcagctgggcacggtggctgacgcctgtaatcccagc

SEQ ID NO: 14866 - DNA, 25 bp, Homo sapiens
  misc_feature 1..25: note = chr6:52156895-52156920
  misc_feature 1..25: note = hypo
  source 1..25: mol_type = genomic DNA
gtttcaaaactttggcgccgggcgc

SEQ ID NO: 14867 - DNA, 30 bp, Homo sapiens
  misc_feature 1..30: note = chr6:52268217-52268247
  misc_feature 1..30: note = hypo
  source 1..30: mol_type = genomic DNA
ctttcagaaacacaacgaggtggtcaacgt

SEQ ID NO: 14868 - DNA, 180 bp, Homo sapiens; identical to SEQ ID NO: 5048
  misc_feature 1..180: note = chr6:52928863-52929043
  misc_feature 1..180: note = hypo
  source 1..180: mol_type = genomic DNA

SEQ ID NO: 14869 - DNA, 30 bp, Homo sapiens
  misc_feature 1..30: note = chr6:57694608-57694638
  misc_feature 1..30: note = hypo
  source 1..30: mol_type = genomic DNA
ctaaggacaaagaaccgccagtaacaacat

SEQ ID NO: 14870 - DNA, 23 bp, Homo sapiens
  misc_feature 1..23: note = chr6:74234189-74234212
  misc_feature 1..23: note = hypo
  source 1..23: mol_type = genomic DNA
gaaaagatgatggcccggtgcgg

SEQ ID NO: 14871 - DNA, 102 bp, Homo sapiens
  misc_feature 1..102: note = chr6:84513455-84513557
  misc_feature 1..102: note = hypo
  source 1..102: mol_type = genomic DNA
gctgttcctattcggccatcttggctcctcctcctaagctgtaactctattcatttcttatatacgtggctggttctgggtcccttgcggtaaaatgatgta

SEQ ID NO: 14872 - DNA, 97 bp, Homo sapiens; identical to SEQ ID NO: 1566
  misc_feature 1..97: note = chr6:86302345-86302442
  misc_feature 1..97: note = hypo
  source 1..97: mol_type = genomic DNA

SEQ ID NO: 14873 - DNA, 81 bp, Homo sapiens
  misc_feature 1..81: note = chr6:89857646-89857727
  misc_feature 1..81: note = hypo
  source 1..81: mol_type = genomic DNA
tgagcactgtagaaccgccaaaaaaaagctaaactttgagaaatgtacactcttttttttttttttttttttttgagacag

SEQ ID NO: 14874 - DNA, 30 bp, Homo sapiens
  misc_feature 1..30: note = chr6:90367322-90367352
  misc_feature 1..30: note = hypo
  source 1..30: mol_type = genomic DNA
ttctgaaaaacaacacgaacctgattctcc

SEQ ID NO: 14875 - DNA, 29 bp, Homo sapiens
  misc_feature 1..29: note = chr6:99396702-99396731
  misc_feature 1..29: note = hypo
  source 1..29: mol_type = genomic DNA
gctgggattacagccgtgagccaccgcgc

SEQ ID NO: 14876 - DNA, 30 bp, Homo sapiens
  misc_feature 1..30: note = chr6:105750542-105750572
  misc_feature 1..30: note = hypo
  source 1..30: mol_type = genomic DNA
gaattgtggatgacacggatcttagagagc

SEQ ID NO: 14877 - DNA, 42 bp, Homo sapiens
  misc_feature 1..42: note = chr6:108280341-108280383
  misc_feature 1..42: note = hypo
  source 1..42: mol_type = genomic DNA
ctccactgggcgacagatttgaatctacgctgtgcccatctt

SEQ ID NO: 14878 - DNA, 17 bp, Homo sapiens
  misc_feature 1..17: note = chr6:109057736-109057753
  misc_feature 1..17: note = hypo
  source 1..17: mol_type = genomic DNA
tgttaggaatattctcg

SEQ ID NO: 14879 - DNA, 82 bp, Homo sapiens
  misc_feature 1..82: note = chr6:109059835-109059917
  misc_feature 1..82: note = hypo
  source 1..82: mol_type = genomic DNA
gaaagagagggcttccgagaggaaaaagaaccagagaagagccagttggccatggatgtgccggatttcatagtcaggcttg

SEQ ID NO: 14880 - DNA, 30 bp, Homo sapiens
  misc_feature 1..30: note = chr6:116574057-116574087
  misc_feature 1..30: note = hypo
  source 1..30: mol_type = genomic DNA
tctctgcaattctgtcgaattctagaaggc

SEQ ID NO: 14881 - DNA, 24 bp, Homo sapiens
  misc_feature 1..24: note = chr6:134067447-134067471
  misc_feature 1..24: note = hypo
  source 1..24: mol_type = genomic DNA
gagccaccgcgcccagcctgcctg

SEQ ID NO: 14882 - DNA, 104 bp, Homo sapiens; identical to SEQ ID NO: 1568
  misc_feature 1..104: note = chr6:134589500-134589604
  misc_feature 1..104: note = hypo
  source 1..104: mol_type = genomic DNA

SEQ ID NO: 14883 - DNA, 99 bp, Homo sapiens; identical to SEQ ID NO: 5053
  misc_feature 1..99: note = chr6:137144497-137144596
  misc_feature 1..99: note = hypo
  source 1..99: mol_type = genomic DNA

SEQ ID NO: 14884 - DNA, 92 bp, Homo sapiens
  misc_feature 1..92: note = chr6:138790478-138790570
  misc_feature 1..92: note = hypo
  source 1..92: mol_type = genomic DNA
aacataaggcttatgcgtttaatttccacaccaatttcaggatctttgtcactgacagcagcactaagacttgttaactttatatagttaag

SEQ ID NO: 14885 - DNA, 151 bp, Homo sapiens
  misc_feature 1..151: note = chr6:149177419-149177570
  misc_feature 1..151: note = hypo
  source 1..151: mol_type = genomic DNA
gggattacaggagtgagccactgtggccagccgaaaaatatgttttgattaatattatgtaaggtaaataggggaaacgttcacaaagatgattcatgctaaacaaataaaaccagagccacatccatcagcataacgtagtgcaataaaa

SEQ ID NO: 14886 - DNA, 20 bp, Homo sapiens
  misc_feature 1..20: note = chr6:154970558-154970578
  misc_feature 1..20: note = hypo
  source 1..20: mol_type = genomic DNA
gaaaaatggcattaccggcc

SEQ ID NO: 14887 - DNA, 30 bp, Homo sapiens
  misc_feature 1..30: note = chr6:155988231-155988261
  misc_feature 1..30: note = hypo
  source 1..30: mol_type = genomic DNA
aaatagctctcccaccgctgatgccactta

SEQ ID NO: 14888 - DNA, 39 bp, Homo sapiens
  misc_feature 1..39: note = chr6:157478299-157478338
  misc_feature 1..39: note = hypo
  source 1..39: mol_type = genomic DNA
tcggagatggctcaccgtgactcgcgcaccactgtctat

SEQ ID NO: 14889 - DNA, 30 bp, Homo sapiens
  misc_feature 1..30: note = chr6:157637384-157637414
  misc_feature 1..30: note = hypo
  source 1..30: mol_type = genomic DNA
cagcttcctgtagctcgtcccaaggtccat

SEQ ID NO: 14890 - DNA, 30 bp, Homo sapiens
  misc_feature 1..30: note = chr6:157638386-157638416
  misc_feature 1..30: note = hypo
  source 1..30: mol_type = genomic DNA
ccgcagtgctcctcccgagcctgcttcatt

SEQ ID NO: 14891 - DNA, 30 bp, Homo sapiens
  misc_feature 1..30: note = chr6:158119028-158119058
  misc_feature 1..30: note = hypo
  source 1..30: mol_type = genomic DNA
cctggaagcaggtgtcgataaaaagagtca

SEQ ID NO: 14892 - DNA, 82 bp, Homo sapiens
  misc_feature 1..82: note = chr6:159049801-159049883
  misc_feature 1..82: note = hypo
  source 1..82: mol_type = genomic DNA
tctggagcgtgcccacgccacgctgctttccacccagaggggcaggtgctgtgaggtaaatgaggtgcggttgcctctccac

SEQ ID NO: 14893 - DNA, 30 bp, Homo sapiens
  misc_feature 1..30: note = chr6:159569380-159569410
  misc_feature 1..30: note = hypo
  source 1..30: mol_type = genomic DNA
gacttcagccgagaacgtgccagttgggtg

SEQ ID NO: 14894 - DNA, 55 bp, Homo sapiens
  misc_feature 1..55: note = chr6:160511899-160511954
  misc_feature 1..55: note = hypo
  source 1..55: mol_type = genomic DNA
aaggagcaggtgctccgtgccctggtgctgagctcatcgccgagaaggagcaggt

SEQ ID NO: 14895 - DNA, 39 bp, Homo sapiens
  misc_feature 1..39: note = chr6:161672733-161672772
  misc_feature 1..39: note = hypo
  source 1..39: mol_type = genomic DNA
gccaagcccacttcccgggccttacgtttcccattcaaa

SEQ ID NO: 14896 - DNA, 32 bp, Homo sapiens
  misc_feature 1..32: note = chr6:161690517-161690549
  misc_feature 1..32: note = hypo
  source 1..32: mol_type = genomic DNA
taccgccagggcaggcgcggtggctcacgcct

SEQ ID NO: 14897 - DNA, 81 bp, Homo sapiens
  misc_feature 1..81: note = chr6:161780138-161780219
  misc_feature 1..81: note = hypo
  source 1..81: mol_type = genomic DNA
tataggtgcatgccaatcccttcattttctaggagcactgctgcatgcaatggagtaataaggacacgctgggtaaattat

SEQ ID NO: 14898 - DNA, 41 bp, Homo sapiens
  misc_feature 1..41: note = chr6:162257990-162258031
  misc_feature 1..41: note = hypo
  source 1..41: mol_type = genomic DNA
gggttttatgcctctcgttttcgctccgctcccacactcct

SEQ ID NO: 14899 - DNA, 18 bp, Homo sapiens
  misc_feature 1..18: note = chr6:164114295-164114313
  misc_feature 1..18: note = hypo
  source 1..18: mol_type = genomic DNA
ttatttttttgagaccga

SEQ ID NO: 14900 - DNA, 44 bp, Homo sapiens
  misc_feature 1..44: note = chr6:164183729-164183773
  misc_feature 1..44: note = hypo
  source 1..44: mol_type = genomic DNA
gctcaatgtttttaatgcaacagaccctgcggaaggtcagtaac

SEQ ID NO: 14901 - DNA, 22 bp, Homo sapiens
  misc_feature 1..22: note = chr6:164196996-164197018
  misc_feature 1..22: note = hypo
  source 1..22: mol_type = genomic DNA
ctaaaagcgtcttctgacaaac

SEQ ID NO: 14902 - DNA, 18 bp, Homo sapiens
  misc_feature 1..18: note = chr6:164215474-164215492
  misc_feature 1..18: note = hypo
  source 1..18: mol_type = genomic DNA
gggcctggtggctcacgc

SEQ ID NO: 14903 - DNA, 98 bp, Homo sapiens
  misc_feature 1..98: note = chr6:164228329-164228427
  misc_feature 1..98: note = hypo
  source 1..98: mol_type = genomic DNA
ggcagtgggagtggccgtgcgggcctgctttgggaacagagggaccctccctgctgttctgttcacacggaagcgtgtctcagcgtctgggggcttgg

SEQ ID NO: 14904 - DNA, 34 bp, Homo sapiens
  misc_feature 1..34: note = chr6:164246109-164246143
  misc_feature 1..34: note = hypo
  source 1..34: mol_type = genomic DNA
gtgagccaccgcaccgggccgatatggaatttct

SEQ ID NO: 14905 - DNA, 30 bp, Homo sapiens
  misc_feature 1..30: note = chr6:164283234-164283264
  misc_feature 1..30: note = hypo
  source 1..30: mol_type = genomic DNA
gaagcatgtccccagcgtggcacagaaacc

SEQ ID NO: 14906 - DNA, 30 bp, Homo sapiens
  misc_feature 1..30: note = chr6:164288079-164288109
  misc_feature 1..30: note = hypo
  source 1..30: mol_type = genomic DNA
aacttatgaacaagccggggcagctgctgt

SEQ ID NO: 14907 - DNA, 36 bp, Homo sapiens
  misc_feature 1..36: note = chr6:164322607-164322643
  misc_feature 1..36: note = hypo
  source 1..36: mol_type = genomic DNA
ctgggttcccatgctcggcggcggctcctccacagg

SEQ ID NO: 14908 - DNA, 30 bp, Homo sapiens
  misc_feature 1..30: note = chr6:164323901-164323931
  misc_feature 1..30: note = hypo
  source 1..30: mol_type = genomic DNA
ataaattcctaaaagcggaatttctgggtc

SEQ ID NO: 14909 - DNA, 30 bp, Homo sapiens
  misc_feature 1..30: note = chr6:166891687-166891717
  misc_feature 1..30: note = hypo
  source 1..30: mol_type = genomic DNA
gcctgccacctgaggcggcacgtcccttgc

SEQ ID NO: 14910 - DNA, 145 bp, Homo sapiens
  misc_feature 1..145: note = chr6:166944367-166944512
  misc_feature 1..145: note = hypo
  source 1..145: mol_type = genomic DNA
aggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctctt

SEQ ID NO: 14911 - DNA, 32 bp, Homo sapiens
  misc_feature 1..32: note = chr6:167835094-167835126
  misc_feature 1..32: note = hypo
  source 1..32: mol_type = genomic DNA
gctgttttccccccacgcggatcctcacctcc

SEQ ID NO: 14912 - DNA, 30 bp, Homo sapiens
  misc_feature 1..30: note = chr6:168453452-168453482
  misc_feature 1..30: note = hypo
  source 1..30: mol_type = genomic DNA
gaaccaggcatgggccggcggcgagccggg

SEQ ID NO: 14913 - DNA, 174 bp, Homo sapiens
  misc_feature 1..174: note = chr6:168858122-168858296
  misc_feature 1..174: note = hypo
  source 1..174: mol_type = genomic DNA
ctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcac

SEQ ID NO: 14914 - DNA, 30 bp, Homo sapiens
  misc_feature 1..30: note = chr6:169562411-169562441
  misc_feature 1..30: note = hypo
  source 1..30: mol_type = genomic DNA
tcgccaccccaaatgcgggcaccgcggcgc

SEQ ID NO: 14915 - DNA, 456 bp, Homo sapiens
  misc_feature 1..456: note = chr6:170475028-170475484
  misc_feature 1..456: note = hypo
  source 1..456: mol_type = genomic DNA
ttcttgggtgacaatcgaggggtcctgacccagcacccgtgggcacacccttatttggaaattgggcctagcccggagtgatcatgaggccacgtgacatgggcgtgccagtctcaccaacgtgtgttttcacgggcaccacagagtctgttttctatgggtggggcagcggtgaacatatccctcttaatagcggtacgggtacggccagggaggcggcagaacgtagacagaacccgggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacg

SEQ ID NO: 14916 - DNA, 19 bp, Homo sapiens
  misc_feature 1..19: note = chr6:170894820-170894839
  misc_feature 1..19: note = hypo
  source 1..19: mol_type = genomic DNA
tttgagatggagtctcgct

SEQ ID NO: 14917 - DNA, 24 bp, Homo sapiens
  misc_feature 1..24: note = chr7:328544-328568
  misc_feature 1..24: note = hypo
  source 1..24: mol_type = genomic DNA
gattacaggcgtgagtcaccgtgc

SEQ ID NO: 14918 - DNA, 30 bp, Homo sapiens
  misc_feature 1..30: note = chr7:409617-409647
  misc_feature 1..30: note = hypo
  source 1..30: mol_type = genomic DNA
cggtgccaccaaggccgctctcaggctgcc

SEQ ID NO: 14919 - DNA, 271 bp, Homo sapiens
  misc_feature 1..271: note = chr7:431429-431700
  misc_feature 1..271: note = hypo
  source 1..271: mol_type = genomic DNA
tgaagccaccaggcacggggctgtgtgtgcagaagcagccaggcagggcggcccagcagacgcagggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcag

SEQ ID NO: 14920 - DNA, 36 bp, Homo sapiens
  misc_feature 1..36: note = chr7:497782-497818
  misc_feature 1..36: note = hypo
  source 1..36: mol_type = genomic DNA
ctggcctcaggtccacggctgcggccacagagccca

SEQ ID NO: 14921 - DNA, 30 bp, Homo sapiens
  misc_feature 1..30: note = chr7:502957-502987
  misc_feature 1..30: note = hypo
  source 1..30: mol_type = genomic DNA
ctgggacccagcctccggggagccgtgaag

SEQ ID NO: 14922 - DNA, 63 bp, Homo sapiens
  misc_feature 1..63: note = chr7:503811-503874
  misc_feature 1..63: note = hypo
  source 1..63: mol_type = genomic DNA
gaggctgggtcccagcgctggggaaggacaccgggccctgagggccaacgccaaacccagacg

SEQ ID NO: 14923 - DNA, 30 bp, Homo sapiens
  misc_feature 1..30: note = chr7:551654-551684
  misc_feature 1..30: note = hypo
  source 1..30: mol_type = genomic DNA
cctggggacaggccccgacaagacagggcg

SEQ ID NO: 14924 - DNA, 30 bp, Homo sapiens
  misc_feature 1..30: note = chr7:819668-819698
  misc_feature 1..30: note = hypo
  source 1..30: mol_type = genomic DNA
tgtcaagggtgccaacgcaaaatcctacta

SEQ ID NO: 14925 - DNA, 404 bp, Homo sapiens
  misc_feature 1..404: note = chr7:834330-834734
  misc_feature 1..404: note = hypo
  source 1..404: mol_type = genomic DNA
cagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccg

SEQ ID NO: 14926 - DNA, 83 bp, Homo sapiens
  misc_feature 1..83: note = chr7:1027233-1027316
  misc_feature 1..83: note = hypo
  source 1..83: mol_type = genomic DNA
actgggacggctgagcgtctggtgggtgcctgatggcccagcgctccccgaccggaggcaataaagggcgtccagccaggagc

SEQ ID NO: 14927 - DNA, 47 bp, Homo sapiens; identical to SEQ ID NO: 5055
  misc_feature 1..47: note = chr7:1030172-1030219
  misc_feature 1..47: note = hypo
  source 1..47: mol_type = genomic DNA

SEQ ID NO: 14928 - DNA, 172 bp, Homo sapiens
  misc_feature 1..172: note = chr7:1054524-1054696
  misc_feature 1..172: note = hypo
  source 1..172: mol_type = genomic DNA
gccccttcctgcctgcgggccctccctgccctgcagggacggtgcagtgagcacaggtgtgcaggctgtgcggtgagagccccagggctgggaggagcaggcagccttggtccagcaggtcctgtgtgggggccgcgttgccgggcagggcctgacacggctgctgtgggct

SEQ ID NO: 14929 - DNA, 53 bp, Homo sapiens
  misc_feature 1..53: note = chr7:1086266-1086319
  misc_feature 1..53: note = hypo
  source 1..53: mol_type = genomic DNA
tcagtttcttaggagcgtgctgtctacccaggagcctccgtgtgcaaacaaaa

SEQ ID NO: 14930 - DNA, 167 bp, Homo sapiens
  misc_feature 1..167: note = chr7:1308368-1308535
  misc_feature 1..167: note = hypo
  source 1..167: mol_type = genomic DNA
gctgccggctggggacgcgggcgtggtgcggcaggcctgccttgattgtgtcgatgggagatgattttcaaggtgaaatttctagttcactagagtcactttcgttcaaggcgacgcacaaaatgtcatcccggcctgttccgcgtgcaacgcgctgttctcccatc

SEQ ID NO: 14931 - DNA, 178 bp, Homo sapiens
  misc_feature 1..178: note = chr7:1325704-1325882
  misc_feature 1..178: note = hypo
  source 1..178: mol_type = genomic DNA
ccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtgg

SEQ ID NO: 14932 - DNA, 32 bp, Homo sapiens
  misc_feature 1..32: note = chr7:1351574-1351606
  misc_feature 1..32: note = hypo
  source 1..32: mol_type = genomic DNA
tcagctctctctgtccgcggggctgtctccct

SEQ ID NO: 14933 - DNA, 43 bp, Homo sapiens
  misc_feature 1..43: note = chr7:1384833-1384876
  misc_feature 1..43: note = hypo
  source 1..43: mol_type = genomic DNA
tggatgggcaggctgcgccgggctgatccgctgtgaacagcgg

SEQ ID NO: 14934 - DNA, 57 bp, Homo sapiens
  misc_feature 1..57: note = chr7:1395730-1395787
  misc_feature 1..57: note = hypo
  source 1..57: mol_type = genomic DNA
ctccttgctgcctcccgccttgtcctcaacagccctgaagtccgtcctccactcagc

SEQ ID NO: 14935 - DNA, 61 bp, Homo sapiens
  misc_feature 1..61: note = chr7:1459019-1459080
  misc_feature 1..61: note = hypo
  source 1..61: mol_type = genomic DNA
ccacttccacctgcccgggcctttgcacctgcaggttcgtaccctacggggtgtgccctgc

SEQ ID NO: 14936 - DNA, 30 bp, Homo sapiens
  misc_feature 1..30: note = chr7:1460840-1460870
  misc_feature 1..30: note = hypo
  source 1..30: mol_type = genomic DNA
ggcagggtgcagaggcgtgcagcgctcacc

SEQ ID NO: 14937 - DNA, 30 bp, Homo sapiens
  misc_feature 1..30: note = chr7:1503566-1503596
  misc_feature 1..30: note = hypo
  source 1..30: mol_type = genomic DNA
cgggaatgcagagggcgtgagagagaacca

SEQ ID NO: 14938 - DNA, 30 bp, Homo sapiens
  misc_feature 1..30: note = chr7:1598982-1599012
  misc_feature 1..30: note = hypo
  source 1..30: mol_type = genomic DNA
tgcctggttccaggccggctgccctgctag

SEQ ID NO: 14939 - DNA, 30 bp, Homo sapiens
  misc_feature 1..30: note = chr7:1607971-1608001
  misc_feature 1..30: note = hypo
  source 1..30: mol_type = genomic DNA
cccggaaaatgctatcgctgtaggggtatt

SEQ ID NO: 14940 - DNA, 89 bp, Homo sapiens; identical to SEQ ID NO: 1569
  misc_feature 1..89: note = chr7:1641847-1641936
  misc_feature 1..89: note = hypo
  source 1..89: mol_type = genomic DNA

SEQ ID NO: 14941 - DNA, 145 bp, Homo sapiens
  misc_feature 1..145: note = chr7:1688977-1689122
  misc_feature 1..145: note = hypo
  source 1..145: mol_type = genomic DNA
gcaaacagggatagtcgtgatccctcccttagggccggtgcttggaaagaatgaacgaacatgggtaaggtgtgcctggtgagcgctgtctgggctgaaggaggagtttgagaaggcggctttatgaagggaggtggccgggcgc

SEQ ID NO: 14942 - DNA, 30 bp, Homo sapiens
  misc_feature 1..30: note = chr7:1694042-1694072
  misc_feature 1..30: note = hypo
  source 1..30: mol_type = genomic DNA
acccgggttccaaagcgcctacagtgaaca

SEQ ID NO: 14943 - DNA, 164 bp, Homo sapiens; identical to SEQ ID NO: 1570
  misc_feature 1..164: note = chr7:1733214-1733378
  misc_feature 1..164: note = hypo
  source 1..164: mol_type = genomic DNA

SEQ ID NO: 14944 - DNA, 30 bp, Homo sapiens
  misc_feature 1..30: note = chr7:1734737-1734767
  misc_feature 1..30: note = hypo
  source 1..30: mol_type = genomic DNA
ggcagcagacgtggccgacaggcacatggt

SEQ ID NO: 14945 - DNA, 59 bp, Homo sapiens
  misc_feature 1..59: note = chr7:1783243-1783302
  misc_feature 1..59: note = hypo
  source 1..59: mol_type = genomic DNA
gagacctggcagacacgagtccccggacaggccagaatacctcccggtgcctccctccc

SEQ ID NO: 14946 - DNA, 41 bp, Homo sapiens
  misc_feature 1..41: note = chr7:1786828-1786869
  misc_feature 1..41: note = hypo
  source 1..41: mol_type = genomic DNA
ggggccctgcagaggcgaggggggagcgagtggggacagac

SEQ ID NO: 14947 - DNA, 47 bp, Homo sapiens
  misc_feature 1..47: note = chr7:2110154-2110201
  misc_feature 1..47: note = hypo
  source 1..47: mol_type = genomic DNA
gaagagaggccacaccggggagggtgcgagtccgcggagggagggcc

SEQ ID NO: 14948 - DNA, 59 bp, Homo sapiens
  misc_feature 1..59: note = chr7:2163332-2163391
  misc_feature 1..59: note = hypo
  source 1..59: mol_type = genomic DNA
tttcagagtgcacttcgcaggcggcgctgaatcgatagatcctccggcggcgtggtgct

SEQ ID NO: 14949 - DNA, 52 bp, Homo sapiens
  misc_feature 1..52: note = chr7:2232930-2232982
  misc_feature 1..52: note = hypo
  source 1..52: mol_type = genomic DNA
ctccgacagccaccacgtcctggagagaaagcgtccccgcccagaggacggt

SEQ ID NO: 14950 - DNA, 44 bp, Homo sapiens
  misc_feature 1..44: note = chr7:2233370-2233414
  misc_feature 1..44: note = hypo
  source 1..44: mol_type = genomic DNA
gagcaggtgctgagccgcgatccgggagacgccagtctcaccct

SEQ ID NO: 14951 - DNA, 160 bp, Homo sapiens
  misc_feature 1..160: note = chr7:2564711-2564871
  misc_feature 1..160: note = hypo
  source 1..160: mol_type = genomic DNA
gggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaa

SEQ ID NO: 14952 - DNA, 30 bp, Homo sapiens
  misc_feature 1..30: note = chr7:2566628-2566658
  misc_feature 1..30: note = hypo
  source 1..30: mol_type = genomic DNA
cagggtctctctaagcggcatgactctaca

SEQ ID NO: 14953 - DNA, 210 bp, Homo sapiens
  misc_feature 1..210: note = chr7:2686448-2686658
  misc_feature 1..210: note = hypo
  source 1..210: mol_type = genomic DNA
ggtccacccctccagcgccgcttcctgcctgccctcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcaggt

SEQ ID NO: 14954 - DNA, 28 bp, Homo sapiens
  misc_feature 1..28: note = chr7:2731870-2731898
  misc_feature 1..28: note = hypo
  source 1..28: mol_type = genomic DNA
gggttgaaagaggaccgagcttggccgg

SEQ ID NO: 14955 - DNA, 35 bp, Homo sapiens
  misc_feature 1..35: note = chr7:2798456-2798491
  misc_feature 1..35: note = hypo
  source 1..35: mol_type = genomic DNA
tgagagggttatcaccgcatgtatcaacatgatgg

SEQ ID NO: 14956 - DNA, 30 bp, Homo sapiens
  misc_feature 1..30: note = chr7:3033477-3033507
  misc_feature 1..30: note = hypo
  source 1..30: mol_type = genomic DNA
gtctcccttctagctcgccaaatgctcagg

SEQ ID NO: 14957 - DNA, 190 bp, Homo sapiens; identical to SEQ ID NO: 5058
  misc_feature 1..190: note = chr7:3283704-3283894
  misc_feature 1..190: note = hypo
  source 1..190: mol_type = genomic DNA

SEQ ID NO: 14958 - DNA, 61 bp, Homo sapiens
  misc_feature 1..61: note = chr7:4214953-4215014
  misc_feature 1..61: note = hypo
  source 1..61: mol_type = genomic DNA
acagtagaagggccccgggatgcggctgggcttacgcacctggtcgcgcagctctccctga

SEQ ID NO: 14959 - DNA, 30 bp, Homo sapiens
  misc_feature 1..30: note = chr7:4751426-4751456
  misc_feature 1..30: note = hypo
  source 1..30: mol_type = genomic DNA
accgtagagaagcaacgcaaggtcagagag

SEQ ID NO: 14960 - DNA, 82 bp, Homo sapiens
  misc_feature 1..82: note = chr7:4781972-4782054
  misc_feature 1..82: note = hypo
  source 1..82: mol_type = genomic DNA
cactctgctgaaccccggccgcaccttggcttgcttttttctttttttcctcttgcagctgtaggagaagaaagggcttttg

SEQ ID NO: 14961 - DNA, 87 bp, Homo sapiens
  misc_feature 1..87: note = chr7:4813783-4813870
  misc_feature 1..87: note = hypo
  source 1..87: mol_type = genomic DNA
ccagtcttcaacctgcggctccaggggcacccgccgcactccaccgactcccatccaccgctcaccatccaccgattcccatctctt

SEQ ID NO: 14962 - DNA, 161 bp, Homo sapiens
  misc_feature 1..161: note = chr7:4840190-4840351
  misc_feature 1..161: note = hypo
  source 1..161: mol_type = genomic DNA
tcgcccctctgggggcggctgttttccagctccagggacccacgcggttctgtgccacctcctcagcaatctctgctcctcctcctcctccctccacacccagatgtggccatgtgcaccctgagggttcccaccgctgaccagaccggggccccaggccc

SEQ ID NO: 14963 - DNA, 50 bp, Homo sapiens
  misc_feature 1..50: note = chr7:4841057-4841107
  misc_feature 1..50: note = hypo
  source 1..50: mol_type = genomic DNA
agtatctgcccaagacgtgtcagcgactgagcgaccgtgtggcccagctg

SEQ ID NO: 14964 - DNA, 177 bp, Homo sapiens
  misc_feature 1..177: note = chr7:4856871-4857048
  misc_feature 1..177: note = hypo
  source 1..177: mol_type = genomic DNA
tggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagcc

SEQ ID NO: 14965 - DNA, 30 bp, Homo sapiens
  misc_feature 1..30: note = chr7:5316401-5316431
  misc_feature 1..30: note = hypo
  source 1..30: mol_type = genomic DNA
tctccactgcgtgtacggattgacgggaaa

SEQ ID NO: 14966 - DNA, 23 bp, Homo sapiens
  misc_feature 1..23: note = chr7:5589502-5589525
  misc_feature 1..23: note = hypo
  source 1..23: mol_type = genomic DNA
agtaagtgaagaggccgggcgcg

SEQ ID NO: 14967 - DNA, 35 bp, Homo sapiens
  misc_feature 1..35: note = chr7:5647869-5647904
  misc_feature 1..35: note = hypo
  source 1..35: mol_type = genomic DNA
gtcccaggtgagatgcgggtcgagggagccaggcc

SEQ ID NO: 14968 - DNA, 56 bp, Homo sapiens
  misc_feature 1..56: note = chr7:5648363-5648419
  misc_feature 1..56: note = hypo
  source 1..56: mol_type = genomic DNA
ttctcccaggtgggtcgggggccactagggaccccataccccgagggtggctcctc

SEQ ID NO: 14969 - DNA, 85 bp, Homo sapiens; identical to SEQ ID NO: 1571
  misc_feature 1..85: note = chr7:6124629-6124714
  misc_feature 1..85: note = hypo
  source 1..85: mol_type = genomic DNA

SEQ ID NO: 14970 - DNA, 37 bp, Homo sapiens
  misc_feature 1..37: note = chr7:6143252-6143289
  misc_feature 1..37: note = hypo
  source 1..37: mol_type = genomic DNA
cttgggcggtggctccggagtgtaatcccagcgcttt

SEQ ID NO: 14971 - DNA, 113 bp, Homo sapiens
  misc_feature 1..113: note = chr7:6443323-6443436
  misc_feature 1..113: note = hypo
  source 1..113: mol_type = genomic DNA
tctttacctcgcccacgcggacacacgcctcctgtagtcgctttgcctattgatgttcctttgggtctgtgaggttctgtaaactgtgctagtgctgacgatgttctgtacaa

SEQ ID NO: 14972 - DNA, 86 bp, Homo sapiens
  misc_feature 1..86: note = chr7:6499253-6499339
  misc_feature 1..86: note = hypo
  source 1..86: mol_type = genomic DNA
gatggctgggtggtacgaggacagaggcacacagaaaacacccacgcagatccaatcaagctagcctcagatgggtggctgctttt

SEQ ID NO: 14973 - DNA, 180 bp, Homo sapiens; identical to SEQ ID NO: 5060
  misc_feature 1..180: note = chr7:6524907-6525087
  misc_feature 1..180: note = hypo
  source 1..180: mol_type = genomic DNA

SEQ ID NO: 14974 - DNA, 189 bp, Homo sapiens
  misc_feature 1..189: note = chr7:6560212-6560401
  misc_feature 1..189: note = hypo
  source 1..189: mol_type = genomic DNA
gctggaagaagctctcgagggcccggcagaccccatagcgctcaggaggtgtgagtaggtgctccagctgctggctgaaggtcctcccttggacccggatgctggacggcaggatctccgccacccactgcagggaggtgagcgccgacgacgggttgggtgagtccagagaatcggagtctgctggga

SEQ ID NO: 14975 - DNA, 30 bp, Homo sapiens
  misc_feature 1..30: note = chr7:7102938-7102968
  misc_feature 1..30: note = hypo
  source 1..30: mol_type = genomic DNA
attgttttttttttccggcaatgaagaaat

SEQ ID NO: 14976 - DNA, 273 bp, Homo sapiens; identical to SEQ ID NO: 1572
  misc_feature 1..273: note = chr7:7605157-7605430
  misc_feature 1..273: note = hypo
  source 1..273: mol_type = genomic DNA

SEQ ID NO: 14977 - DNA, 152 bp, Homo sapiens; identical to SEQ ID NO: 1573
  misc_feature 1..152: note = chr7:7605670-7605822
  misc_feature 1..152: note = hypo
  source 1..152: mol_type = genomic DNA

SEQ ID NO: 14978 - DNA, 24 bp, Homo sapiens
  misc_feature 1..24: note = chr7:20710238-20710262
  misc_feature 1..24: note = hypo
  source 1..24: mol_type = genomic DNA
aagaagcaagctggccgggtgcgg

SEQ ID NO: 14979 - DNA, 24 bp, Homo sapiens
  misc_feature 1..24: note = chr7:25132702-25132726
  misc_feature 1..24: note = hypo
  source 1..24: mol_type = genomic DNA
gcgatactccgtctcaaaaaaaaa

SEQ ID NO: 14980 - DNA, 186 bp, Homo sapiens
  misc_feature 1..186: note = chr7:25495487-25495673
  misc_feature 1..186: note = hypo
  source 1..186: mol_type = genomic DNA
cgaactagtcagtcccgtggtgacgtcaggattatctttctctcacttcagtgcctctgggacttaataggtgcacgaagaatatttataggtgcctgagaaatgcttgccgagaaatgactggctgttccaaggcatttccagggcaaggcagtccagtctgtgccgggccgggcggttgtagag

SEQ ID NO: 14981 - DNA, 29 bp, Homo sapiens
  misc_feature 1..29: note = chr7:25530898-25530927
  misc_feature 1..29: note = hypo
  source 1..29: mol_type = genomic DNA
aatttgtattaaaggcggggcgcagtgac

SEQ ID NO: 14982 - DNA, 30 bp, Homo sapiens
  misc_feature 1..30: note = chr7:31116621-31116651
  misc_feature 1..30: note = hypo
  source 1..30: mol_type = genomic DNA
ttcgggggtgtggggcggtgtaaaaacagg

SEQ ID NO: 14983 - DNA, 84 bp, Homo sapiens; identical to SEQ ID NO: 5064
  misc_feature 1..84: note = chr7:36428640-36428724
  misc_feature 1..84: note = hypo
  source 1..84: mol_type = genomic DNA

SEQ ID NO: 14984 - DNA, 30 bp, Homo sapiens
  misc_feature 1..30: note = chr7:37264509-37264539
  misc_feature 1..30: note = hypo
  source 1..30: mol_type = genomic DNA
gatggtgatctcctgcgccactttctggta

SEQ ID NO: 14985 - DNA, 181 bp, Homo sapiens
  misc_feature 1..181: note = chr7:37279183-37279364
  misc_feature 1..181: note = hypo
  source 1..181: mol_type = genomic DNA
aacagagattgagtacgagtttgggcaatgcctgtggaagataaagcaggcagaaagcaggattgagtatggaaagccttgggaccatgaaacagatctgatgcctgcgaagggaaggggaagaagcaaatgcagatctgaaaatgtctcagccaactcagtggaacgctgcagaataaac

SEQ ID NO: 14986 - DNA, 39 bp, Homo sapiens
  misc_feature 1..39: note = chr7:37770953-37770992
  misc_feature 1..39: note = hypo
  source 1..39: mol_type = genomic DNA
caagcaagtcatgcacgtggagaacgaggtgtctctctg

SEQ ID NO: 14987 - DNA, 30 bp, Homo sapiens
  misc_feature 1..30: note = chr7:38740329-38740359
  misc_feature 1..30: note = hypo
  source 1..30: mol_type = genomic DNA
cttgttttctgagctcgctgggggattgat

SEQ ID NO: 14988 - DNA, 17 bp, Homo sapiens
  misc_feature 1..17: note = chr7:43767864-43767881
  misc_feature 1..17: note = hypo
  source 1..17: mol_type = genomic DNA
tacgttttaaatggtga

SEQ ID NO: 14989 - DNA, 33 bp, Homo sapiens
  misc_feature 1..33: note = chr7:43865061-43865094
  misc_feature 1..33: note = hypo
  source 1..33: mol_type = genomic DNA
gtaaagatggaaaagcggctgtctagtagagac

SEQ ID NO: 14990 - DNA, 93 bp, Homo sapiens
  misc_feature 1..93: note = chr7:43865154-43865247
  misc_feature 1..93: note = hypo
  source 1..93: mol_type = genomic DNA
tatttattaaagaacttttacaaccttaaactcactctggactttccagccttatgttgggggttacaagtggcgccccgaacagcaacagga

SEQ ID NO: 14991 - DNA, 28 bp, Homo sapiens
  misc_feature 1..28: note = chr7:44083432-44083460
  misc_feature 1..28: note = hypo
  source 1..28: mol_type = genomic DNA
gagccaccgtgcccggcaggatttatat

SEQ ID NO: 14992 - DNA, 30 bp, Homo sapiens
  misc_feature 1..30: note = chr7:44151353-44151383
  misc_feature 1..30: note = hypo
  source 1..30: mol_type = genomic DNA
tgtcccccagaccctcgggtatgaggtggg

SEQ ID NO: 14993 - DNA, 41 bp, Homo sapiens; identical to SEQ ID NO: 5065
  misc_feature 1..41: note = chr7:44151615-44151656
  misc_feature 1..41: note = hypo
  source 1..41: mol_type = genomic DNA

SEQ ID NO: 14994 - DNA, 30 bp, Homo sapiens
  misc_feature 1..30: note = chr7:44152191-44152221
  misc_feature 1..30: note = hypo
  source 1..30: mol_type = genomic DNA
ggagaagaaccccttcgtgctgggagcaaa

SEQ ID NO: 14995 - DNA, 264 bp, Homo sapiens; identical to SEQ ID NO: 1574
  misc_feature 1..264: note = chr7:44835120-44835384
  misc_feature 1..264: note = hypo
  source 1..264: mol_type = genomic DNA

SEQ ID NO: 14996 - DNA, 20 bp, Homo sapiens
  misc_feature 1..20: note = chr7:45027140-45027160
  misc_feature 1..20: note = hypo
  source 1..20: mol_type = genomic DNA
cagagcgagactctgtctca

SEQ ID NO: 14997 - DNA, 30 bp, Homo sapiens
  misc_feature 1..30: note = chr7:50294451-50294481
  misc_feature 1..30: note = hypo
  source 1..30: mol_type = genomic DNA
atttttatcatgaatcggtattcaattgta

SEQ ID NO: 14998 - DNA, 158 bp, Homo sapiens
  misc_feature 1..158: note = chr7:50438618-50438776
  misc_feature 1..158: note = hypo
  source 1..158: mol_type = genomic DNA
aagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttc

SEQ ID NO: 14999 - DNA, 49 bp, Homo sapiens
  misc_feature 1..49: note = chr7:50560588-50560637
  misc_feature 1..49: note = hypo
  source 1..49: mol_type = genomic DNA
ggggcatcagctctgcggcaggcactccacgtcccgaaaggctcaactc

SEQ ID NO: 15000 - DNA, 30 bp, Homo sapiens
  misc_feature 1..30: note = chr7:54794762-54794792
  misc_feature 1..30: note = hypo
  source 1..30: mol_type = genomic DNA
gtcctgcacacagtacgccactacccgggg

SEQ ID NO: 15001 - DNA, 37 bp, Homo sapiens
  misc_feature 1..37: note = chr7:55145943-55145980
  misc_feature 1..37: note = hypo
  source 1..37: mol_type = genomic DNA
acaccccaagccccgcgtcccgcgtcctcactgtcct

SEQ ID NO: 15002 - DNA, 78 bp, Homo sapiens; identical to SEQ ID NO: 5068
  misc_feature 1..78: note = chr7:56018123-56018201
  misc_feature 1..78: note = hypo
  source 1..78: mol_type = genomic DNA

SEQ ID NO: 15003 - DNA, 91 bp, Homo sapiens
  misc_feature 1..91: note = chr7:65880043-65880134
  misc_feature 1..91: note = hypo
  source 1..91: mol_type = genomic DNA
ttcagtttactgcttcgatatcttttcctaattgattgttaattaagttctgcctagcaagtataaaaacctctgcctcctgggttcaatc

SEQ ID NO: 15004 - DNA, 42 bp, Homo sapiens
  misc_feature 1..42: note = chr7:69036110-69036152
  misc_feature 1..42: note = hypo
  source 1..42: mol_type = genomic DNA
gtcttcttactgggccgggcatggtggctcacgcctgtaatc

SEQ ID NO: 15005 - DNA, 179 bp, Homo sapiens
  misc_feature 1..179: note = chr7:69313694-69313873
  misc_feature 1..179: note = hypo
  source 1..179: mol_type = genomic DNA
acaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttc

SEQ ID NO: 15006 - DNA, 30 bp, Homo sapiens
  misc_feature 1..30: note = chr7:97600117-97600147
  misc_feature 1..30: note = hypo
  source 1..30: mol_type = genomic DNA
gtcgacctcttgtgtcgcacatgctaatga

SEQ ID NO: 15007 - DNA, 41 bp, Homo sapiens
  misc_feature 1..41: note = chr7:97797757-97797798
  misc_feature 1..41: note = hypo
  source 1..41: mol_type = genomic DNA
tttcattagcagaagcgggggtgttgcgctgtctatatcat

SEQ ID NO: 15008 - DNA, 30 bp, Homo sapiens
  misc_feature 1..30: note = chr7:97869614-97869644
  misc_feature 1..30: note = hypo
  source 1..30: mol_type = genomic DNA
gcatttgggtaccagcgtgtgggtggaaga

SEQ ID NO: 15009 - DNA, 198 bp, Homo sapiens
  misc_feature 1..198: note = chr7:98183080-98183278
  misc_feature 1..198: note = hypo
  source 1..198: mol_type = genomic DNA
tcttacccttgcaaccgaagtctttgcacagcttcactgtggggtggagttcctggcagtgatatatttgtagtgctgctatttaactgggtgatttgccttggcagctgctgagatctcagatctcacagagatttgagacttaatcacccgcagcaccaacaaagacctgctctttttatgcggctaaaaaaaata

SEQ ID NO: 15010 - DNA, 20 bp, Homo sapiens
  misc_feature 1..20: note = chr7:98971529-98971549
  misc_feature 1..20: note = hypo
  source 1..20: mol_type = genomic DNA
ccggccgaggtaaggttttc

SEQ ID NO: 15011 - DNA, 30 bp, Homo sapiens
  misc_feature 1..30: note = chr7:98991702-98991732
  misc_feature 1..30: note = hypo
  source 1..30: mol_type = genomic DNA
cactggcatggatggcggcatgagtatctg

SEQ ID NO: 15012 - DNA, 273 bp, Homo sapiens
  misc_feature 1..273: note = chr7:99020719-99020992
  misc_feature 1..273: note = hypo
  source 1..273: mol_type = genomic DNA
caagtctccatctatcgcccaggctggagtgcagtggcgcgatcttggctcacaacaaatctcaggtattcaccccagacaatgacaccacttcactgcctgcccagtccctgagcaagcgacaacctgtttggagtacccagcaacgtgcaggtgctggggacccagatgagcacagcagacagcctctgcctccagaagcctgatacagggaaggccagggctgcccatgagcacatgatccaagactgtaggacacggcataaaggaaca

SEQ ID NO: 15013 - DNA, 37 bp, Homo sapiens
  misc_feature 1..37: note = chr7:99700198-99700235
  misc_feature 1..37: note = hypo
  source 1..37: mol_type = genomic DNA
actagtaagaggcatcgggatccgagctcaggtctcc

SEQ ID NO: 15014 - DNA, 79 bp, Homo sapiens
  misc_feature 1..79: note = chr7:100088134-100088213
  misc_feature 1..79: note = hypo
  source 1..79: mol_type = genomic DNA
agcagaggtcgaggacggtgcccgggcctggaatggcagtgccgagggtccaggcaaggtggagcgtgaggacaggggc

SEQ ID NO: 15015 - DNA, 30 bp, Homo sapiens
  misc_feature 1..30: note = chr7:100179772-100179802
  misc_feature 1..30: note = hypo
  source 1..30: mol_type = genomic DNA
agcgacagctggtttcggctgtggaaggga

SEQ ID NO: 15016 - DNA, 30 bp, Homo sapiens
  misc_feature 1..30: note = chr7:100799119-100799149
  misc_feature 1..30: note = hypo
  source 1..30: mol_type = genomic DNA
ggcgtcggttactgtcgtcttgtcactgtg

SEQ ID NO: 15017 - DNA, 67 bp, Homo sapiens; identical to SEQ ID NO: 5069
  misc_feature 1..67: note = chr7:101652623-101652690
  misc_feature 1..67: note = hypo
  source 1..67: mol_type = genomic DNA

SEQ ID NO: 15018 - DNA, 78 bp, Homo sapiens
  misc_feature 1..78: note = chr7:101656381-101656459
  misc_feature 1..78: note = hypo
  source 1..78: mol_type = genomic DNA
attctgccattctgccgtcataccaaaaaaaaaaaaaaagcaccatcccagggttatgaatgacgttactgtctttgg

SEQ ID NO: 15019 - DNA, 30 bp, Homo sapiens
  misc_feature 1..30: note = chr7:101707502-101707532
  misc_feature 1..30: note = hypo
  source 1..30: mol_type = genomic DNA
agagtgtgtgtgaaacggagttttgctgtg

SEQ ID NO: 15020 - DNA, 24 bp, Homo sapiens
  misc_feature 1..24: note = chr7:102782042-102782066
  misc_feature 1..24: note = hypo
  source 1..24: mol_type = genomic DNA
atcttcttagattcacggtatctt

SEQ ID NO: 15021 - DNA, 48 bp, Homo sapiens
  misc_feature 1..48: note = chr7:105279623-105279671
  misc_feature 1..48: note = hypo
  source 1..48: mol_type = genomic DNA
ctgcatacattaaaacgtagcaggctttagaaccgcctgtgagtgcct

SEQ ID NO: 15022 - DNA, 148 bp, Homo sapiens
  misc_feature 1..148: note = chr7:107483719-107483867
  misc_feature 1..148: note = hypo
  source 1..148: mol_type = genomic DNA
aggacaccacccaggcgaggagccagaaagagcagccgcagcaggtggagcgcatgggcagaggggcggtggtgggacacgcgactgtttgggattgagcgaggccacctaagcagattgcggtgagtgagcgcggaatgacgtcact

SEQ ID NO: 15023 - DNA, 30 bp, Homo sapiens; identical to SEQ ID NO: 1575
  misc_feature 1..30: note = chr7:128097589-128097619
  misc_feature 1..30: note = hypo
  source 1..30: mol_type = genomic DNA

SEQ ID NO: 15024 - DNA, 30 bp, Homo sapiens
  misc_feature 1..30: note = chr7:128493200-128493230
  misc_feature 1..30: note = hypo
  source 1..30: mol_type = genomic DNA
gtctgcgtcaggattcgcattctggggccc

SEQ ID NO: 15025 - DNA, 30 bp, Homo sapiens
  misc_feature 1..30: note = chr7:128528857-128528887
  misc_feature 1..30: note = hypo
  source 1..30: mol_type = genomic DNA
gtgagaaaggcaccccgggagccccagcag

SEQ ID NO: 15026 - DNA, 30 bp, Homo sapiens
  misc_feature 1..30: note = chr7:128529102-128529132
  misc_feature 1..30: note = hypo
  source 1..30: mol_type = genomic DNA
aagagacagagaggccgaggggagggacag

SEQ ID NO: 15027 - DNA, 77 bp, Homo sapiens
  misc_feature 1..77: note = chr7:129794662-129794739
  misc_feature 1..77: note = hypo
  source 1..77: mol_type = genomic DNA
gtgcaacccccatgccgcagcccgtcgcctcctgctccagcctccgccaggactgtcctgtgcgcccatcagggtgt

SEQ ID NO: 15028 - DNA, 30 bp, Homo sapiens
  misc_feature 1..30: note = chr7:131041536-131041566
  misc_feature 1..30: note = hypo
  source 1..30: mol_type = genomic DNA
cgccaaatatgttgccggtggcagataccc

SEQ ID NO: 15029 - DNA, 30 bp, Homo sapiens
  misc_feature 1..30: note = chr7:131231034-131231064
  misc_feature 1..30: note = hypo
  source 1..30: mol_type = genomic DNA
ggagtgtacagtgggcgtgtccaggagctg

SEQ ID NO: 15030 - DNA, 57 bp, Homo sapiens
  misc_feature 1..57: note = chr7:134918564-134918621
  misc_feature 1..57: note = hypo
  source 1..57: mol_type = genomic DNA
gacccagacaggaaccgcgatccccactccggcgcacgaagccgggtgactgctgtc

SEQ ID NO: 15031 - DNA, 20 bp, Homo sapiens
  misc_feature 1..20: note = chr7:135196094-135196114
  misc_feature 1..20: note = hypo
  source 1..20: mol_type = genomic DNA
tttttttttttgagacggag

SEQ ID NO: 15032 - DNA, 135 bp, Homo sapiens
  misc_feature 1..135: note = chr7:135401363-135401498
  misc_feature 1..135: note = hypo
  source 1..135: mol_type = genomic DNA
aatttattaattcaacggaggattttggtcacattgcctggggggttaagagctcaagttctggaatcatacaatcttggattcaagtcccagctccaccacttagtagctgcataaccgcgggtaagtaagtta

SEQ ID NO: 15033 - DNA, 30 bp, Homo sapiens
  misc_feature 1..30: note = chr7:137664095-137664125
  misc_feature 1..30: note = hypo
  source 1..30: mol_type = genomic DNA
aaagcacagcaagggcgggtcatcaggcca

SEQ ID NO: 15034 - DNA, 41 bp, Homo sapiens
  misc_feature 1..41: note = chr7:139650651-139650692
  misc_feature 1..41: note = hypo
  source 1..41: mol_type = genomic DNA
ctcgccctccatctacgggaccccctcgccctccatctaca

SEQ ID NO: 15035 - DNA, 21 bp, Homo sapiens
  misc_feature 1..21: note = chr7:140026923-140026944
  misc_feature 1..21: note = hypo
  source 1..21: mol_type = genomic DNA
acggagcgagattctgtctca

SEQ ID NO: 15036 - DNA, 16 bp, Homo sapiens
  misc_feature 1..16: note = chr7:140097283-140097299
  misc_feature 1..16: note = hypo
  source 1..16: mol_type = genomic DNA
gcgcccaacccgaagc

SEQ ID NO: 15037 - DNA, 30 bp, Homo sapiens
  misc_feature 1..30: note = chr7:140156648-140156678
  misc_feature 1..30: note = hypo
  source 1..30: mol_type = genomic DNA
atgggcctcaatgcacgactagagaaggtg

SEQ ID NO: 15038 - DNA, 95 bp, Homo sapiens; identical to SEQ ID NO: 5071
  misc_feature 1..95: note = chr7:148640241-148640336
  misc_feature 1..95: note = hypo
  source 1..95: mol_type = genomic DNA

SEQ ID NO: 15039 - DNA, 105 bp, Homo sapiens
  misc_feature 1..105: note = chr7:148846075-148846180
  misc_feature 1..105: note = hypo
  source 1..105: mol_type = genomic DNA
cttaaattctctaggcgtcacgtttaaaaagtaaaaagccaggcgctgtgttgtgcacgcctgtagtcccagctaggccgggggctgaggcggaagaatcacttg

SEQ ID NO: 15040 - DNA, 97 bp, Homo sapiens
  misc_feature 1..97: note = chr7:150049533-150049630
  misc_feature 1..97: note = hypo
  source 1..97: mol_type = genomic DNA
accagaatgtcttatcgttgaaattattttttacttccttttgaaatgcttgagtttttttgtttgttttggtttggtttttgagacggagtctcgc

SEQ ID NO: 15041 - DNA, 30 bp, Homo sapiens
  misc_feature 1..30: note = chr7:150070259-150070289
  misc_feature 1..30: note = hypo
  source 1..30: mol_type = genomic DNA
tgtgtgctaaggctccgtcctgactgccct

SEQ ID NO: 15042 - DNA, 76 bp, Homo sapiens
  misc_feature 1..76: note = chr7:150746248-150746324
  misc_feature 1..76: note = hypo
  source 1..76: mol_type = genomic DNA
aacatcaacccactgcgccgctcgcgcctaacgcccaacgacctgcactgggctgggtctgcgctgctgggcctgg

SEQ ID NO: 15043 - DNA, 99 bp, Homo sapiens
  misc_feature 1..99: note = chr7:150774704-150774803
  misc_feature 1..99: note = hypo
  source 1..99: mol_type = genomic DNA
cacctgtacttgcagcgggcacggtcggtgatgagaggctggggaaagatgggcacttgctgccttcggggaaggcggggaccccggtatcctgggagc

SEQ ID NO: 15044 - DNA, 30 bp, Homo sapiens
  misc_feature 1..30: note = chr7:150823844-150823874
  misc_feature 1..30: note = hypo
  source 1..30: mol_type = genomic DNA
cctggaagactccttcgcagaccaagaggc

SEQ ID NO: 15045 - DNA, 92 bp, Homo sapiens
  misc_feature 1..92: note = chr7:150870816-150870908
  misc_feature 1..92: note = hypo
  source 1..92: mol_type = genomic DNA
ctccaaactctttcccgcaccagcgagcccgcactcgcatgatacccagacctgcgctcgacctggccccagatccccgtgccaagggccac

SEQ ID NO: 15046 - DNA, 57 bp, Homo sapiens
  misc_feature 1..57: note = chr7:150871142-150871199
  misc_feature 1..57: note = hypo
  source 1..57: mol_type = genomic DNA
tctggcctggaccaccgccgcaggtgccccccgacccacgcccgcagccaggacggt

SEQ ID NO: 15047 - DNA, 30 bp, Homo sapiens
  misc_feature 1..30: note = chr7:151591649-151591679
  misc_feature 1..30: note = hypo
  source 1..30: mol_type = genomic DNA
ggctcaagccctccccgatccctccgccct

SEQ ID NO: 15048 - DNA, 43 bp, Homo sapiens
  misc_feature 1..43: note = chr7:152337501-152337544
  misc_feature 1..43: note = hypo
  source 1..43: mol_type = genomic DNA
ctgctgaccaaagtactgggattacaggcgtgaaccaccgacc

SEQ ID NO: 15049 - DNA, 175 bp, Homo sapiens
  misc_feature 1..175: note = chr7:152693809-152693984
  misc_feature 1..175: note = hypo
  source 1..175: mol_type = genomic DNA
ccagaggaaataacccgcatggcaactcacggcaagaagtgtccttctagggaaaggagttttcatccatgtgcacactctccaagcagagcctctggatctgggtaaatatgtctgtggggtcatgtggggtgcgtagtgttggaatgagcatatactgcgttgttcattgatg

SEQ ID NO: 15050 - DNA, 39 bp, Homo sapiens
  misc_feature 1..39: note = chr7:154561150-154561189
  misc_feature 1..39: note = hypo
  source 1..39: mol_type = genomic DNA
cacactggtggtctccggatggcacgagactcgcctacg

SEQ ID NO: 15051 - DNA, 30 bp, Homo sapiens
  misc_feature 1..30: note = chr7:154670104-154670134
  misc_feature 1..30: note = hypo
  source 1..30: mol_type = genomic DNA
ggagcgtgtggacaacggcaaagcttagag

SEQ ID NO: 15052 - DNA, 32 bp, Homo sapiens
  misc_feature 1..32: note = chr7:155202839-155202871
  misc_feature 1..32: note = hypo
  source 1..32: mol_type = genomic DNA
catgcggggagggggcgcggggagggggcgca

SEQ ID NO: 15053 - DNA, 43 bp, Homo sapiens
  misc_feature 1..43: note = chr7:155363419-155363462
  misc_feature 1..43: note = hypo
  source 1..43: mol_type = genomic DNA
cctcacaggcccctccgcgagtgctgggcgtgcagcagacaaa

SEQ ID NO: 15054 - DNA, 44 bp, Homo sapiens
  misc_feature 1..44: note = chr7:155580846-155580890
  misc_feature 1..44: note = hypo
  source 1..44: mol_type = genomic DNA
tcaggtttccccaggcggagcgctcagcatatcgacagctaaaa

SEQ ID NO: 15055 - DNA, 223 bp, Homo sapiens; identical to SEQ ID NO: 1576
  misc_feature 1..223: note = chr7:155581330-155581553
  misc_feature 1..223: note = hypo
  source 1..223: mol_type = genomic DNA

SEQ ID NO: 15056 - DNA, 92 bp, Homo sapiens
  misc_feature 1..92: note = chr7:155581765-155581857
  misc_feature 1..92: note = hypo
  source 1..92: mol_type = genomic DNA
ttgtgtgggtccccacgtggtcaccagcgtcctttcaggacaagagaaaactgagcaggaccagggcttccgcctgccgcattcatctgccc

SEQ ID NO: 15057 - DNA, 63 bp, Homo sapiens
  misc_feature 1..63: note = chr7:155582277-155582340
  misc_feature 1..63: note = hypo
  source 1..63: mol_type = genomic DNA
tgtgcgtgtttaacccgcccagagactggtgctgccgcatttgttcatcggtttgttttgttt

SEQ ID NO: 15058 - DNA, 100 bp, Homo sapiens
  misc_feature 1..100: note = chr7:155753587-155753687
  misc_feature 1..100: note = hypo
  source 1..100: mol_type = genomic DNA
gagcgtgtgtgtgtgtgtgtgtgtgtgtgtgtgtgttagaatcctgccctgagctggccttcaggaaggtgaattccggtttctgcgcactctgcactct

SEQ ID NO: 15059 - DNA, 131 bp, Homo sapiens
  misc_feature 1..131: note = chr7:155899015-155899146
  misc_feature 1..131: note = hypo
  source 1..131: mol_type = genomic DNA
agctttcagttagatcgcagctcctggattgagctgtatacccaaacccagctatatgctctttacaagcacatacaataaagtgacagaaagggatccaaaaagtgtactgggtgcgtgcacggagggaa

SEQ ID NO: 15060 - DNA, 97 bp, Homo sapiens; identical to SEQ ID NO: 5073
  misc_feature 1..97: note = chr7:156744702-156744799
  misc_feature 1..97: note = hypo
  source 1..97: mol_type = genomic DNA

SEQ ID NO: 15061 - DNA, 33 bp, Homo sapiens
  misc_feature 1..33: note = chr7:156832223-156832256
  misc_feature 1..33: note = hypo
  source 1..33: mol_type = genomic DNA
aggtcacattccccacggcgagtctgctcagat

SEQ ID NO: 15062 - DNA, 69 bp, Homo sapiens
  misc_feature 1..69: note = chr7:156832823-156832892
  misc_feature 1..69: note = hypo
  source 1..69: mol_type = genomic DNA
aagcggacttgggagcgacggggtttgggcatctgggagacgggaactccttcccgggaggaagaccgt

SEQ ID NO: 15063 - DNA, 40 bp, Homo sapiens
  misc_feature 1..40: note = chr7:156880549-156880589
  misc_feature 1..40: note = hypo
  source 1..40: mol_type = genomic DNA
tgctcacggacagcacggccctcggcgtggatatccggaa

SEQ ID NO: 15064 - DNA, 63 bp, Homo sapiens
  misc_feature 1..63: note = chr7:157084534-157084597
  misc_feature 1..63: note = hypo
  source 1..63: mol_type = genomic DNA
cagtggcctcccacccgccgtggcaggacaagcagagtgtggtctccacgcaagaggctggag

SEQ ID NO: 15065 - DNA, 144 bp, Homo sapiens
  misc_feature 1..144: note = chr7:157085343-157085487
  misc_feature 1..144: note = hypo
  source 1..144: mol_type = genomic DNA
gggggaggccaggaccgtggagttctagagggggcaccaagggcccgtgtgtccgcgtggagctggacatgcttctgtgggccaggcaccctgaccctgatcctctccagtgaagaggccgggggcaggcggaactgggtcagg

SEQ ID NO: 15066 - DNA, 169 bp, Homo sapiens
  misc_feature 1..169: note = chr7:157085946-157086115
  misc_feature 1..169: note = hypo
  source 1..169: mol_type = genomic DNA
gagcctctgctcccacggtctcaggccctccccgccctgatgagtctccgctcccaacacaagggccacgtggtctggagggaccttttgcccagctgcaggggccatctcagggagaccccgccttggaggacttgttctccggatctccagacgtttaggctgaaag

SEQ ID NO: 15067 - DNA, 239 bp, Homo sapiens
  misc_feature 1..239: note = chr7:157255083-157255322
  misc_feature 1..239: note = hypo
  source 1..239: mol_type = genomic DNA
tggggcgaggctggacgctgccatccagcacccagctcgtttcggcctgggctgccctcagcactgcgcagacccgcgagctcctcatttccccggaagatgaacgagaaggttcgcgcgagattctctgcaaagccctggcacaggccccgtccctgcagctgtttattgacgctgtggcggccgagacggcatgtttggaaatctgcttggcatggagactgcggtgccctgaccac

SEQ ID NO: 15068 - DNA, 884 bp, Homo sapiens; identical to SEQ ID NO: 5074
  misc_feature 1..884: note = chr7:157262579-157263463
  misc_feature 1..884: note = hypo
  source 1..884: mol_type = genomic DNA

SEQ ID NO: 15069 - DNA, 30 bp, Homo sapiens
  misc_feature 1..30: note = chr7:157294288-157294318
  misc_feature 1..30: note = hypo
  source 1..30: mol_type = genomic DNA
gcacacagcttttgccgtcgtttggagaat

SEQ ID NO: 15070 - DNA, 57 bp, Homo sapiens
  misc_feature 1..57: note = chr7:157337964-157338021
  misc_feature 1..57: note = hypo
  source 1..57: mol_type = genomic DNA
tgtgagcagtgtgcacggctgtatgtgggtgtgtaccacatgcgtgggtgtgtaggt

SEQ ID NO: 15071 - DNA, 43 bp, Homo sapiens
  misc_feature 1..43: note = chr7:157353030-157353073
  misc_feature 1..43: note = hypo
  source 1..43: mol_type = genomic DNA
gcagtgctgcccacacggatgcccagagcgtgttccccaagac

SEQ ID NO: 15072 - DNA, 65 bp, Homo sapiens
  misc_feature 1..65: note = chr7:157396449-157396514
  misc_feature 1..65: note = hypo
  source 1..65: mol_type = genomic DNA
atgttctacaagtcacggaacccaccgcccagcgtgagccgggacccacacggctcataaacagc

SEQ ID NO: 15073 - DNA, 167 bp, Homo sapiens
  misc_feature 1..167: note = chr7:157403604-157403771
  misc_feature 1..167: note = hypo
  source 1..167: mol_type = genomic DNA
gtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataa

SEQ ID NO: 15074 - DNA, 32 bp, Homo sapiens
  misc_feature 1..32: note = chr7:157448480-157448512
  misc_feature 1..32: note = hypo
  source 1..32: mol_type = genomic DNA
atgcacggccacacacgcgtgatcactccagc

SEQ ID NO: 15075 - DNA, 48 bp, Homo sapiens
  misc_feature 1..48: note = chr7:157565500-157565548
  misc_feature 1..48: note = hypo
  source 1..48: mol_type = genomic DNA
cttctctggcctctgcgccccagctcctttgtgcgaggtcccatgtgc

SEQ ID NO: 15076 - DNA, 30 bp, Homo sapiens
  misc_feature 1..30: note = chr7:157568187-157568217
  misc_feature 1..30: note = hypo
  source 1..30: mol_type = genomic DNA
cctgaatacaggactcgatgcctcgaggag

SEQ ID NO: 15077 - DNA, 63 bp, Homo sapiens
  misc_feature 1..63: note = chr7:157584178-157584241
  misc_feature 1..63: note = hypo
  source 1..63: mol_type = genomic DNA
cacacgcctgcctggcgccagcctgcctgtcctccctgcacccgcccccgctccctgcaccca

SEQ ID NO: 15078 - DNA, 30 bp, Homo sapiens
  misc_feature 1..30: note = chr7:157588586-157588616
  misc_feature 1..30: note = hypo
  source 1..30: mol_type = genomic DNA
cacatgtgatgctgacgccctcagaaacct

SEQ ID NO: 15079 - DNA, 30 bp, Homo sapiens
  misc_feature 1..30: note = chr7:157588963-157588993
  misc_feature 1..30: note = hypo
  source 1..30: mol_type = genomic DNA
caactgctgatgttacgtgcactaagcaca

SEQ ID NO: 15080 - DNA, 46 bp, Homo sapiens
  misc_feature 1..46: note = chr7:157606706-157606752
  misc_feature 1..46: note = hypo
  source 1..46: mol_type = genomic DNA
gcctcttcagagctgcgagactgtgcccacgcgaggcagtggtcgc

SEQ ID NO: 15081 - DNA, 30 bp, Homo sapiens
  misc_feature 1..30: note = chr7:157633412-157633442
  misc_feature 1..30: note = hypo
  source 1..30: mol_type = genomic DNA
atccagagcctccagcgttttcacccagtg

SEQ ID NO: 15082 - DNA, 192 bp, Homo sapiens
  misc_feature 1..192: note = chr7:157659256-157659448
  misc_feature 1..192: note = hypo
  source 1..192: mol_type = genomic DNA
ggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggcca

SEQ ID NO: 15083 - DNA, 161 bp, Homo sapiens
  misc_feature 1..161: note = chr7:157776781-157776942
  misc_feature 1..161: note = hypo
  source 1..161: mol_type = genomic DNA
agccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacct

SEQ ID NO: 15084 - DNA, 30 bp, Homo sapiens
  misc_feature 1..30: note = chr7:157793858-157793888
  misc_feature 1..30: note = hypo
  source 1..30: mol_type = genomic DNA
gcaggtctggtgcaacgtggggctggggtc

SEQ ID NO: 15085 - DNA, 30 bp, Homo sapiens
  misc_feature 1..30: note = chr7:157877477-157877507
  misc_feature 1..30: note = hypo
  source 1..30: mol_type = genomic DNA
cgatgcccatccacacggatgcccatacac

SEQ ID NO: 15086 - DNA, 30 bp, Homo sapiens
  misc_feature 1..30: note = chr7:157958638-157958668
  misc_feature 1..30: note = hypo
  source 1..30: mol_type = genomic DNA
ccagacagggggcttcggaggatgtggcaa

SEQ ID NO: 15087 - DNA, 34 bp, Homo sapiens
  misc_feature 1..34: note = chr7:158301521-158301555
  misc_feature 1..34: note = hypo
  source 1..34: mol_type = genomic DNA
cggggcaacgtgggacgctcggagcaggtgcgga

SEQ ID NO: 15088 - DNA, 140 bp, Homo sapiens
  misc_feature 1..140: note = chr8:972710-972850
  misc_feature 1..140: note = hypo
  source 1..140: mol_type = genomic DNA
tggacagtaccgtgccgaggtagatgctccaaccacaatccaccctccctgggagtggacagtcccatgccgaggtagacactccagccgccacccatcccccccgggagtggatggttccgtgccgaggtagacactcc

SEQ ID NO: 15089 - DNA, 30 bp, Homo sapiens
  misc_feature 1..30: note = chr8:1048584-1048614
  misc_feature 1..30: note = hypo
  source 1..30: mol_type = genomic DNA
cccacaccaggctcccggccgcccacgggc

SEQ ID NO: 15090 - DNA, 88 bp, Homo sapiens
  misc_feature 1..88: note = chr8:1137245-1137333
  misc_feature 1..88: note = hypo
  source 1..88: mol_type = genomic DNA
ggaatctcacacacacgggacctctgtgacgtttgtctcatggaatctcacatgcccgggacctctgtgacatttccctcacacgccc

SEQ ID NO: 15091 - DNA, 99 bp, Homo sapiens
  misc_feature 1..99: note = chr8:1246701-1246800
  misc_feature 1..99: note = hypo
  source 1..99: mol_type = genomic DNA
actggggtataaatacggtttcatggggacacacaggagggagctgagtgtgctcctctggccccggagagtgctgagaggcagcgtaccctgcagaag

SEQ ID NO: 15092 - DNA, 102 bp, Homo sapiens
  misc_feature 1..102: note = chr8:1302692-1302794
  misc_feature 1..102: note = hypo
  source 1..102: mol_type = genomic DNA
aacgaaaagaaaataccttggaatgaaagactgtggggccattaagatgatgctgtgggtgaaggtggaaagtcacggatgatgctgcggatgaaggtggaa

SEQ ID NO: 15093 - DNA, 37 bp, Homo sapiens
  misc_feature 1..37: note = chr8:1471545-1471582
  misc_feature 1..37: note = hypo
  source 1..37: mol_type = genomic DNA
gatttgccggcctcacgccggccgagccactgctgac

SEQ ID NO: 15094 - DNA, 30 bp, Homo sapiens
  misc_feature 1..30: note = chr8:2652772-2652802
  misc_feature 1..30: note = hypo
  source 1..30: mol_type = genomic DNA
atactatgggaacagcggactgaaggcatc

SEQ ID NO: 15095 - DNA, 28 bp, Homo sapiens
  misc_feature 1..28: note = chr8:8639463-8639491
  misc_feature 1..28: note = hypo
  source 1..28: mol_type = genomic DNA
agcgggatgcagccgtagggccagccac

SEQ ID NO: 15096 - DNA, 30 bp, Homo sapiens
  misc_feature 1..30: note = chr8:8639731-8639761
  misc_feature 1..30: note = hypo
  source 1..30: mol_type = genomic DNA
agcagggcagaagaacgccccccagcaacc

SEQ ID NO: 15097 - DNA, 30 bp, Homo sapiens
  misc_feature 1..30: note = chr8:8748683-8748713
  misc_feature 1..30: note = hypo
  source 1..30: mol_type = genomic DNA
agctaacaggcaacacgggggagaggatct

SEQ ID NO: 15098 - DNA, 30 bp, Homo sapiens
  misc_feature 1..30: note = chr8:8748926-8748956
  misc_feature 1..30: note = hypo
  source 1..30: mol_type = genomic DNA
ccagctcacgctctccgcacaggtctgcgt

SEQ ID NO: 15099 - DNA, 117 bp, Homo sapiens
  misc_feature 1..117: note = chr8:10529008-10529125
  misc_feature 1..117: note = hypo
  source 1..117: mol_type = genomic DNA
tggacaccccacaggcggcgcaggtccgcaggtatccgttctttggggagaggtgtggtgagtcgcacactccaagacagagaggggtgaacaccgccactgcgtaaatgtgtgagt

SEQ ID NO: 15100 - DNA, 38 bp, Homo sapiens
  misc_feature 1..38: note = chr8:11706106-11706144
  misc_feature 1..38: note = hypo
  source 1..38: mol_type = genomic DNA
gccgccagtgaacaccgctactgcggaaccaaggcgag

SEQ ID NO: 15101 - DNA, 27 bp, Homo sapiens
  misc_feature 1..27: note = chr8:13654937-13654964
  misc_feature 1..27: note = hypo
  source 1..27: mol_type = genomic DNA
gttatgggccgggtgcggtggctcaca

SEQ ID NO: 15102 - DNA, 30 bp, Homo sapiens
  misc_feature 1..30: note = chr8:23290404-23290434
  misc_feature 1..30: note = hypo
  source 1..30: mol_type = genomic DNA
ttccttttgagtcttcgtggagctgtgagc

SEQ ID NO: 15103 - DNA, 38 bp, Homo sapiens
  misc_feature 1..38: note = chr8:23399594-23399632
  misc_feature 1..38: note = hypo
  source 1..38: mol_type = genomic DNA
gtcagcaccacataacgatgtttcggtcaactatggac

SEQ ID NO: 15104 - DNA, 152 bp, Homo sapiens
  misc_feature 1..152: note = chr8:23423918-23424070
  misc_feature 1..152: note = hypo
  source 1..152: mol_type = genomic DNA
tccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcct

SEQ ID NO: 15105 - DNA, 117 bp, Homo sapiens
  misc_feature 1..117: note = chr8:25397086-25397203
  misc_feature 1..117: note = hypo
  source 1..117: mol_type = genomic DNA
cggctggctgctgggcgtgtagcgatcactgaggacaggtcagcctggggatttggagcgcagctacctgcagtacctgttctaactccgtctgtgtcggagcgcccttctgttatc

SEQ ID NO: 15106 - DNA, 39 bp, Homo sapiens; identical to SEQ ID NO: 5075
  misc_feature 1..39: note = chr8:37961863-37961902
  misc_feature 1..39: note = hypo
  source 1..39: mol_type = genomic DNA

SEQ ID NO: 15107 - DNA, 58 bp, Homo sapiens
  misc_feature 1..58: note = chr8:42144632-42144690
  misc_feature 1..58: note = hypo
  source 1..58: mol_type = genomic DNA
ggcagctggagtgcccgaggccagagccgctttccctgctgcccgtgccacagcctca

SEQ ID NO: 15108 - DNA, 30 bp, Homo sapiens
  misc_feature 1..30: note = chr8:42699267-42699297
  misc_feature 1..30: note = hypo
  source 1..30: mol_type = genomic DNA
ctgtgttgcaaatagcgaactgctgcagca

SEQ ID NO: 15109 - DNA, 32 bp, Homo sapiens; identical to SEQ ID NO: 5076
  misc_feature 1..32: note = chr8:42749968-42750000
  misc_feature 1..32: note = hypo
  source 1..32: mol_type = genomic DNA

SEQ ID NO: 15110 - DNA, 115 bp, Homo sapiens
  misc_feature 1..115: note = chr8:47093290-47093405
  misc_feature 1..115: note = hypo
  source 1..115: mol_type = genomic DNA
tcccaccattccctgcggcctcgctgctacccccatctgccagcctcaacatccccatgagtccctatgtcctgtccacaccgcaccgaggccaagttttcgctagtggcggcct

SEQ ID NO: 15111 - DNA, 92 bp, Homo sapiens
  misc_feature 1..92: note = chr8:47334506-47334598
  misc_feature 1..92: note = hypo
  source 1..92: mol_type = genomic DNA
gaagcagcgagaccgcggagaatgctgggatactgccaaggaggcctctaccatccaagaagcccgcagggatgtcccgaactggttgtaaa

SEQ ID NO: 15112 - DNA, 30 bp, Homo sapiens
  misc_feature 1..30: note = chr8:48045032-48045062
  misc_feature 1..30: note = hypo
  source 1..30: mol_type = genomic DNA
ggaggggcagcctggcggaactcgctgcaa

SEQ ID NO: 15113 - DNA, 168 bp, Homo sapiens
  misc_feature 1..168: note = chr8:48294168-48294336
  misc_feature 1..168: note = hypo
  source 1..168: mol_type = genomic DNA
tcagaagatcctattcgggcaggtctgggcctggtcagtaattgggtgggaggcctcagagagcagaaaccagcgattggcaggaagtggcatgggcagctcacctggcctgcgagtctgggctcagctggacctgccccacgtggcaccaggcgcacaaggtgtcct

SEQ ID NO: 15114 - DNA, 180 bp, Homo sapiens
  misc_feature 1..180: note = chr8:49335062-49335242
  misc_feature 1..180: note = hypo
  source 1..180: mol_type = genomic DNA
tcctgcaactcttagcgagtaaatgggcacatccacactggagttgaacacaggggcgccggccacgggttcaggctagcccgggcgtctggcttccctgccaggatggctgcctcgttactgagatggaacacacaacacagccgcgtgggcagtgggaggctgcgaggttagcctggc

SEQ ID NO: 15115 - DNA, 30 bp, Homo sapiens
  misc_feature 1..30: note = chr8:49572124-49572154
  misc_feature 1..30: note = hypo
  source 1..30: mol_type = genomic DNA
gacctgcgaggctgtcgggggtgcgcctgg

SEQ ID NO: 15116 - DNA, 41 bp, Homo sapiens
  misc_feature 1..41: note = chr8:49609162-49609203
  misc_feature 1..41: note = hypo
  source 1..41: mol_type = genomic DNA
ctgcaacctgctaaacgccgctcctgcggagcgccagggcc

SEQ ID NO: 15117 - DNA, 28 bp, Homo sapiens
  misc_feature 1..28: note = chr8:50015582-50015610
  misc_feature 1..28: note = hypo
  source 1..28: mol_type = genomic DNA
ctatgggaccgggcgtcttggagcaggg

SEQ ID NO: 15118 - DNA, 41 bp, Homo sapiens
  misc_feature 1..41: note = chr8:50377787-50377828
  misc_feature 1..41: note = hypo
  source 1..41: mol_type = genomic DNA
aggcagacacacaggcggctgaacatcgaggggagcacacc

SEQ ID NO: 15119 - DNA, 34 bp, Homo sapiens
  misc_feature 1..34: note = chr8:52432891-52432925
  misc_feature 1..34: note = hypo
  source 1..34: mol_type = genomic DNA
tccctctagaaggggcgagcgctttgaatatgtg

SEQ ID NO: 15120 - DNA, 30 bp, Homo sapiens
  misc_feature 1..30: note = chr8:55689465-55689495
  misc_feature 1..30: note = hypo
  source 1..30: mol_type = genomic DNA
acctgaatagtgatacgacaagctctcaca

SEQ ID NO: 15121 - DNA, 30 bp, Homo sapiens
  misc_feature 1..30: note = chr8:56929748-56929778
  misc_feature 1..30: note = hypo
  source 1..30: mol_type = genomic DNA
ggcagcgtgaggccacgccttggagagaag

SEQ ID NO: 15122 - DNA, 109 bp, Homo sapiens
  misc_feature 1..109: note = chr8:58106014-58106123
  misc_feature 1..109: note = hypo
  source 1..109: mol_type = genomic DNA
ccacaggcccatctgcggcaggcacgtggtgccgcgagaacttggctcagggacggtttttccgccatgcgcagattctcgcctctcgcgggggcgccagggggcagct

SEQ ID NO: 15123 - DNA, 56 bp, Homo sapiens
  misc_feature 1..56: note = chr8:58116950-58117006
  misc_feature 1..56: note = hypo
  source 1..56: mol_type = genomic DNA
cagaaacgttgcagccgatggcacggcagtggggaggaaaacgtaggaagcatgga

SEQ ID NO: 15124 - DNA, 115 bp, Homo sapiens; identical to SEQ ID NO: 5077
  misc_feature 1..115: note = chr8:58130301-58130416
  misc_feature 1..115: note = hypo
  source 1..115: mol_type = genomic DNA

SEQ ID NO: 15125 - DNA, 100 bp, Homo sapiens
  misc_feature 1..100: note = chr8:61789885-61789985
  misc_feature 1..100: note = hypo
  source 1..100: mol_type = genomic DNA
ataatgacgacgaggcggatggcggcggggaggctagagcccatttcagaagcctgcagtgaggattccaccagttcacatgcatcgggcactgagccct

SEQ ID NO: 15126 - DNA, 23 bp, Homo sapiens
  misc_feature 1..23: note = chr8:64023521-64023544
  misc_feature 1..23: note = hypo
  source 1..23: mol_type = genomic DNA
accgcgcccggccttaagtgttt

SEQ ID NO: 15127 - DNA, 90 bp, Homo sapiens
  misc_feature 1..90: note = chr8:65749819-65749909
  misc_feature 1..90: note = hypo
  source 1..90: mol_type = genomic DNA
tttattcacgatgttcggctggagtagagtggttattgtgtgaaagcattctatcttgctaggctgcctctttcccgttctttggcttaa

SEQ ID NO: 15128 - DNA, 22 bp, Homo sapiens
  misc_feature 1..22: note = chr8:66560523-66560545
  misc_feature 1..22: note = hypo
  source 1..22: mol_type = genomic DNA
ttacaggcgtgagtcaccatgc

SEQ ID NO: 15129 - DNA, 30 bp, Homo sapiens
  misc_feature 1..30: note = chr8:71368455-71368485
  misc_feature 1..30: note = hypo
  source 1..30: mol_type = genomic DNA
cactaacattctacacgtctaaacttcgag

SEQ ID NO: 15130 - DNA, 32 bp, Homo sapiens
  misc_feature 1..32: note = chr8:74332813-74332845
  misc_feature 1..32: note = hypo
  source 1..32: mol_type = genomic DNA
acggatgggggtgggcgcgattcccacaacag

SEQ ID NO: 15131 - DNA, 16 bp, Homo sapiens
  misc_feature 1..16: note = chr8:74889431-74889447
  misc_feature 1..16: note = hypo
  source 1..16: mol_type = genomic DNA
ttggaggtgaagtctc

SEQ ID NO: 15132 - DNA, 23 bp, Homo sapiens
  misc_feature 1..23: note = chr8:86406826-86406849
  misc_feature 1..23: note = hypo
  source 1..23: mol_type = genomic DNA
tttacaaacggagacttgggggc

SEQ ID NO: 15133 - DNA, 30 bp, Homo sapiens
  misc_feature 1..30: note = chr8:86436621-86436651
  misc_feature 1..30: note = hypo
  source 1..30: mol_type = genomic DNA
gcatccaacctgactcggcccgcgtggcag

SEQ ID NO: 15134 - DNA, 137 bp, Homo sapiens; identical to SEQ ID NO: 1578
  misc_feature 1..137: note = chr8:90913516-90913653
  misc_feature 1..137: note = hypo
  source 1..137: mol_type = genomic DNA

SEQ ID NO: 15135 - DNA, 30 bp, Homo sapiens
  misc_feature 1..30: note = chr8:91130098-91130128
  misc_feature 1..30: note = hypo
  source 1..30: mol_type = genomic DNA
tattccaaataatagcgggaattcaaattt

SEQ ID NO: 15136 - DNA, 99 bp, Homo sapiens; identical to SEQ ID NO: 5080
  misc_feature 1..99: note = chr8:92083523-92083622
  misc_feature 1..99: note = hypo
  source 1..99: mol_type = genomic DNA

SEQ ID NO: 15137 - DNA, 77 bp, Homo sapiens
  misc_feature 1..77: note = chr8:95416054-95416131
  misc_feature 1..77: note = hypo
  source 1..77: mol_type = genomic DNA
cttaaaagtaaggaccgtggtcctgattcccatatgcccacctcctagcagtatgtttggcacgtggcatctatcaa

SEQ ID NO: 15138 - DNA, 30 bp, Homo sapiens
  misc_feature 1..30: note = chr8:96208663-96208693
  misc_feature 1..30: note = hypo
  source 1..30: mol_type = genomic DNA
atgtaatatggtggccgagttaagcgcttg

SEQ ID NO: 15139 - DNA, 81 bp, Homo sapiens
  misc_feature 1..81: note = chr8:97340121-97340202
  misc_feature 1..81: note = hypo
  source 1..81: mol_type = genomic DNA
cattttcagtgggtacgtgcctagatttccacaggtgtgattgcaaacctgtaaattaccggcttccgtttgctgggacaa

SEQ ID NO: 15140 - DNA, 30 bp, Homo sapiens
  misc_feature 1..30: note = chr8:98738336-98738366
  misc_feature 1..30: note = hypo
  source 1..30: mol_type = genomic DNA
actaggaaagctaaacgaacaaaatggttt

SEQ ID NO: 15141 - DNA, 41 bp, Homo sapiens
  misc_feature 1..41: note = chr8:100026614-100026655
  misc_feature 1..41: note = hypo
  source 1..41: mol_type = genomic DNA
ggattataggcgtgagccaccgcgcccggcctgcataattt

SEQ ID NO: 15142 - DNA, 25 bp, Homo sapiens
  misc_feature 1..25: note = chr8:101156861-101156886
  misc_feature 1..25: note = hypo
  source 1..25: mol_type = genomic DNA
aaaaaaaaaaagcagcggccgggcg

SEQ ID NO: 15143 - DNA, 16 bp, Homo sapiens
  misc_feature 1..16: note = chr8:103629866-103629882
  misc_feature 1..16: note = hypo
  source 1..16: mol_type = genomic DNA
acgtagacctaacaaa

SEQ ID NO: 15144 - DNA, 30 bp, Homo sapiens
  misc_feature 1..30: note = chr8:104382635-104382665
  misc_feature 1..30: note = hypo
  source 1..30: mol_type = genomic DNA
cacttatgaaaacagcgtttatatatcatt

SEQ ID NO: 15145 - DNA, 30 bp, Homo sapiens
  misc_feature 1..30: note = chr8:106500552-106500582
  misc_feature 1..30: note = hypo
  source 1..30: mol_type = genomic DNA
tccattatcttcaaccgtgcatttccattc

SEQ ID NO: 15146 - DNA, 25 bp, Homo sapiens
  misc_feature 1..25: note = chr8:110274990-110275015
  misc_feature 1..25: note = hypo
  source 1..25: mol_type = genomic DNA
aaacctgaatgtggccgggtgtggt

SEQ ID NO: 15147 - DNA, 30 bp, Homo sapiens
  misc_feature 1..30: note = chr8:110275321-110275351
  misc_feature 1..30: note = hypo
  source 1..30: mol_type = genomic DNA
ctttgttctctagaacgcaccttcatttta

SEQ ID NO: 15148 - DNA, 171 bp, Homo sapiens
  misc_feature 1..171: note = chr8:110548417-110548588
  misc_feature 1..171: note = hypo
  source 1..171: mol_type = genomic DNA
cttcaaaggtttcaccgattttattgctgtgtttccaacacatttccacatatggtatgatatttaatttgcaaaataaatccgtaaagcaggaattactaacctaattttgcagatgagaaaactgaggcttaaagttgttcaaggtcaaagtcacgatgtccatcatgc

SEQ ID NO: 15149 - DNA, 30 bp, Homo sapiens
  misc_feature 1..30: note = chr8:110961977-110962007
  misc_feature 1..30: note = hypo
  source 1..30: mol_type = genomic DNA
ttaggaaaaatgtttcgtgacattacctaa

SEQ ID NO: 15150 - DNA, 30 bp, Homo sapiens
  misc_feature 1..30: note = chr8:117824014-117824044
  misc_feature 1..30: note = hypo
  source 1..30: mol_type = genomic DNA
aacattgtgcactcacgttttgccaggctc

SEQ ID NO: 15151 - DNA, 38 bp, Homo sapiens
  misc_feature 1..38: note = chr8:121206396-121206434
  misc_feature 1..38: note = hypo
  source 1..38: mol_type = genomic DNA
tgtcgaccggagccattcctattcggccatcttggctg

SEQ ID NO: 15152 - DNA, 144 bp, Homo sapiens
  misc_feature 1..144: note = chr8:123695516-123695660
  misc_feature 1..144: note = hypo
  source 1..144: mol_type = genomic DNA
gcaggccagttgcgccgaaggtggagtgagacgaggtgatcgcgttgagggagacttgcttttcccgagtctgtcagggcaaagcatgtgtgagtttcccatggagcagaactggcctgggaggtgcggcgccagatgctaggg

SEQ ID NO: 15153 - DNA, 248 bp, Homo sapiens
  misc_feature 1..248: note = chr8:123966089-123966337
  misc_feature 1..248: note = hypo
  source 1..248: mol_type = genomic DNA
gggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacaggtaattccacctgctcacccaggcagcaggggagaacgcagcttgctttcttttcgttgccagggttaa

SEQ ID NO: 15154 - DNA, 97 bp, Homo sapiens
  misc_feature 1..97: note = chr8:127305217-127305314
  misc_feature 1..97: note = hypo
  source 1..97: mol_type = genomic DNA
ctagccgaggagcaggtgtccctaagaacccaaatattccagctgcaaacgtatcaacaaaaacagtctcattgcacacatacggtaggcaaaatgc

SEQ ID NO: 15155 - DNA, 28 bp, Homo sapiens
  misc_feature 1..28: note = chr8:128745586-128745614
  misc_feature 1..28: note = hypo
  source 1..28: mol_type = genomic DNA
ttcagaggcaaaggccgaaggatcgctt

SEQ ID NO: 15156 - DNA, 30 bp, Homo sapiens
  misc_feature 1..30: note = chr8:128872385-128872415
  misc_feature 1..30: note = hypo
  source 1..30: mol_type = genomic DNA
ctctgtgaagagaaccggctcccagtgagc

SEQ ID NO: 15157 - DNA, 41 bp, Homo sapiens
  misc_feature 1..41: note = chr8:128889207-128889248
  misc_feature 1..41: note = hypo
  source 1..41: mol_type = genomic DNA
ttccaaagtcaggagcgtgacctccccggaagcccagctaa

SEQ ID NO: 15158 - DNA, 154 bp, Homo sapiens
  misc_feature 1..154: note = chr8:129069828-129069982
  misc_feature 1..154: note = hypo
  source 1..154: mol_type = genomic DNA
acagaatgaggtgtccgtccctccaaggcacggtgacctagaatcccactgctcactgcctgtctctgttcagcctttcagttcataaacatgctttcctccctgcattttgacatccatcatcgtttaaattccaggtcgtcatccttgtaga

SEQ ID NO: 15159 - DNA, 30 bp, Homo sapiens
  misc_feature 1..30: note = chr8:130116433-130116463
  misc_feature 1..30: note = hypo
  source 1..30: mol_type = genomic DNA
ctgtcttcggtgcctcgcacatttcttggc

SEQ ID NO: 15160 - DNA, 23 bp, Homo sapiens
  misc_feature 1..23: note = chr8:131922190-131922213
  misc_feature 1..23: note = hypo
  source 1..23: mol_type = genomic DNA
tttttttttttgagacggagttt

SEQ ID NO: 15161 - DNA, 30 bp, Homo sapiens
  misc_feature 1..30: note = chr8:133062835-133062865
  misc_feature 1..30: note = hypo
  source 1..30: mol_type = genomic DNA
gtgagacttcgggcacgtgttctttcctcg

SEQ ID NO: 15162 - DNA, 91 bp, Homo sapiens; identical to SEQ ID NO: 1580
  misc_feature 1..91: note = chr8:133686745-133686836
  misc_feature 1..91: note = hypo
  source 1..91: mol_type = genomic DNA

SEQ ID NO: 15163 - DNA, 132 bp, Homo sapiens
  misc_feature 1..132: note = chr8:133811037-133811169
  misc_feature 1..132: note = hypo
  source 1..132: mol_type = genomic DNA
tatgatggagtaattcgttgtttaaaaagaatgcacattaaagccatgcccgaggatgctaaggggcaggtaagagtgttcagtattcctagctacccaaagggttatcttcttgaacggtgactgatcaaa

SEQ ID NO: 15164 - DNA, 17 bp, Homo sapiens
  misc_feature 1..17: note = chr8:135301235-135301252
  misc_feature 1..17: note = hypo
  source 1..17: mol_type = genomic DNA
gccggccagatcccaca

SEQ ID NO: 15165 - DNA, 119 bp, Homo sapiens; identical to SEQ ID NO: 5084
  misc_feature 1..119: note = chr8:140834148-140834267
  misc_feature 1..119: note = hypo
  source 1..119: mol_type = genomic DNA

SEQ ID NO: 15166 - DNA, 30 bp, Homo sapiens
  misc_feature 1..30: note = chr8:140963317-140963347
  misc_feature 1..30: note = hypo
  source 1..30: mol_type = genomic DNA
tcagccagacccaggcgcgcacatccccac

SEQ ID NO: 15167 - DNA, 141 bp, Homo sapiens
  misc_feature 1..141: note = chr8:141202568-141202709
  misc_feature 1..141: note = hypo
  source 1..141: mol_type = genomic DNA
gcacagtgcctggggcgtgttttctagcagtaaaaacaggcagcatggtgcaggggaggagcaagctgcccgcccacagccctcgcaccagctgtgcagtcagggcagccccattatgcagagcctcgcttcaatacctgc

SEQ ID NO: 15168 - DNA, 30 bp, Homo sapiens
  misc_feature 1..30: note = chr8:141466682-141466712
  misc_feature 1..30: note = hypo
  source 1..30: mol_type = genomic DNA
acacaattaaaaaaacgaacaaacacacac

SEQ ID NO: 15169 - DNA, 38 bp, Homo sapiens; identical to SEQ ID NO: 5085
  misc_feature 1..38: note = chr8:141588102-141588140
  misc_feature 1..38: note = hypo
  source 1..38: mol_type = genomic DNA

SEQ ID NO: 15170 - DNA, 30 bp, Homo sapiens
  misc_feature 1..30: note = chr8:141597034-141597064
  misc_feature 1..30: note = hypo
  source 1..30: mol_type = genomic DNA
atgcagttacttaaccgagcctcacaacca

SEQ ID NO: 15171 - DNA, 164 bp, Homo sapiens
  misc_feature 1..164: note = chr8:142535343-142535507
  misc_feature 1..164: note = hypo
  source 1..164: mol_type = genomic DNA
cggcaaggctggggccggggcggcgggaagggtgaggtttctgtgcactgagatggggctgctggggctgtctggggagtccgaggtgcccaggggcaggcggtgggctcagtacacgaacgctgcgggcaaacaggccgggggaggagcgaggacctgcctgc

SEQ ID NO: 15172 - DNA, 30 bp, Homo sapiens
  misc_feature 1..30: note = chr8:142553829-142553859
  misc_feature 1..30: note = hypo
  source 1..30: mol_type = genomic DNA
gatggggctgagccccggcgcaggctgcca

SEQ ID NO: 15173 - DNA, 30 bp, Homo sapiens
  misc_feature 1..30: note = chr8:142560172-142560202
  misc_feature 1..30: note = hypo
  source 1..30: mol_type = genomic DNA
tgagtccccggcaggcgtcactgcccccag

SEQ ID NO: 15174 - DNA, 30 bp, Homo sapiens
  misc_feature 1..30: note = chr8:142694812-142694842
  misc_feature 1..30: note = hypo
  source 1..30: mol_type = genomic DNA
gatggagaggtgctccgtccactctgccca

SEQ ID NO: 15175 - DNA, 170 bp, Homo sapiens
  misc_feature 1..170: note = chr8:142706692-142706862
  misc_feature 1..170: note = hypo
  source 1..170: mol_type = genomic DNA
ccgggaagaaaactgcgtctgctcacgtcctttccttctgcccccatgctccctccaccttccttccagcctggacatggagcctcatttccgcagaggtgagccttgagtcacaagggtgtcccccacaaactctaggaagcaagcgccttgagcgccatgggcggtac

SEQ ID NO: 15176 - DNA, 88 bp, Homo sapiens
  misc_feature 1..88: note = chr8:143054995-143055083
  misc_feature 1..88: note = hypo
  source 1..88: mol_type = genomic DNA
ggctcacggtgcctgcgctcacgggtgcctgccctcacgagcctgcgctcacgggtgcctgtgcttacaggtgcgcaccaccccccac

SEQ ID NO: 15177 - DNA, 30 bp, Homo sapiens
  misc_feature 1..30: note = chr8:143089014-143089044
  misc_feature 1..30: note = hypo
  source 1..30: mol_type = genomic DNA
cgagcgcctcagggtcggcttcccaggcct

SEQ ID NO: 15178 - DNA, 33 bp, Homo sapiens
  misc_feature 1..33: note = chr8:143097424-143097457
  misc_feature 1..33: note = hypo
  source 1..33: mol_type = genomic DNA
gcccagccctcagagcgccgccctatgttccca

SEQ ID NO: 15179 - DNA, 146 bp, Homo sapiens
  misc_feature 1..146: note = chr8:143105231-143105377
  misc_feature 1..146: note = hypo
  source 1..146: mol_type = genomic DNA
gtctcaggcaggcaccgtctgctgtggccggcgggtggtgtgtctgggccggctctgctctagatgccgctaaggtgcaggaggcatggctgctgccctctgggagctcgtcctggggtgtccgtgtgacacggacctgcccatgc

SEQ ID NO: 15180 - DNA, 30 bp, Homo sapiens
  misc_feature 1..30: note = chr8:143333589-143333619
  misc_feature 1..30: note = hypo
  source 1..30: mol_type = genomic DNA
caagaggtaaacagacggctgcttcatctt

SEQ ID NO: 15181 - DNA, 155 bp, Homo sapiens
  misc_feature 1..155: note = chr8:143405792-143405947
  misc_feature 1..155: note = hypo
  source 1..155: mol_type = genomic DNA
tgactgaggagtctgcgaggcctgcctggggggtgtgtcacctgaggcccatttgccctagcgccctgccctagtctgccggggccagaaccgacctgagtacggaggctctcgcatttgcttgtcattacttaagatgccgtttagaagcacct

SEQ ID NO: 15182 - DNA, 53 bp, Homo sapiens
  misc_feature 1..53: note = chr8:143437078-143437131
  misc_feature 1..53: note = hypo
  source 1..53: mol_type = genomic DNA
ggcaagggctccacccgcccacacaaacacctgaagtgcgaaggcaggtttca

SEQ ID NO: 15183 - DNA, 30 bp, Homo sapiens
  misc_feature 1..30: note = chr8:143463651-143463681
  misc_feature 1..30: note = hypo
  source 1..30: mol_type = genomic DNA
cacgcccagaatcagcggtggagaagcacc

SEQ ID NO: 15184 - DNA, 122 bp, Homo sapiens
  misc_feature 1..122: note = chr8:143509422-143509544
  misc_feature 1..122: note = hypo
  source 1..122: mol_type = genomic DNA
gaccgtgggtaatggcgtcaccccatccgccgtctctctctagctgccaacggcgccttcaccagacacgcccggcaccaccttccaggtcagcagtcccagccctgcgtatcggaggcctg

SEQ ID NO: 15185 - DNA, 30 bp, Homo sapiens
  misc_feature 1..30: note = chr8:143538458-143538488
  misc_feature 1..30: note = hypo
  source 1..30: mol_type = genomic DNA
agatgcagtgaggcccggaacctgagggcc

SEQ ID NO: 15186 - DNA, 30 bp, Homo sapiens
  misc_feature 1..30: note = chr8:143557725-143557755
  misc_feature 1..30: note = hypo
  source 1..30: mol_type = genomic DNA
gtgagggaggtggcgcggggtatgggagac

SEQ ID NO: 15187 - DNA, 36 bp, Homo sapiens
  misc_feature 1..36: note = chr8:143587455-143587491
  misc_feature 1..36: note = hypo
  source 1..36: mol_type = genomic DNA
gactgagcacctgggcgaccccgaggtggagtaaac

SEQ ID NO: 15188 - DNA, 162 bp, Homo sapiens
  misc_feature 1..162: note = chr8:143595620-143595782
  misc_feature 1..162: note = hypo
  source 1..162: mol_type = genomic DNA
gggtgggatgagatccgggcagggtggtagagcgaggggaggtgagacccacgagtcctcctctagagctggcctggagccagggtgtcggcgcagatgcgggctgcgcagatgccggctctgcggctgcagcaggcctacgacggccggaaggttgagtaa

SEQ ID NO: 15189 - DNA, 161 bp, Homo sapiens
  misc_feature 1..161: note = chr8:143621956-143622117
  misc_feature 1..161: note = hypo
  source 1..161: mol_type = genomic DNA
caaggtgggtacatgcgagggaggcacatagacccctcacgtgccaggcgctcgttctgccttgtggggagcaaagtgtgaggtgtgtgggaggtcgggagccccagggtctgtgcggggtggggcggccttggggacgtgcgtcccgagagtgctgtggc

SEQ ID NO: 15190 - DNA, 36 bp, Homo sapiens
  misc_feature 1..36: note = chr8:143876928-143876964
  misc_feature 1..36: note = hypo
  source 1..36: mol_type = genomic DNA
tctttagcacgggcacgggctcgggagaccagtggc

SEQ ID NO: 15191 - DNA, 198 bp, Homo sapiens; identical to SEQ ID NO: 5086
  misc_feature 1..198: note = chr8:143993967-143994165
  misc_feature 1..198: note = hypo
  source 1..198: mol_type = genomic DNA

SEQ ID NO: 15192 - DNA, 36 bp, Homo sapiens
  misc_feature 1..36: note = chr8:144070623-144070659
  misc_feature 1..36: note = hypo
  source 1..36: mol_type = genomic DNA
ggcacagggctcctgcggccacgtcagaaacgccct

SEQ ID NO: 15193 - DNA, 72 bp, Homo sapiens
  misc_feature 1..72: note = chr8:144203849-144203921
  misc_feature 1..72: note = hypo
  source 1..72: mol_type = genomic DNA
acatgccctggatgtcgagacgcggtccacagagagatgggctcctgtgactgtcctcggataggcctctgg

SEQ ID NO: 15194 - DNA, 30 bp, Homo sapiens
  misc_feature 1..30: note = chr8:144208784-144208814
  misc_feature 1..30: note = hypo
  source 1..30: mol_type = genomic DNA
ttgtgcatggaagagcgttagatgatcccg

SEQ ID NO: 15195 - DNA, 180 bp, Homo sapiens
  misc_feature 1..180: note = chr8:144238806-144238986
  misc_feature 1..180: note = hypo
  source 1..180: mol_type = genomic DNA
agacatgggcatgcacgtgtgggtgtgggcacgtgcactgggacacgccagtttgtgccagttatgtgcatgccccagcacgtgtgcgcggggcacctggggtgtgtgtgtgtgaaggagcagggcgggcacgggtgtgtgtgcacatgctggctgcgtgggcaccgtttgtatgcttgt

SEQ ID NO: 15196 - DNA, 30 bp, Homo sapiens
  misc_feature 1..30: note = chr8:144293809-144293839
  misc_feature 1..30: note = hypo
  source 1..30: mol_type = genomic DNA
atgctgggtgggtgccggtagagtggaaag

SEQ ID NO: 15197 - DNA, 41 bp, Homo sapiens
  misc_feature 1..41: note = chr8:144326894-144326935
  misc_feature 1..41: note = hypo
  source 1..41: mol_type = genomic DNA
aaagggtctgtcaggcggaggcggagcgggggtgttcaagg

SEQ ID NO: 15198 - DNA, 100 bp, Homo sapiens
  misc_feature 1..100: note = chr8:144330280-144330380
  misc_feature 1..100: note = hypo
  source 1..100: mol_type = genomic DNA
cccggccagtccactctgcttttaagaaatattttatttctcagggtgggcagcgtgtagagaagtgagtcattccagtctctgccggttagcacctgcc

SEQ ID NO: 15199 - DNA, 57 bp, Homo sapiens
  misc_feature 1..57: note = chr8:144343530-144343587
  misc_feature 1..57: note = hypo
  source 1..57: mol_type = genomic DNA
tccccagagctgaggcggtggtgggcagggctcctgagaagccggggcagggcaggg

SEQ ID NO: 15200 - DNA, 289 bp, Homo sapiens
  misc_feature 1..289: note = chr8:144344254-144344543
  misc_feature 1..289: note = hypo
  source 1..289: mol_type = genomic DNA
tcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctg

SEQ ID NO: 15201 - DNA, 190 bp, Homo sapiens
  misc_feature 1..190: note = chr8:144360311-144360501
  misc_feature 1..190: note = hypo
  source 1..190: mol_type = genomic DNA
caccagcgctctggacgccccactctgccaggtgagaacgagtttaggggtgcgggctggaggtcagtgtgtctgtccgaagtcagctgggaggcaggcgcctacttgaggcgtccttgctggtgtgcggtgggcctggggttcagactgtctgcctgaaaggtaagggtgaggacgcctgcattctcct

SEQ ID NO: 15202 - DNA, 65 bp, Homo sapiens
  misc_feature 1..65: note = chr8:144361758-144361823
  misc_feature 1..65: note = hypo
  source 1..65: mol_type = genomic DNA
acttatccttcctcacggagcctgtttctgcctctgacaatggtggttagcgcagcccgctccgc

SEQ ID NO: 15203 - DNA, 30 bp, Homo sapiens
  misc_feature 1..30: note = chr8:144372473-144372503
  misc_feature 1..30: note = hypo
  source 1..30: mol_type = genomic DNA
cattcatgagcctctcgcccacccagtcta

SEQ ID NO: 15204 - DNA, 57 bp, Homo sapiens
  misc_feature 1..57: note = chr8:144383350-144383407
  misc_feature 1..57: note = hypo
  source 1..57: mol_type = genomic DNA
agtaaaagcacctaccgatatctcgcacaaagatggaaggaacgacctacatccagg

SEQ ID NO: 15205 - DNA, 179 bp, Homo sapiens
  misc_feature 1..179: note = chr8:144471637-144471816
  misc_feature 1..179: note = hypo
  source 1..179: mol_type = genomic DNA
cttcggcccctagaccgtgcgccagacatgcattaaggcaggagtgacttatcgagctgtcagggggagcgttttaagacagaattataggggagaggaaaaagatttttaccaaattaatgaaaaatcaatgtggcctcaaaaatccattagccttcataatgcgctggttccaggct

SEQ ID NO: 15206 - DNA, 83 bp, Homo sapiens
  misc_feature 1..83: note = chr8:144589999-144590082
  misc_feature 1..83: note = hypo
  source 1..83: mol_type = genomic DNA
ttgacaatgcggtagcgggtcttgatcaccttgctggtgggtgcagtccgcacggcatgcaggctggacgctgtagagaaaac

SEQ ID NO: 15207 - DNA, 115 bp, Homo sapiens
  misc_feature 1..115: note = chr8:144656797-144656912
  misc_feature 1..115: note = hypo
  source 1..115: mol_type = genomic DNA
cagggctgtctcccacgccggcagggcctgtgctttcactgggatgcaaatcttcctgctacctcgagctcagattcccgactccagcccagccgcagcccgggaggcgcagccc

SEQ ID NO: 15208 - DNA, 97 bp, Homo sapiens
  misc_feature 1..97: note = chr8:144668854-144668951
  misc_feature 1..97: note = hypo
  source 1..97: mol_type = genomic DNA
gtcgggcagcagagccgcccagccgccccacgtgcagctctcacctggcgggaggcacctgccacaggcccgttcatctgctcgtagaatctccttt

SEQ ID NO: 15209 - DNA, 30 bp, Homo sapiens
  misc_feature 1..30: note = chr8:144676006-144676036
  misc_feature 1..30: note = hypo
  source 1..30: mol_type = genomic DNA
catttccccgcttcccgcattcccaagcat

SEQ ID NO: 15210 - DNA, 30 bp, Homo sapiens
  misc_feature 1..30: note = chr8:144677984-144678014
  misc_feature 1..30: note = hypo
  source 1..30: mol_type = genomic DNA
cccagacaatacccacgccacacctcacac

SEQ ID NO: 15211 - DNA, 57 bp, Homo sapiens
  misc_feature 1..57: note = chr8:145753490-145753547
  misc_feature 1..57: note = hypo
  source 1..57: mol_type = genomic DNA
gcgtgcaggtgggggcggggaagctcaggaggtcctgaagctcgggaggtcctgaac

SEQ ID NO: 15212 - DNA, 106 bp, Homo sapiens
  misc_feature 1..106: note = chr8:145758572-145758678
  misc_feature 1..106: note = hypo
  source 1..106: mol_type = genomic DNA
acccagggcagctggcgctcggggtagcgctctctctgcatgcccatgacctcctgcagtgcgctgccgaacatggacgggctgaacacggcgttcttggcatgcc

SEQ ID NO: 15213 - DNA, 30 bp, Homo sapiens
  misc_feature 1..30: note = chr8:146013567-146013597
  misc_feature 1..30: note = hypo
  source 1..30: mol_type = genomic DNA
cctaggtgtggtgggcgcccaaagacaggt

SEQ ID NO: 15214 - DNA, 98 bp, Homo sapiens; identical to SEQ ID NO: 5087
  misc_feature 1..98: note = chr8:146079215-146079313
  misc_feature 1..98: note = hypo
  source 1..98: mol_type = genomic DNA

SEQ ID NO: 15215 - DNA, 105 bp, Homo sapiens; identical to SEQ ID NO: 1581
  misc_feature 1..105: note = chr9:6756353-6756458
  misc_feature 1..105: note = hypo
  source 1..105: mol_type = genomic DNA

SEQ ID NO: 15216 - DNA, 30 bp, Homo sapiens
  misc_feature 1..30: note = chr9:7164747-7164777
  misc_feature 1..30: note = hypo
  source 1..30: mol_type = genomic DNA
ggcaacttaaagcctcgcaggagtctcagt

SEQ ID NO: 15217 - DNA, 18 bp, Homo sapiens
  misc_feature 1..18: note = chr9:15533133-15533151
  misc_feature 1..18: note = hypo
  source 1..18: mol_type = genomic DNA
agacgtgtttactacaaa

SEQ ID NO: 15218 - DNA, 99 bp, Homo sapiens
  misc_feature 1..99: note = chr9:32999960-33000059
  misc_feature 1..99: note = hypo
  source 1..99: mol_type = genomic DNA
tataaaaataaaaataaaaggtaacaaagagtaggtgtctgggagcttaatggacagtcgaagaaaaacaatatagaacagtggcgaagatcaaggtct

SEQ ID NO: 15219 - DNA, 24 bp, Homo sapiens
  misc_feature 1..24: note = chr9:33647199-33647223
  misc_feature 1..24: note = hypo
  source 1..24: mol_type = genomic DNA
gcgagactgcgtctcaaaaaaaaa

SEQ ID NO: 15220 - DNA, 75 bp, Homo sapiens
  misc_feature 1..75: note = chr9:35816231-35816306
  misc_feature 1..75: note = hypo
  source 1..75: mol_type = genomic DNA
gtatgaggcaccaataagtcaggtttgcactgctggaatatatatttttgacataagaaacgtggggtcacaaaa

SEQ ID NO: 15221 - DNA, 33 bp, Homo sapiens
  misc_feature 1..33: note = chr9:36257376-36257409
  misc_feature 1..33: note = hypo
  source 1..33: mol_type = genomic DNA
gtttggcttcaactgcggcgctcctacagttgg

SEQ ID NO: 15222 - DNA, 30 bp, Homo sapiens; identical to SEQ ID NO: 5089
  misc_feature 1..30: note = chr9:37467610-37467640
  misc_feature 1..30: note = hypo
  source 1..30: mol_type = genomic DNA

SEQ ID NO: 15223 - DNA, 30 bp, Homo sapiens; identical to SEQ ID NO: 5090
  misc_feature 1..30: note = chr9:37467940-37467970
  misc_feature 1..30: note = hypo
  source 1..30: mol_type = genomic DNA

SEQ ID NO: 15224 - DNA, 30 bp, Homo sapiens
  misc_feature 1..30: note = chr9:79231349-79231379
  misc_feature 1..30: note = hypo
  source 1..30: mol_type = genomic DNA
aaatttggggcacatcgtctaaaaactgcg

SEQ ID NO: 15225 - DNA, 41 bp, Homo sapiens
  misc_feature 1..41: note = chr9:90322123-90322164
  misc_feature 1..41: note = hypo
  source 1..41: mol_type = genomic DNA
ctgagggagctgggtcgccgggatgccgcagactttttgct

SEQ ID NO: 15226 - DNA, 30 bp, Homo sapiens
  misc_feature 1..30: note = chr9:90421661-90421691
  misc_feature 1..30: note = hypo
  source 1..30: mol_type = genomic DNA
caccacaatcctcagcgatgcattctccaa

SEQ ID NO: 15227 - DNA, 39 bp, Homo sapiens
  misc_feature 1..39: note = chr9:91914149-91914188
  misc_feature 1..39: note = hypo
  source 1..39: mol_type = genomic DNA
tctggtggccaggtgcggtgactcatgcctataatccca

SEQ ID NO: 15228 - DNA, 30 bp, Homo sapiens
  misc_feature 1..30: note = chr9:92897186-92897216
  misc_feature 1..30: note = hypo
  source 1..30: mol_type = genomic DNA
ccatcccgctggctgcgggctgctggcaag

SEQ ID NO: 15229 - DNA, 77 bp, Homo sapiens
  misc_feature 1..77: note = chr9:92980516-92980593
  misc_feature 1..77: note = hypo
  source 1..77: mol_type = genomic DNA
ggtgtacacaccctgtgacgtcaggagcaatatccgtctaggatgttaggaagactatcacacggaacacaccccct

SEQ ID NO: 15230 - DNA, 22 bp, Homo sapiens
  misc_feature 1..22: note = chr9:93698029-93698051
  misc_feature 1..22: note = hypo
  source 1..22: mol_type = genomic DNA
gagcaggtggttggccgggcgc

SEQ ID NO: 15231 - DNA, 30 bp, Homo sapiens
  misc_feature 1..30: note = chr9:96362025-96362055
  misc_feature 1..30: note = hypo
  source 1..30: mol_type = genomic DNA
gcagcaagggggattcggagcacgaaaggg

SEQ ID NO: 15232 - DNA, 90 bp, Homo sapiens; identical to SEQ ID NO: 5091
  misc_feature 1..90: note = chr9:100397609-100397699
  misc_feature 1..90: note = hypo
  source 1..90: mol_type = genomic DNA

SEQ ID NO: 15233 - DNA, 37 bp, Homo sapiens
  misc_feature 1..37: note = chr9:103174717-103174754
  misc_feature 1..37: note = hypo
  source 1..37: mol_type = genomic DNA
ggggaaacaaatcaaatgtccccgtataaatgataaa

SEQ ID NO: 15234 - DNA, 30 bp, Homo sapiens
  misc_feature 1..30: note = chr9:107712165-107712195
  misc_feature 1..30: note = hypo
  source 1..30: mol_type = genomic DNA
cattttctttctggccgggcacgatggctt

SEQ ID NO: 15235 - DNA, 42 bp, Homo sapiens
  misc_feature 1..42: note = chr9:115067926-115067968
  misc_feature 1..42: note = hypo
  source 1..42: mol_type = genomic DNA
ataagagctttcagccgggcacggtggctcacgcctgtaatc

SEQ ID NO: 15236 - DNA, 24 bp, Homo sapiens
  misc_feature 1..24: note = chr9:115087591-115087615
  misc_feature 1..24: note = hypo
  source 1..24: mol_type = genomic DNA
ctaagggcccgtctgcacactggg

SEQ ID NO: 15237 - DNA, 30 bp, Homo sapiens
  misc_feature 1..30: note = chr9:116331277-116331307
  misc_feature 1..30: note = hypo
  source 1..30: mol_type = genomic DNA
gcctaagtcatcactcgagatgtgtggata

SEQ ID NO: 15238 - DNA, 42 bp, Homo sapiens
  misc_feature 1..42: note = chr9:116633864-116633906
  misc_feature 1..42: note = hypo
  source 1..42: mol_type = genomic DNA
aattccacctgccgacgtgtgcgctttctctacacgagacac

SEQ ID NO: 15239 - DNA, 30 bp, Homo sapiens
  misc_feature 1..30: note = chr9:123287840-123287870
  misc_feature 1..30: note = hypo
  source 1..30: mol_type = genomic DNA
gaagggctccgatctcggttggacctagaa

SEQ ID NO: 15240 - DNA, 30 bp, Homo sapiens
  misc_feature 1..30: note = chr9:126125543-126125573
  misc_feature 1..30: note = hypo
  source 1..30: mol_type = genomic DNA
ttcagctttgcctttcgtgtagggacgccc

SEQ ID NO: 15241 - DNA, 39 bp, Homo sapiens
  misc_feature 1..39: note = chr9:126133778-126133817
  misc_feature 1..39: note = hypo
  source 1..39: mol_type = genomic DNA
ctcaagccagcccagcgagctcggcggcaggcagtcctg

SEQ ID NO: 15242 - DNA, 80 bp, Homo sapiens
  misc_feature 1..80: note = chr9:126154254-126154334
  misc_feature 1..80: note = hypo
  source 1..80: mol_type = genomic DNA
ccccacggctgctcccgcctctgcccaccttgtctccgcgtggagttcccatgcagatgacttcccgaaccccttctaat

SEQ ID NO: 15243 - DNA, 34 bp, Homo sapiens
  misc_feature 1..34: note = chr9:126158010-126158044
  misc_feature 1..34: note = hypo
  source 1..34: mol_type = genomic DNA
actggcagcttcatacgcacgtcctaatcacacc

SEQ ID NO: 15244 - DNA, 44 bp, Homo sapiens
  misc_feature 1..44: note = chr9:126169447-126169491
  misc_feature 1..44: note = hypo
  source 1..44: mol_type = genomic DNA
ggggggtggggagcacggagctggagcctcggaggctggggagg

SEQ ID NO: 15245 - DNA, 96 bp, Homo sapiens
  misc_feature 1..96: note = chr9:128759878-128759974
  misc_feature 1..96: note = hypo
  source 1..96: mol_type = genomic DNA
aggtggcctggccaccgtccagaatggaggcccccggtgctggcctgcccagcagcacctgcggctcagtccctccaggatcggaaggaatcacac

SEQ ID NO: 15246 - DNA, 30 bp, Homo sapiens
  misc_feature 1..30: note = chr9:130180052-130180082
  misc_feature 1..30: note = hypo
  source 1..30: mol_type = genomic DNA
ttctatttcctacctcgccctcttggcaac

SEQ ID NO: 15247 - DNA, 42 bp, Homo sapiens
  misc_feature 1..42: note = chr9:131060925-131060967
  misc_feature 1..42: note = hypo
  source 1..42: mol_type = genomic DNA
tgctgggattataagcataagccaccgcgcctggccccttgg

SEQ ID NO: 15248 - DNA, 218 bp, Homo sapiens
  misc_feature 1..218: note = chr9:131504930-131505148
  misc_feature 1..218: note = hypo
  source 1..218: mol_type = genomic DNA
tgctgagcaggagctcgttgacccggcggtactggaattccagctcctcggggatgctgaagttgcagagcgtcaggcagcagttccgctgcacctgggccgggacaggacacaagtggggcacattcagggtcagactcaggagcagggctctaggaactatctagaggtatgagctcatccagagttgtggcagtccagcccggttttctggaaga

SEQ ID NO: 15249 - DNA, 22 bp, Homo sapiens
  misc_feature 1..22: note = chr9:131580093-131580115
  misc_feature 1..22: note = hypo
  source 1..22: mol_type = genomic DNA
tttgccaatctgggccgggcgc

SEQ ID NO: 15250 - DNA, 221 bp, Homo sapiens; identical to SEQ ID NO: 5093
  misc_feature 1..221: note = chr9:131854231-131854452
  misc_feature 1..221: note = hypo
  source 1..221: mol_type = genomic DNA

SEQ ID NO: 15251 - DNA, 86 bp, Homo sapiens
  misc_feature 1..86: note = chr9:132402797-132402883
  misc_feature 1..86: note = hypo
  source 1..86: mol_type = genomic DNA
cacccccggggctctcgctgaccttcaaagttgagattggccccatgccgcaagagaacgtcggccgcccgcgtcagccccagctc

SEQ ID NO: 15252 - DNA, 67 bp, Homo sapiens
  misc_feature 1..67: note = chr9:132403149-132403216
  misc_feature 1..67: note = hypo
  source 1..67: mol_type = genomic DNA
gtagagagagggccacgctgcatctcttaatacgggagcagactgggatttgcggagaatgggctgg

SEQ ID NO: 15253 - DNA, 30 bp, Homo sapiens
  misc_feature 1..30: note = chr9:133518455-133518485
  misc_feature 1..30: note = hypo
  source 1..30: mol_type = genomic DNA
gcctggctgcgataccggcctgccttgcca

SEQ ID NO: 15254 - DNA, 126 bp, Homo sapiens; identical to SEQ ID NO: 5094
  misc_feature 1..126: note = chr9:133773766-133773892
  misc_feature 1..126: note = hypo
  source 1..126: mol_type = genomic DNA

SEQ ID NO: 15255 - DNA, 59 bp, Homo sapiens
  misc_feature 1..59: note = chr9:133779518-133779577
  misc_feature 1..59: note = hypo
  source 1..59: mol_type = genomic DNA
aggaggaccactccacgccgtcggcataggaggcgtgcgcaccgcgcaggtactgccca

SEQ ID NO: 15256 - DNA, 85 bp, Homo sapiens
  misc_feature 1..85: note = chr9:133865386-133865471
  misc_feature 1..85: note = hypo
  source 1..85: mol_type = genomic DNA
tagccgtgccaggtgcgggggatgcgcgaaccggccgacagcggcccagcccttcgcggggccctgccctcggagtcacagagag

SEQ ID NO: 15257 - DNA, 30 bp, Homo sapiens
  misc_feature 1..30: note = chr9:133928236-133928266
  misc_feature 1..30: note = hypo
  source 1..30: mol_type = genomic DNA
cctgcaggagacctccgaggacgtggcccc

SEQ ID NO: 15258 - DNA, 133 bp, Homo sapiens
  misc_feature 1..133: note = chr9:134191085-134191218
  misc_feature 1..133: note = hypo
  source 1..133: mol_type = genomic DNA
acctctcaggggtggcgagggtgttgcgttgcctccttctacagacgcaaatgccacctaatcacacagctccctctgcaaacccgctcccatctccatagcaactacagggcttcggcgctcttgggctcct

SEQ ID NO: 15259 - DNA, 71 bp, Homo sapiens
  misc_feature 1..71: note = chr9:134207916-134207987
  misc_feature 1..71: note = hypo
  source 1..71: mol_type = genomic DNA
gtggctttgacttaccgtgtaagactccatttcctcatctgtaaaatgaggagaaccggccagccgggcgc

SEQ ID NO: 15260 - DNA, 50 bp, Homo sapiens
  misc_feature 1..50: note = chr9:134717269-134717319
  misc_feature 1..50: note = hypo
  source 1..50: mol_type = genomic DNA
gggaagagaaaaagccgagaaaaaagcggtttgaacggggggtgatgtca

SEQ ID NO: 15261 - DNA, 52 bp, Homo sapiens
  misc_feature 1..52: note = chr9:135768018-135768070
  misc_feature 1..52: note = hypo
  source 1..52: mol_type = genomic DNA
tcttagtgctttcagcgagaaaaggtgagtctcattacgcagaacttttgtt

SEQ ID NO: 15262 - DNA, 107 bp, Homo sapiens
  misc_feature 1..107: note = chr9:135865054-135865161
  misc_feature 1..107: note = hypo
  source 1..107: mol_type = genomic DNA
ttccgcaggggatcccggccgggtccagtcctgagcctgcacctgaccccccggggcctcatttcctccggcaggagcgcagcttcgagtgccgcatgtgcggcaag

SEQ ID NO: 15263 - DNA, 202 bp, Homo sapiens; identical to SEQ ID NO: 5095
  misc_feature 1..202: note = chr9:135898911-135899113
  misc_feature 1..202: note = hypo
  source 1..202: mol_type = genomic DNA

SEQ ID NO: 15264 - DNA, 103 bp, Homo sapiens
  misc_feature 1..103: note = chr9:136375630-136375733
  misc_feature 1..103: note = hypo
  source 1..103: mol_type = genomic DNA
cgaacttaaattatttaaaatgaggataacatttaaagatccaggtttggggttgtaccagctacgttgcagatgcccaggcaccaggcgtgttgggcagccc

SEQ ID NO: 15265 - DNA, 30 bp, Homo sapiens
  misc_feature 1..30: note = chr9:136999528-136999558
  misc_feature 1..30: note = hypo
  source 1..30: mol_type = genomic DNA
agggttctggggtctcgccccttatcttgc

SEQ ID NO: 15266 - DNA, 170 bp, Homo sapiens
  misc_feature 1..170: note = chr9:137656958-137657128
  misc_feature 1..170: note = hypo
  source 1..170: mol_type = genomic DNA
tcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcag

SEQ ID NO: 15267 - DNA, 59 bp, Homo sapiens
  misc_feature 1..59: note = chr9:137710245-137710304
  misc_feature 1..59: note = hypo
  source 1..59: mol_type = genomic DNA
tggcgctgtgacacccggtctgtggtcggcgcagtcagcggagacgggatccctgctgg

SEQ ID NO: 15268 - DNA, 218 bp, Homo sapiens
  misc_feature 1..218: note = chr9:137718872-137719090
  misc_feature 1..218: note = hypo
  source 1..218: mol_type = genomic DNA
ctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacc

SEQ ID NO: 15269 - DNA, 34 bp, Homo sapiens
  misc_feature 1..34: note = chr9:138289547-138289581
  misc_feature 1..34: note = hypo
  source 1..34: mol_type = genomic DNA
atgctgcaggccaggcgctcggttacactcttca

SEQ ID NO: 15270 - DNA, 44 bp, Homo sapiens
  misc_feature 1..44: note = chr9:138562752-138562796
  misc_feature 1..44: note = hypo
  source 1..44: mol_type = genomic DNA
cccctcaccatagcccgcccagggtctctcgggcatcgaaagga

SEQ ID NO: 15271 - DNA, 68 bp, Homo sapiens; identical to SEQ ID NO: 5096
  misc_feature 1..68: note = chr9:138563212-138563280
  misc_feature 1..68: note = hypo
  source 1..68: mol_type = genomic DNA

SEQ ID NO: 15272 - DNA, 165 bp, Homo sapiens; identical to SEQ ID NO: 5097
  misc_feature 1..165: note = chr9:138627636-138627801
  misc_feature 1..165: note = hypo
  source 1..165: mol_type = genomic DNA

SEQ ID NO: 15273 - DNA, 30 bp, Homo sapiens
  misc_feature 1..30: note = chr9:138634173-138634203
  misc_feature 1..30: note = hypo
  source 1..30: mol_type = genomic DNA
ggcctgggctggcttcgtgctgagcagggc

SEQ ID NO: 15274 - DNA, 35 bp, Homo sapiens; identical to SEQ ID NO: 5098
  misc_feature 1..35: note = chr9:138650129-138650164
  misc_feature 1..35: note = hypo
  source 1..35: mol_type = genomic DNA

SEQ ID NO: 15275 - DNA, 30 bp, Homo sapiens
  misc_feature 1..30: note = chr9:138659727-138659757
  misc_feature 1..30: note = hypo
  source 1..30: mol_type = genomic DNA
gctcccactcagggccgtggccaggagaag

SEQ ID NO: 15276 - DNA, 322 bp, Homo sapiens
  misc_feature 1..322: note = chr9:138660824-138661146
  misc_feature 1..322: note = hypo
  source 1..322: mol_type = genomic DNA
gggcacgtgtgcacacgtgggtgatggtgcatctggggcagggcgcatgtgcacatgtgtgacggtgcgtctggggcaggacgcgtgtgcacacgtgggtgacggtgcgtctggggcaggatgcgtgtgcacacgtgggtgtcggtgcgtctggggcagggcgcatgtgcacacgtgggtgacggtgcgtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggc

SEQ ID NO: 15277 - DNA, 96 bp, Homo sapiens
  misc_feature 1..96: note = chr9:138661837-138661933
  misc_feature 1..96: note = hypo
  source 1..96: mol_type = genomic DNA
tgaactgcatctgcccggcgacctccaccctcatcaccctgctggtgcacacgtcccgcggccagtgagtgccccgtgccccgggggaccgacctc

SEQ ID NO: 15278 - DNA, 40 bp, Homo sapiens
  misc_feature 1..40: note = chr9:138743731-138743771
  misc_feature 1..40: note = hypo
  source 1..40: mol_type = genomic DNA
ctctgagaggggactcgctgggccacgagctaggcacgcc

SEQ ID NO: 15279 - DNA, 30 bp, Homo sapiens
  misc_feature 1..30: note = chr9:138780600-138780630
  misc_feature 1..30: note = hypo
  source 1..30: mol_type = genomic DNA
gcgaccagtagtccacgccccagctccatc

SEQ ID NO: 15280 - DNA, 45 bp, Homo sapiens
  misc_feature 1..45: note = chr9:138994395-138994440
  misc_feature 1..45: note = hypo
  source 1..45: mol_type = genomic DNA
aggggaggtggggagcgttcggactgaggccgggcaggtgggccc

SEQ ID NO: 15281 - DNA, 121 bp, Homo sapiens; identical to SEQ ID NO: 1583
  misc_feature 1..121: note = chr9:139012272-139012393
  misc_feature 1..121: note = hypo
  source 1..121: mol_type = genomic DNA

SEQ ID NO: 15282 - DNA, 30 bp, Homo sapiens
  misc_feature 1..30: note = chr9:139100397-139100427
  misc_feature 1..30: note = hypo
  source 1..30: mol_type = genomic DNA
cccttgttagaagagcgtttgtaaaaccag

SEQ ID NO: 15283 - DNA, 144 bp, Homo sapiens
  misc_feature 1..144: note = chr9:139421932-139422076
  misc_feature 1..144: note = hypo
  source 1..144: mol_type = genomic DNA
cttccatgagtgacccgcaccccaccttccaccgtccccgcatctcctcctatcaggggcggtggggagacccctctggggctaaaaagtgaggcttgagatagggaacgccagtctcccccgactggacgagagagctgccct

SEQ ID NO: 15284 - DNA, 40 bp, Homo sapiens
  misc_feature 1..40: note = chr9:139472499-139472539
  misc_feature 1..40: note = hypo
  source 1..40: mol_type = genomic DNA
ctggaggtaaatctgcgcaagaacgcgggctttggttaag

SEQ ID NO: 15285 - DNA, 39 bp, Homo sapiens
  misc_feature 1..39: note = chr9:139506449-139506488
  misc_feature 1..39: note = hypo
  source 1..39: mol_type = genomic DNA
gggtgacggatgaaccgggtagaccgtctgtacaatgga

SEQ ID NO: 15286 - DNA, 51 bp, Homo sapiens
  misc_feature 1..51: note = chr9:139634047-139634098
  misc_feature 1..51: note = hypo
  source 1..51: mol_type = genomic DNA
aggagacacatgagccgtgaacacgtctcccccggccgctccctggttcca

SEQ ID NO: 15287 - DNA, 166 bp, Homo sapiens
  misc_feature 1..166: note = chr9:139698925-139699091
  misc_feature 1..166: note = hypo
  source 1..166: mol_type = genomic DNA
aaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccgggtaagccccagg

SEQ ID NO: 15288 - DNA, 17 bp, Homo sapiens
  misc_feature 1..17: note = chr9:139703929-139703946
  misc_feature 1..17: note = hypo
  source 1..17: mol_type = genomic DNA
atgaaagttggtgtccg

SEQ ID NO: 15289 - DNA, 136 bp, Homo sapiens; identical to SEQ ID NO: 1585
  misc_feature 1..136: note = chr9:139704066-139704202
  misc_feature 1..136: note = hypo
  source 1..136: mol_type = genomic DNA

SEQ ID NO: 15290 - DNA, 30 bp, Homo sapiens
  misc_feature 1..30: note = chr9:139714130-139714160
  misc_feature 1..30: note = hypo
  source 1..30: mol_type = genomic DNA
caaaatgaaagagagcgggtagaaatgtga

SEQ ID NO: 15291 - DNA, 30 bp, Homo sapiens
  misc_feature 1..30: note = chr9:139717804-139717834
  misc_feature 1..30: note = hypo
  source 1..30: mol_type = genomic DNA
atggtacccacccatcgtcttcctcccctg

SEQ ID NO: 15292 - DNA, 72 bp, Homo sapiens
  misc_feature 1..72: note = chr9:139809893-139809965
  misc_feature 1..72: note = hypo
  source 1..72: mol_type = genomic DNA
gtggatccagccaaccgtaggttggaaatgttcaggtaaaaatgcactgaacacgcgcggacattttttatt

SEQ ID NO: 15293 - DNA, 55 bp, Homo sapiens
  misc_feature 1..55: note = chr9:139818567-139818622
  misc_feature 1..55: note = hypo
  source 1..55: mol_type = genomic DNA
tgtctgcagcaggcacgtcaccctgtgatgctgtgtcacgcggtggagagctctg

SEQ ID NO: 15294 - DNA, 227 bp, Homo sapiens
  misc_feature 1..227: note = chr9:139859041-139859268
  misc_feature 1..227: note = hypo
  source 1..227: mol_type = genomic DNA
gcacagagagcaggacgccaggtgcgctcccgggaagctgtcctagagaggggccggaccgcacacctggcgctggaagcctccatgactggatgtttgcaagaaacagaaagaaacttctgtccagtctcagccacaggcacgccaggtcctctgctgccttgccgcaagctcgggggtttcagtgagaccctctcccactcccacggcctcgagtggaccaggta

SEQ ID NO: 15295 - DNA, 54 bp, Homo sapiens
  misc_feature 1..54: note = chr9:139888895-139888949
  misc_feature 1..54: note = hypo
  source 1..54: mol_type = genomic DNA
gatccctgaggccaccggttgcaggaggcctggagtctgcgccttcttagcgtg

SEQ ID NO: 15296 - DNA, 30 bp, Homo sapiens
  misc_feature 1..30: note = chr9:139978966-139978996
  misc_feature 1..30: note = hypo
  source 1..30: mol_type = genomic DNA
ataaacacaaggtgccgtaattgactgcta

SEQ ID NO: 15297 - DNA, 30 bp, Homo sapiens
  misc_feature 1..30: note = chr9:140030509-140030539
  misc_feature 1..30: note = hypo
  source 1..30: mol_type = genomic DNA
acagcgtctggtacacggtaggtgctcagt

SEQ ID NO: 15298 - DNA, 113 bp, Homo sapiens
  misc_feature 1..113: note = chr9:140107128-140107241
  misc_feature 1..113: note = hypo
  source 1..113: mol_type = genomic DNA
accagcttccagggtcggcccctgcgcgcctcagggccctcgcagtggtactggcttctccacaacgctccctggtgggcaccccaggcttcacgctgcggggagggcacaga

SEQ ID NO: 15299 - DNA, 30 bp, Homo sapiens
  misc_feature 1..30: note = chr9:140108225-140108255
  misc_feature 1..30: note = hypo
  source 1..30: mol_type = genomic DNA
ccacaggttcaacttcgtggccaagaagct

SEQ ID NO: 15300 - DNA, 268 bp, Homo sapiens; identical to SEQ ID NO: 5102
  misc_feature 1..268: note = chr9:140127812-140128080
  misc_feature 1..268: note = hypo
  source 1..268: mol_type = genomic DNA

SEQ ID NO: 15301 - DNA, 180 bp, Homo sapiens
  misc_feature 1..180: note = chr9:140137562-140137742
  misc_feature 1..180: note = hypo
  source 1..180: mol_type = genomic DNA
acatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccac

SEQ ID NO: 15302 - DNA, 42 bp, Homo sapiens
  misc_feature 1..42: note = chr9:140245865-140245907
  misc_feature 1..42: note = hypo
  source 1..42: mol_type = genomic DNA
cgtccagaaggaacacgtggccctccacggccacctgcagga

SEQ ID NO: 15303 - DNA, 30 bp, Homo sapiens
  misc_feature 1..30: note = chr9:140265779-140265809
  misc_feature 1..30: note = hypo
  source 1..30: mol_type = genomic DNA
cccgccgcgagacgacggccccgggcgtgg

SEQ ID NO: 15304 - DNA, 61 bp, Homo sapiens
  misc_feature 1..61: note = chr9:140267262-140267323
  misc_feature 1..61: note = hypo
  source 1..61: mol_type = genomic DNA
gcccccacacagaggcggccctgagccaggcgcgtccttgccccaccgcccgagaagccgt

SEQ ID NO: 15305 - DNA, 78 bp, Homo sapiens
  misc_feature 1..78: note = chr9:140274184-140274262
  misc_feature 1..78: note = hypo
  source 1..78: mol_type = genomic DNA
ctctgatttggggtgcgctctcgcccaggctggtttctgtcacccccggagttctgcagcacccgttctaaccacagc

SEQ ID NO: 15306 - DNA, 166 bp, Homo sapiens
  misc_feature 1..166: note = chr9:140332949-140333115
  misc_feature 1..166: note = hypo
  source 1..166: mol_type = genomic DNA
ccttagaggcatctccggggctcaggcggcctcccgtggccatagaggcatctccggggctcagacggcctcccgtggccatagaggcatccccggggctcagacggcctcccgtggccatagaggcatccccggggctcagacggtctcccgtggccatagaggc

SEQ ID NO: 15307 - DNA, 39 bp, Homo sapiens
  misc_feature 1..39: note = chr9:140382566-140382605
  misc_feature 1..39: note = hypo
  source 1..39: mol_type = genomic DNA
gagcttcggcctgaacgctgctctcgtggtctgatgtct

SEQ ID NO: 15308 - DNA, 142 bp, Homo sapiens
  misc_feature 1..142: note = chr9:140389345-140389487
  misc_feature 1..142: note = hypo
  source 1..142: mol_type = genomic DNA
ccttcacctgctctgcgctctcacctgctccgcgccctcacctgctctgtgccctcacccgctccgccctcacctgttccatgccctcatccactccacaccctcatccgctccgcatcctcacccacgccatgctcacctg

SEQ ID NO: 15309 - DNA, 260 bp, Homo sapiens
  misc_feature 1..260: note = chr9:140392377-140392637
  misc_feature 1..260: note = hypo
  source 1..260: mol_type = genomic DNA
aaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgac

SEQ ID NO: 15310 - DNA, 167 bp, Homo sapiens
  misc_feature 1..167: note = chr9:140396560-140396727
  misc_feature 1..167: note = hypo
  source 1..167: mol_type = genomic DNA
atgccctccagggcacgaggactctggaatctgggagctcccagaggtgacccgggagtgcccaacacactggaacccagaaggcagaggttgcagtggacccggagcctgtggagaggccctggggcaaaccaagggtgagggagcgtctgcgggcaccacaccca

SEQ ID NO: 15311 - DNA, 30 bp, Homo sapiens
  misc_feature 1..30: note = chr9:140397067-140397097
  misc_feature 1..30: note = hypo
  source 1..30: mol_type = genomic DNA
ttcaggagaagaaagcggcctccctgagga

SEQ ID NO: 15312 - DNA, 71 bp, Homo sapiens
  misc_feature 1..71: note = chr9:140400208-140400279
  misc_feature 1..71: note = hypo
  source 1..71: mol_type = genomic DNA
tggactggagaagaacggagataccggcaattcgaagggatgtggttggggaacatcgcacaagggtgtgg

SEQ ID NO: 15313 - DNA, 45 bp, Homo sapiens
  misc_feature 1..45: note = chr9:140680320-140680365
  misc_feature 1..45: note = hypo
  source 1..45: mol_type = genomic DNA
gccctgcaagtgcctcgcatagcagggttccgtttgtttgctttt

SEQ ID NO: 15314 - DNA, 30 bp, Homo sapiens
  misc_feature 1..30: note = chr9:140727555-140727585
  misc_feature 1..30: note = hypo
  source 1..30: mol_type = genomic DNA
gtccacgcctttacccgcttgttggtttgg

SEQ ID NO: 15315 - DNA, 32 bp, Homo sapiens
  misc_feature 1..32: note = chr9:140969282-140969314
  misc_feature 1..32: note = hypo
  source 1..32: mol_type = genomic DNA
tgttagtctggcagccgcgctgaaggacaggc

SEQ ID NO: 15316 - DNA, 145 bp, Homo sapiens
  misc_feature 1..145: note = chr9:141022582-141022727
  misc_feature 1..145: note = hypo
  source 1..145: mol_type = genomic DNA
cttatttaactttaacgatggtttcccactggcatcagaacaggggtcgcagaactgacctggcccccagtccctgagcgctcccacctgctgccctctcccgcccagcccagcccagctgcctgcgttgcggcctccacctgca

SEQ ID NO: 15317 - DNA, 30 bp, Homo sapiens
  misc_feature 1..30: note = chr10:833307-833337
  misc_feature 1..30: note = hypo
  source 1..30: mol_type = genomic DNA
caggtcctctgcaggcggggacggtgccgg

SEQ ID NO: 15318 - DNA, 35 bp, Homo sapiens
  misc_feature 1..35: note = chr10:851432-851467
  misc_feature 1..35: note = hypo
  source 1..35: mol_type = genomic DNA
gcctggcggcctctgcggagcgccctctgcggagc

SEQ ID NO: 15319 - DNA, 76 bp, Homo sapiens
  misc_feature 1..76: note = chr10:978857-978933
  misc_feature 1..76: note = hypo
  source 1..76: mol_type = genomic DNA
gggaccaaaaggccccggccccacgtttcctagaggcgctgggttcgggcccacgttgcaacgagtcagatgctct

SEQ ID NO: 15320 - DNA, 62 bp, Homo sapiens
  misc_feature 1..62: note = chr10:1156723-1156785
  misc_feature 1..62: note = hypo
  source 1..62: mol_type = genomic DNA
atcgccaaggacatccgtgagcctccgatgggtgtccagcgtgttagcgcccagacccacag

SEQ ID NO: 15321 - DNA, 30 bp, Homo sapiens
  misc_feature 1..30: note = chr10:1259979-1260009
  misc_feature 1..30: note = hypo
  source 1..30: mol_type = genomic DNA
ctttgcacctgtacccggacctgccggtga

SEQ ID NO: 15322 - DNA, 30 bp, Homo sapiens
  misc_feature 1..30: note = chr10:2283030-2283060
  misc_feature 1..30: note = hypo
  source 1..30: mol_type = genomic DNA
agagcccctgatgctcgaggttcccaggac

SEQ ID NO: 15323 - DNA, 78 bp, Homo sapiens
  misc_feature 1..78: note = chr10:3161042-3161120
  misc_feature 1..78: note = hypo
  source 1..78: mol_type = genomic DNA
gatcatcggtggattcgaggtacgttaccgtttctctcttgccggtcttgcaggtgtgagccgcgccctgtgttggct

SEQ ID NO: 15324 - DNA, 30 bp, Homo sapiens
  misc_feature 1..30: note = chr10:3329710-3329740
  misc_feature 1..30: note = hypo
  source 1..30: mol_type = genomic DNA
tgttgtaattgagtgcgtgcacactcagta

SEQ ID NO: 15325 - DNA, 43 bp, Homo sapiens
  misc_feature 1..43: note = chr10:3330464-3330507
  misc_feature 1..43: note = hypo
  source 1..43: mol_type = genomic DNA
aggtgagggctcccccgcgccgccctggcgtccaggtggtgag

SEQ ID NO: 15326 - DNA, 45 bp, Homo sapiens
  misc_feature 1..45: note = chr10:3895395-3895440
  misc_feature 1..45: note = hypo
  source 1..45: mol_type = genomic DNA
ggtttccagctgtgtcgtgttgacttgaaccgactcagcaggcgg

SEQ ID NO: 15327 - DNA, 30 bp, Homo sapiens
  misc_feature 1..30: note = chr10:5531069-5531099
  misc_feature 1..30: note = hypo
  source 1..30: mol_type = genomic DNA
acggagggcgacctgcgcagcctaggcact

SEQ ID NO: 15328 - DNA, 30 bp, Homo sapiens
  misc_feature 1..30: note = chr10:5538908-5538938
  misc_feature 1..30: note = hypo
  source 1..30: mol_type = genomic DNA
caggtgggaaagagacgaatcctgactcca

SEQ ID NO: 15329 - DNA, 112 bp, Homo sapiens
  misc_feature 1..112: note = chr10:5540808-5540920
  misc_feature 1..112: note = hypo
  source 1..112: mol_type = genomic DNA
atccaggccccggagcgcaaagccttcctcccagggggaggcagtttcccatccaccgaccaggtttccccggagagtcccagcacaaaagcagcagcgggcggtggccctg

SEQ ID NO: 15330 - DNA, 312 bp, Homo sapiens
  misc_feature 1..312: note = chr10:5541199-5541511
  misc_feature 1..312: note = hypo
  source 1..312: mol_type = genomic DNA
cctggaagctgatttcgccgtcgccgtcgctgtcaacctcggagatgagtttccttagctgggcctccgagaggttcttgcccgtggccttcagcgccgcgcccagctcctgggcattgatggtgccgtttccatccgtgtcaaccgcggagaaagcctttttgtactgggcctcctcctcaggagtcagctcaccggccatgcctgcgtctcctgcacctcgcggagcctccgagctgctgcccaccggccctcaacctgctgctctcagagctcgtggtccagagtgcaggcagccgcagggatccgggc

SEQ ID NO: 15331 - DNA, 30 bp, Homo sapiens
  misc_feature 1..30: note = chr10:5553298-5553328
  misc_feature 1..30: note = hypo
  source 1..30: mol_type = genomic DNA
ctactgctcacacctcgacttctcagggag

SEQ ID NO: 15332 - DNA, 30 bp, Homo sapiens
  misc_feature 1..30: note = chr10:5567180-5567210
  misc_feature 1..30: note = hypo
  source 1..30: mol_type = genomic DNA
acggaggccgagctgcgggacatgatgagt

SEQ ID NO: 15333 - DNA, 30 bp, Homo sapiens
  misc_feature 1..30: note = chr10:5875038-5875068
  misc_feature 1..30: note = hypo
  source 1..30: mol_type = genomic DNA
tccctgagaaccagtcggaccaggacaggc

SEQ ID NO: 15334 - DNA, 37 bp, Homo sapiens; identical to SEQ ID NO: 1586
  misc_feature 1..37: note = chr10:5875322-5875359
  misc_feature 1..37: note = hypo
  source 1..37: mol_type = genomic DNA

SEQ ID NO: 15335 - DNA, 30 bp, Homo sapiens
  misc_feature 1..30: note = chr10:6003491-6003521
  misc_feature 1..30: note = hypo
  source 1..30: mol_type = genomic DNA
cgaggacgctcggagcggctgcgtgtgaaa

SEQ ID NO: 15336 - DNA, 205 bp, Homo sapiens
  misc_feature 1..205: note = chr10:6042309-6042514
  misc_feature 1..205: note = hypo
  source 1..205: mol_type = genomic DNA
agggtttccttaaggcgtgccgttaaatattcgtaaaatgaacacatgaagagcctagagtccagaggtcctagcagatggtgttacatcctcatcgtgaggcacgtggacgggggtttccgaccacctgcgttcacccctagaattgggattgatctgggcacctctgggaaacatatgggacaggacccgtgactctagttgc

SEQ ID NO: 15337 - DNA, 30 bp, Homo sapiens
  misc_feature 1..30: note = chr10:6159901-6159931
  misc_feature 1..30: note = hypo
  source 1..30: mol_type = genomic DNA
tgatcagaccggcaccgcagtgtgggagag

SEQ ID NO: 15338 - DNA, 24 bp, Homo sapiens
  misc_feature 1..24: note = chr10:6199196-6199220
  misc_feature 1..24: note = hypo
  source 1..24: mol_type = genomic DNA
tttttttttttgagacggagtctc

SEQ ID NO: 15339 - DNA, 15 bp, Homo sapiens
  misc_feature 1..15: note = chr10:6564170-6564185
  misc_feature 1..15: note = hypo
  source 1..15: mol_type = genomic DNA
cgggattacaagagt

SEQ ID NO: 15340 - DNA, 47 bp, Homo sapiens
  misc_feature 1..47: note = chr10:6577682-6577729
  misc_feature 1..47: note = hypo
  source 1..47: mol_type = genomic DNA
tttgaagtctcccctcgccgcgcctctttagacgcacctgagatcca

SEQ ID NO: 15341 - DNA, 42 bp, Homo sapiens
  misc_feature 1..42: note = chr10:7203062-7203104
  misc_feature 1..42: note = hypo
  source 1..42: mol_type = genomic DNA
acggagagtcttgggcgcttggctccacgggaagcaaacact

SEQ ID NO: 15342 - DNA, 82 bp, Homo sapiens
  misc_feature 1..82: note = chr10:7205705-7205787
  misc_feature 1..82: note = hypo
  source 1..82: mol_type = genomic DNA
taatgggccacctcccgagggcagactcagttggcgtactgggcgtagaaagccactttgactctctcgatctggtggcata

SEQ ID NO: 15343 - DNA, 30 bp, Homo sapiens
  misc_feature 1..30: note = chr10:7212955-7212985
  misc_feature 1..30: note = hypo
  source 1..30: mol_type = genomic DNA
gaccgtccactccaacgggttgctctccag

SEQ ID NO: 15344 - DNA, 30 bp, Homo sapiens
  misc_feature 1..30: note = chr10:7213658-7213688
  misc_feature 1..30: note = hypo
  source 1..30: mol_type = genomic DNA
actccattctgatgccgaaaggcccctcca

SEQ ID NO: 15345 - DNA, 30 bp, Homo sapiens
  misc_feature 1..30: note = chr10:7214234-7214264
  misc_feature 1..30: note = hypo
  source 1..30: mol_type = genomic DNA
gccagtggtcccacccgtgggccctacgag

SEQ ID NO: 15346 - DNA, 43 bp, Homo sapiens
  misc_feature 1..43: note = chr10:7236181-7236224
  misc_feature 1..43: note = hypo
  source 1..43: mol_type = genomic DNA
tcccctacctcccctcgctgcaccccctcgaattgaggccaga

SEQ ID NO: 15347 - DNA, 30 bp, Homo sapiens
  misc_feature 1..30: note = chr10:7340032-7340062
  misc_feature 1..30: note = hypo
  source 1..30: mol_type = genomic DNA
gcacccagaggccctcgcagcttgtccttc

SEQ ID NO: 15348 - DNA, 21 bp, Homo sapiens
  misc_feature 1..21: note = chr10:7414164-7414185
  misc_feature 1..21: note = hypo
  source 1..21: mol_type = genomic DNA
ccgccacgcccggccttcttg

SEQ ID NO: 15349 - DNA, 30 bp, Homo sapiens
  misc_feature 1..30: note = chr10:7414544-7414574
  misc_feature 1..30: note = hypo
  source 1..30: mol_type = genomic DNA
ccaagaagtttagagcgtcacagacacagc

SEQ ID NO: 15350 - DNA, 128 bp, Homo sapiens
  misc_feature 1..128: note = chr10:11472865-11472993
  misc_feature 1..128: note = hypo
  source 1..128: mol_type = genomic DNA
ggctccgagaacacacgcatgaataaataaaaccaatactctgctgctgagacatcgctacatccagaaggacccagagcaacagacgcagagaaaagcaacatggaccaccgcggcctgacagcagg

SEQ ID NO: 15351 - DNA, 30 bp, Homo sapiens
  misc_feature 1..30: note = chr10:13137625-13137655
  misc_feature 1..30: note = hypo
  source 1..30: mol_type = genomic DNA
tcacctcctgctgttcggtctagttcctga

SEQ ID NO: 15352 - DNA, 126 bp, Homo sapiens
  misc_feature 1..126: note = chr10:13355078-13355204
  misc_feature 1..126: note = hypo
  source 1..126: mol_type = genomic DNA
ccccaaagatgttcacgccctaatccctggaatctgtggctgttaccttacctggcaaaagggattttccaaatgtgattaacgttaaggactttgatagggggatcaccccgtattatctgggtg

SEQ ID NO: 15353 - DNA, 32 bp, Homo sapiens
  misc_feature 1..32: note = chr10:15000601-15000633
  misc_feature 1..32: note = hypo
  source 1..32: mol_type = genomic DNA
aacatgtaaattggccgggcgcggtggctcac

SEQ ID NO: 15354 - DNA, 39 bp, Homo sapiens; identical to SEQ ID NO: 5104
  misc_feature 1..39: note = chr10:15140487-15140526
  misc_feature 1..39: note = hypo
  source 1..39: mol_type = genomic DNA

SEQ ID NO: 15355 - DNA, 30 bp, Homo sapiens
  misc_feature 1..30: note = chr10:16715583-16715613
  misc_feature 1..30: note = hypo
  source 1..30: mol_type = genomic DNA
atgtttcttgaagcacgtgatcatgcctga

SEQ ID NO: 15356 - DNA, 96 bp, Homo sapiens
  misc_feature 1..96: note = chr10:17429165-17429261
  misc_feature 1..96: note = hypo
  source 1..96: mol_type = genomic DNA
gggcccagtggaagacgcacagcaccgtggattccccttgcaagcttaaggcccgctagttggaatttaaggaaaagaaaacaataattttttttt

SEQ ID NO: 15357 - DNA, 96 bp, Homo sapiens
  misc_feature 1..96: note = chr10:17429561-17429657
  misc_feature 1..96: note = hypo
  source 1..96: mol_type = genomic DNA
ggcccagaaaactaggattttcatagggctatccttctgtgagaaacggagctaacatacaggactggactgctgtcacatcgattaacccaaatc

SEQ ID NO: 15358 - DNA, 30 bp, Homo sapiens
  misc_feature 1..30: note = chr10:24841823-24841853
  misc_feature 1..30: note = hypo
  source 1..30: mol_type = genomic DNA
ttaccgtgccatgcacgcacccatcagcag

SEQ ID NO: 15359 - DNA, 22 bp, Homo sapiens
  misc_feature 1..22: note = chr10:26128001-26128023
  misc_feature 1..22: note = hypo
  source 1..22: mol_type = genomic DNA
acttccacggcctggcgcggtg

SEQ ID NO: 15360 - DNA, 30 bp, Homo sapiens
  misc_feature 1..30: note = chr10:26638451-26638481
  misc_feature 1..30: note = hypo
  source 1..30: mol_type = genomic DNA
gagggatggaagagacgagaggtggggaga

SEQ ID NO: 15361 - DNA, 30 bp, Homo sapiens
  misc_feature 1..30: note = chr10:26733386-26733416
  misc_feature 1..30: note = hypo
  source 1..30: mol_type = genomic DNA
aagcgttggattctgcgtatattttgaagg

SEQ ID NO: 15362 - DNA, 30 bp, Homo sapiens
  misc_feature 1..30: note = chr10:26739045-26739075
  misc_feature 1..30: note = hypo
  source 1..30: mol_type = genomic DNA
gggggttgtgttaaacgctgggcagttttg

SEQ ID NO: 15363 - DNA, 30 bp, Homo sapiens
  misc_feature 1..30: note = chr10:26877730-26877760
  misc_feature 1..30: note = hypo
  source 1..30: mol_type = genomic DNA
gaggcgcccagaacacgctgtcccccaatg

SEQ ID NO: 15364 - DNA, 30 bp, Homo sapiens
  misc_feature 1..30: note = chr10:26926812-26926842
  misc_feature 1..30: note = hypo
  source 1..30: mol_type = genomic DNA
aaggaccaagcagcccgagaagagcagagg

SEQ ID NO: 15365 - DNA, 46 bp, Homo sapiens
  misc_feature 1..46: note = chr10:31892894-31892940
  misc_feature 1..46: note = hypo
  source 1..46: mol_type = genomic DNA
cccgtggccagcacccgaggcctgctggctccgatctgggccacgt

SEQ ID NO: 15366 - DNA, 30 bp, Homo sapiens
  misc_feature 1..30: note = chr10:32499025-32499055
  misc_feature 1..30: note = hypo
  source 1..30: mol_type = genomic DNA
caaattctccagtcccgcctcagacctact

SEQ ID NO: 15367 - DNA, 31 bp, Homo sapiens
  misc_feature 1..31: note = chr10:38078895-38078926
  misc_feature 1..31: note = hypo
  source 1..31: mol_type = genomic DNA
aaacctgcctggggccgggcgccatggctca

SEQ ID NO: 15368 - DNA, 39 bp, Homo sapiens
  misc_feature 1..39: note = chr10:43906055-43906094
  misc_feature 1..39: note = hypo
  source 1..39: mol_type = genomic DNA
tgttgggattactggattgagccacgcatctggctgaac

SEQ ID NO: 15369 - DNA, 38 bp, Homo sapiens
  misc_feature 1..38: note = chr10:46221018-46221056
  misc_feature 1..38: note = hypo
  source 1..38: mol_type = genomic DNA
aaacaaacaaacaaacaaacaaacgacaacaaaaaaaa

SEQ ID NO: 15370 - DNA, 30 bp, Homo sapiens
  misc_feature 1..30: note = chr10:49929928-49929958
  misc_feature 1..30: note = hypo
  source 1..30: mol_type = genomic DNA
tagagtcagcctgaacgacattccctgtag

SEQ ID NO: 15371 - DNA, 192 bp, Homo sapiens
  misc_feature 1..192: note = chr10:50507515-50507707
  misc_feature 1..192: note = hypo
  source 1..192: mol_type = genomic DNA
tgtctggctccttagcgtgggcagggaggctcaagttcatggcgggagggatgttcccgctgggccgatgctgtgctggggaagtagttcggtgccagggtgctgtgcagggtggtatgtgtgtgccgggagcccattggtgttggggctaaggttcttggtgtgctggatgggcctcggggaccacgtacc

SEQ ID NO: 15372 - DNA, 21 bp, Homo sapiens
  misc_feature 1..21: note = chr10:50748373-50748394
  misc_feature 1..21: note = hypo
  source 1..21: mol_type = genomic DNA
cacgcccggcttgtaacttgc

SEQ ID NO: 15373 - DNA, 80 bp, Homo sapiens
  misc_feature 1..80: note = chr10:70288112-70288192
  misc_feature 1..80: note = hypo
  source 1..80: mol_type = genomic DNA
agctctctcctgtctcgtcccttgacctatattgaccactgaccagtaatcgcctatcgcgctttttttttttttttttt

SEQ ID NO: 15374 - DNA, 96 bp, Homo sapiens
  misc_feature 1..96: note = chr10:70476540-70476636
  misc_feature 1..96: note = hypo
  source 1..96: mol_type = genomic DNA
gtgcctggccaagactagaacttgataatcacgaggatgttctatagttttccattgaaactatattgtctctaaaatcaccgttatttttattaa

SEQ ID NO: 15375 - DNA, 18 bp, Homo sapiens
  misc_feature 1..18: note = chr10:70483311-70483329
  misc_feature 1..18: note = hypo
  source 1..18: mol_type = genomic DNA
taaaagtaaatgggccgg

SEQ ID NO: 15376 - DNA, 30 bp, Homo sapiens
  misc_feature 1..30: note = chr10:73466313-73466343
  misc_feature 1..30: note = hypo
  source 1..30: mol_type = genomic DNA
gttgtcatgattgtccgtgttgccatggtc

SEQ ID NO: 15377 - DNA, 30 bp, Homo sapiens
  misc_feature 1..30: note = chr10:77022299-77022329
  misc_feature 1..30: note = hypo
  source 1..30: mol_type = genomic DNA
tctgtttattttctgcggccatgaaattaa

SEQ ID NO: 15378 - DNA, 30 bp, Homo sapiens
  misc_feature 1..30: note = chr10:89605951-89605981
  misc_feature 1..30: note = hypo
  source 1..30: mol_type = genomic DNA
aacgtcattatgtcacgcaagactagataa

SEQ ID NO: 15379 - DNA, 21 bp, Homo sapiens
  misc_feature 1..21: note = chr10:94603316-94603337
  misc_feature 1..21: note = hypo
  source 1..21: mol_type = genomic DNA
atgcatttggccgggcgcggt

SEQ ID NO: 15380 - DNA, 120 bp, Homo sapiens
  misc_feature 1..120: note = chr10:96304080-96304200
  misc_feature 1..120: note = hypo
  source 1..120: mol_type = genomic DNA
cagtctagataacatggcgaaaaaccgtctctaccaaaaaacaaaaacacacaaaaaccccaaaccaacaaaaattagcctggaatgggctaatgtccgacactaaaatgtccgggcgtg

SEQ ID NO: 15381 - DNA, 226 bp, Homo sapiens; identical to SEQ ID NO: 1587
  misc_feature 1..226: note = chr10:98129781-98130007
  misc_feature 1..226: note = hypo
  source 1..226: mol_type = genomic DNA

SEQ ID NO: 15382 - DNA, 22 bp, Homo sapiens
  misc_feature 1..22: note = chr10:98528164-98528186
  misc_feature 1..22: note = hypo
  source 1..22: mol_type = genomic DNA
cagaccacggactgatacaggt

SEQ ID NO: 15383 - DNA, 16 bp, Homo sapiens
  misc_feature 1..16: note = chr10:101493058-101493074
  misc_feature 1..16: note = hypo
  source 1..16: mol_type = genomic DNA
ccgtctcaaaaaaata

SEQ ID NO: 15384 - DNA, 55 bp, Homo sapiens
  misc_feature 1..55: note = chr10:104823193-104823248
  misc_feature 1..55: note = hypo
  source 1..55: mol_type = genomic DNA
cgcatggggaagtcccgccttgagccgcatgcactgatcccgggttggcactgtt

SEQ ID NO: 15385 - DNA, 44 bp, Homo sapiens; identical to SEQ ID NO: 5107
  misc_feature 1..44: note = chr10:105155356-105155400
  misc_feature 1..44: note = hypo
  source 1..44: mol_type = genomic DNA

SEQ ID NO: 15386 - DNA, 21 bp, Homo sapiens
  misc_feature 1..21: note = chr10:108522437-108522458
  misc_feature 1..21: note = hypo
  source 1..21: mol_type = genomic DNA
agccaccgtgcccagcctatt

SEQ ID NO: 15387 - DNA, 83 bp, Homo sapiens
  misc_feature 1..83: note = chr10:113623006-113623089
  misc_feature 1..83: note = hypo
  source 1..83: mol_type = genomic DNA
aataaactcaatcagcgtctctcggggtgagctcagttctagaccggtggtcctcaccactgctggaaagttctttaaaacta

SEQ ID NO: 15388 - DNA, 34 bp, Homo sapiens
  misc_feature 1..34: note = chr10:115844821-115844855
  misc_feature 1..34: note = hypo
  source 1..34: mol_type = genomic DNA
gtgggaacatgcaggcggacgctgcagcagcttt

SEQ ID NO: 15389 - DNA, 30 bp, Homo sapiens
  misc_feature 1..30: note = chr10:116331147-116331177
  misc_feature 1..30: note = hypo
  source 1..30: mol_type = genomic DNA
ccgggtggaaacgggcgcctggaggcagaa

SEQ ID NO: 15390 - DNA, 30 bp, Homo sapiens
  misc_feature 1..30: note = chr10:120791248-120791278
  misc_feature 1..30: note = hypo
  source 1..30: mol_type = genomic DNA
attcgtgtattaactcgtattcaagaaggt

SEQ ID NO: 15391 - DNA, 17 bp, Homo sapiens
  misc_feature 1..17: note = chr10:121354427-121354444
  misc_feature 1..17: note = hypo
  source 1..17: mol_type = genomic DNA
cccggcctgaaggacaa

SEQ ID NO: 15392 - DNA, 30 bp, Homo sapiens
  misc_feature 1..30: note = chr10:121651072-121651102
  misc_feature 1..30: note = hypo
  source 1..30: mol_type = genomic DNA
aaggagacagggtctcgctgcacagtgagt

SEQ ID NO: 15393 - DNA, 120 bp, Homo sapiens
  misc_feature 1..120: note = chr10:122492432-122492552
  misc_feature 1..120: note = hypo
  source 1..120: mol_type = genomic DNA
agtaggcagaagaaagtggaaggagagagatttgccgtgtcttctgcccttcatctttcctccatgttggatactcttaagttcttcagcttttggattcttggacttacaccagtgatt

SEQ ID NO: 15394 - DNA, 20 bp, Homo sapiens
  misc_feature 1..20: note = chr10:123688618-123688638
  misc_feature 1..20: note = hypo
  source 1..20: mol_type = genomic DNA
agcactttgggaggccgagg

SEQ ID NO: 15395 - DNA, 149 bp, Homo sapiens
  misc_feature 1..149: note = chr10:126198986-126199135
  misc_feature 1..149: note = hypo
  source 1..149: mol_type = genomic DNA
agcctccgcctccctcgccgacagcttcccggggctctgcctggaggcagcctcgctttatcccgcagaacctccacgctgttcctgcatgagaactcttcctccaagagaccacgttcctctggtcctgtctccgtgggccacatcca

SEQ ID NO: 15396 - DNA, 23 bp, Homo sapiens
  misc_feature 1..23: note = chr10:126479341-126479364
  misc_feature 1..23: note = hypo
  source 1..23: mol_type = genomic DNA
cttctttttttgagacggagtca

SEQ ID NO: 15397 - DNA, 44 bp, Homo sapiens
  misc_feature 1..44: note = chr10:126809890-126809934
  misc_feature 1..44: note = hypo
  source 1..44: mol_type = genomic DNA
aatgctttactcacacggcttggtgaattcgagaatccacagtc

SEQ ID NO: 15398 - DNA, 39 bp, Homo sapiens
  misc_feature 1..39: note = chr10:127463306-127463345
  misc_feature 1..39: note = hypo
  source 1..39: mol_type = genomic DNA
cgcgggggaggaagacgctccccccggccttgcggggca

SEQ ID NO: 15399 - DNA, 84 bp, Homo sapiens
  misc_feature 1..84: note = chr10:130203435-130203519
  misc_feature 1..84: note = hypo
  source 1..84: mol_type = genomic DNA
aggctgaagtgggaccggacagcactggcacggcttgactttggcaatggacaacagggaaaatggaggcgcaggtgagaaagg

SEQ ID NO: 15400 - DNA, 38 bp, Homo sapiens
  misc_feature 1..38: note = chr10:131641111-131641149
  misc_feature 1..38: note = hypo
  source 1..38: mol_type = genomic DNA
cagcggcaccaacaccgtccacccgccactgcacactg

SEQ ID NO: 15401 - DNA, 190 bp, Homo sapiens
  misc_feature 1..190: note = chr10:131647747-131647937
  misc_feature 1..190: note = hypo
  source 1..190: mol_type = genomic DNA
caggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcacgtacactcaataatgcgcccgaaagttgaggacc

SEQ ID NO: 15402 - DNA, 131 bp, Homo sapiens
  misc_feature 1..131: note = chr10:131844101-131844232
  misc_feature 1..131: note = hypo
  source 1..131: mol_type = genomic DNA
gaagtctgatggctccggtcgtggctgttgtggggaatccgtcgtgtggagaacgtgcctgccacgtgcgggggagaaaggagccaccttccgagtacgcgacctcacctgccgggcgtgaggtgctggac

SEQ ID NO: 15403 - DNA, 65 bp, Homo sapiens
  misc_feature 1..65: note = chr10:131844627-131844692
  misc_feature 1..65: note = hypo
  source 1..65: mol_type = genomic DNA
gacctgctccagaagcgccagttgcgggaccccacacggaaggcagtcttcggtggttctcactg

SEQ ID NO: 15404 - DNA, 172 bp, Homo sapiens
  misc_feature 1..172: note = chr10:131845044-131845216
  misc_feature 1..172: note = hypo
  source 1..172: mol_type = genomic DNA
gaggttcatttaatccgtgcgtctatgcagcgcctaggcctaactctcccaggaggcgccagtcacgttccccagggggagctccctgacctttctgggggtgacagagtggggaagtgggcagtgtgagcccacccctgaggcgtgtgtgtgtaagcgtgcacacttgctt

SEQ ID NO: 15405 - DNA, 29 bp, Homo sapiens
  misc_feature 1..29: note = chr10:131936597-131936626
  misc_feature 1..29: note = hypo
  source 1..29: mol_type = genomic DNA
caggcttgagcccccgtgacctgccctgt

SEQ ID NO: 15406 - DNA, 30 bp, Homo sapiens
  misc_feature 1..30: note = chr10:132001388-132001418
  misc_feature 1..30: note = hypo
  source 1..30: mol_type = genomic DNA
acagcacacacagcacggtgcccacacagc

SEQ ID NO: 15407 - DNA, 132 bp, Homo sapiens
  misc_feature 1..132: note = chr10:132365736-132365868
  misc_feature 1..132: note = hypo
  source 1..132: mol_type = genomic DNA
gcaaagcagaaatggcgtgacagccacatgtgcggggccggggaagtggaggctggctgctcctcacgggcactcgggtgaggctctctccacctcgcgcaggggctacccgctcgccgtgctgagcccttc

SEQ ID NO: 15408 - DNA, 119 bp, Homo sapiens
  misc_feature 1..119: note = chr10:132976493-132976612
  misc_feature 1..119: note = hypo
  source 1..119: mol_type = genomic DNA
acaagacagtgacagcggtgaccctgccaggtgcttggaggggacttccctggaaacaaggaagccgactagcgcggggccctggacgtacttttgaaacaagacgaggcaggtttgta

SEQ ID NO: 15409 - DNA, 141 bp, Homo sapiens
  misc_feature 1..141: note = chr10:133913916-133914057
  misc_feature 1..141: note = hypo
  source 1..141: mol_type = genomic DNA
gggtctctctccagtcgccccgtctgcctcccaggagggtgtcaggaaggccacgagaagacgtattgaccagaacagcctcacacacccttgagactggatgattctctgcaccctggttccttacgagggttggggggt

SEQ ID NO: 15410 - DNA, 57 bp, Homo sapiens
  misc_feature 1..57: note = chr10:133949378-133949435
  misc_feature 1..57: note = hypo
  source 1..57: mol_type = genomic DNA
gacctgctggttctccgtcacttaaagaacaatcacatagtgcgttgtctttcagtt

SEQ ID NO: 15411 - DNA, 421 bp, Homo sapiens; identical to SEQ ID NO: 1589
  misc_feature 1..421: note = chr10:133951502-133951923
  misc_feature 1..421: note = hypo
  source 1..421: mol_type = genomic DNA

SEQ ID NO: 15412 - DNA, 119 bp, Homo sapiens
  misc_feature 1..119: note = chr10:133962676-133962795
  misc_feature 1..119: note = hypo
  source 1..119: mol_type = genomic DNA
gtgatgaactctgcccggcacatctggggtcagcgaatatacaggggcagtccttgtgggcaggtccaggtccagtgcagattctgccaccactgctgccgctgcggtttggttttcat

SEQ ID NO: 15413 - DNA, 46 bp, Homo sapiens
  misc_feature 1..46: note = chr10:133984135-133984181
  misc_feature 1..46: note = hypo
  source 1..46: mol_type = genomic DNA
ttctcctgctcccagcgtgtgtccatgggggcggtcagggtagaca

SEQ ID NO: 15414 - DNA, 112 bp, Homo sapiens
  misc_feature 1..112: note = chr10:134012352-134012464
  misc_feature 1..112: note = hypo
  source 1..112: mol_type = genomic DNA
aggtggaggctgaggcggtgtaccgagctgtcaccatcgccaagcaggcaaactgcccgctgtacgtcaccaaggtgatgagcaagggggcggccgacgccatcgctcaggc

SEQ ID NO: 15415 - DNA, 30 bp, Homo sapiens
  misc_feature 1..30: note = chr10:134014429-134014459
  misc_feature 1..30: note = hypo
  source 1..30: mol_type = genomic DNA
ccccgagggcaccaacggcattgaggagcg

SEQ ID NO: 15416 - DNA, 51 bp, Homo sapiens
  misc_feature 1..51: note = chr10:134016358-134016409
  misc_feature 1..51: note = hypo
  source 1..51: mol_type = genomic DNA
aggtaggcaggtgggcgctgagttctaggcccagaacgcacccctggtcaa

SEQ ID NO: 15417 - DNA, 67 bp, Homo sapiens
  misc_feature 1..67: note = chr10:134022845-134022912
  misc_feature 1..67: note = hypo
  source 1..67: mol_type = genomic DNA
ggcttggacttgctccgtggggcctgcaggaccaggcagaagctgttctctgcgggactttgctgga

SEQ ID NO: 15418 - DNA, 47 bp, Homo sapiens
  misc_feature 1..47: note = chr10:134093662-134093709
  misc_feature 1..47: note = hypo
  source 1..47: mol_type = genomic DNA
cacgcccctgcactccgtgaccacgccacctgcgctccatgaccatg

SEQ ID NO: 15419 - DNA, 212 bp, Homo sapiens; identical to SEQ ID NO: 1590
  misc_feature 1..212: note = chr10:134095580-134095792
  misc_feature 1..212: note = hypo
  source 1..212: mol_type = genomic DNA

SEQ ID NO: 15420 - DNA, 241 bp, Homo sapiens
  misc_feature 1..241: note = chr10:134301075-134301316
  misc_feature 1..241: note = hypo
  source 1..241: mol_type = genomic DNA
cttgggaagctgtgccgcaagcgggaatgagtggacggggctgctcacgcggctgcttttccgtcacggatgccccacccggtcctgtgcgggaggccctgttgaggtgagctccgccctgccgagtgtagggactttgcctccacctccagggttccacatccttccagtaggacacaggcagacatcgccttgggaggctgaatttgctcaaacggcaaacacacgatgagagcctggg

SEQ ID NO: 15421 - DNA, 180 bp, Homo sapiens
  misc_feature 1..180: note = chr10:134481125-134481305
  misc_feature 1..180: note = hypo
  source 1..180: mol_type = genomic DNA
taatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaa

SEQ ID NO: 15422 - DNA, 274 bp, Homo sapiens; identical to SEQ ID NO: 5111
  misc_feature 1..274: note = chr10:134607922-134608196
  misc_feature 1..274: note = hypo
  source 1..274: mol_type = genomic DNA

SEQ ID NO: 15423 - DNA, 38 bp, Homo sapiens
  misc_feature 1..38: note = chr10:134610885-134610923
  misc_feature 1..38: note = hypo
  source 1..38: mol_type = genomic DNA
ggggtgcttccaaaccggtgcctcgtgaggaattggga

SEQ ID NO: 15424 - DNA, 121 bp, Homo sapiens
  misc_feature 1..121: note = chr10:134665081-134665202
  misc_feature 1..121: note = hypo
  source 1..121: mol_type = genomic DNA
ggcattttccagaaccgtacctaagtggaggcgcacagagtgctgtctttccgtctggttcattttcctcggtaaagtcaccgtgagactcccccacgcggctgcacgcatgctccttccc

SEQ ID NO: 15425 - DNA, 30 bp, Homo sapiens
  misc_feature 1..30: note = chr10:134671588-134671618
  misc_feature 1..30: note = hypo
  source 1..30: mol_type = genomic DNA
tgcaaggacaatgtacgacatccacagtaa

SEQ ID NO: 15426 - DNA, 77 bp, Homo sapiens
  misc_feature 1..77: note = chr10:134682737-134682814
  misc_feature 1..77: note = hypo
  source 1..77: mol_type = genomic DNA
gactcaaaccccaggcggcgcagggtgggacggcacacacctggcctgctccagctcgctgacgcacacctgcccga

SEQ ID NO: 15427 - DNA, 21 bp, Homo sapiens
  misc_feature 1..21: note = chr10:134683679-134683700
  misc_feature 1..21: note = hypo
  source 1..21: mol_type = genomic DNA
atgagacggtgaactgagtcg

SEQ ID NO: 15428 - DNA, 38 bp, Homo sapiens
  misc_feature 1..38: note = chr10:134690510-134690548
  misc_feature 1..38: note = hypo
  source 1..38: mol_type = genomic DNA
aacagcagacacccccggcccaccggcatggctgtgca

SEQ ID NO: 15429 - DNA, 181 bp, Homo sapiens
  misc_feature 1..181: note = chr10:134699728-134699909
  misc_feature 1..181: note = hypo
  source 1..181: mol_type = genomic DNA
ccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtcctcatgcttggtgcccgcagcacgggaacaatccccg

SEQ ID NO: 15430 - DNA, 74 bp, Homo sapiens
  misc_feature 1..74: note = chr10:134731905-134731979
  misc_feature 1..74: note = hypo
  source 1..74: mol_type = genomic DNA
gatgaaccccacctccgcgaacttccgcagcaggtcggggcacacctgcctctgcaggacgacctcaggctggc

SEQ ID NO: 15431 - DNA, 41 bp, Homo sapiens
  misc_feature 1..41: note = chr10:134732884-134732925
  misc_feature 1..41: note = hypo
  source 1..41: mol_type = genomic DNA
gacagacgtcccacacgccttgtttccgggccactttggcc

SEQ ID NO: 15432 - DNA, 471 bp, Homo sapiens; identical to SEQ ID NO: 5112
  misc_feature 1..471: note = chr10:134733221-134733692
  misc_feature 1..471: note = hypo
  source 1..471: mol_type = genomic DNA

SEQ ID NO: 15433 - DNA, 30 bp, Homo sapiens
  misc_feature 1..30: note = chr10:134734085-134734115
  misc_feature 1..30: note = hypo
  source 1..30: mol_type = genomic DNA
gatgttccgaatcaccgctccttttcctgg

SEQ ID NO: 15434 - DNA, 372 bp, Homo sapiens
  misc_feature 1..372: note = chr10:134738296-134738668
  misc_feature 1..372: note = hypo
  source 1..372: mol_type = genomic DNA
gcgtggcgcacaccacgtggatgacccgggggtcgcccaggcgcacggctcgctgcagcgcgacgtctagcctctgtatgatatccagctgggcctgcggagaagacgtgggggattctagggaggttgctggctcgagctgcggggctggggcggcacctgcgtgcagggcacactgagaacgcaggccctaaattcatcaccctgcgtggcgtcatgctcaaatctgtccgtgaaaatggccagagtgactctttctaggaggaagtggacgtctcacaagatattacatgcaggaggcttggcggtgcccacacatcgtggctgcgcccgcctcccccgtgtggactcagcgggcgctgctcccttcct

SEQ ID NO: 15435 - DNA, 30 bp, Homo sapiens
  misc_feature 1..30: note = chr10:134788083-134788113
  misc_feature 1..30: note = hypo
  source 1..30: mol_type = genomic DNA
gggagaggtggatgccgcccgcacctgcct

SEQ ID NO: 15436 - DNA, 224 bp, Homo sapiens
  misc_feature 1..224: note = chr10:134834692-134834916
  misc_feature 1..224: note = hypo
  source 1..224: mol_type = genomic DNA
tcccgtcagcccctccgcggtcccggccccagccctgggttgagggagggctggggaggagcagggacagacgggcaggcaccaggacgctggctgctgcgtgaatgtcacctgtggtcacggccgacgcccggcgggcctgggcatggagtcaggaccggaaagcgaggccggcagcagcaccagctcctcagcaaggcccccgctgccgactgggcacgggc

SEQ ID NO: 15437 - DNA, 30 bp, Homo sapiens
  misc_feature 1..30: note = chr10:134855649-134855679
  misc_feature 1..30: note = hypo
  source 1..30: mol_type = genomic DNA
ggtccgggatgggtccgggaaggcagggtc

SEQ ID NO: 15438 - DNA, 37 bp, Homo sapiens
  misc_feature 1..37: note = chr10:134875820-134875857
  misc_feature 1..37: note = hypo
  source 1..37: mol_type = genomic DNA
caacacgttaagtaacgtgtcacgtgcctgctggcca

SEQ ID NO: 15439 - DNA, 49 bp, Homo sapiens
  misc_feature 1..49: note = chr10:134895296-134895345
  misc_feature 1..49: note = hypo
  source 1..49: mol_type = genomic DNA
tccacccacagaagccgtgttctgattatcaacacgccctctggcagga

SEQ ID NO: 15440 - DNA, 39 bp, Homo sapiens
  misc_feature 1..39: note = chr10:134898411-134898450
  misc_feature 1..39: note = hypo
  source 1..39: mol_type = genomic DNA
tgggtccctcatggccgcgtgagccgcttcctcactgta

SEQ ID NO: 15441 - DNA, 149 bp, Homo sapiens
  misc_feature 1..149: note = chr10:134913803-134913952
  misc_feature 1..149: note = hypo
  source 1..149: mol_type = genomic DNA
caagtgcccgggaaacgccattgacgtcccgcctgtaagtgcctgcgagaggccgtcaccatcacgtctgcactttgccaccaagtacgccccacactgggatgaagcctgctggatccgcgggtgaggccccccgagggccttcagca

SEQ ID NO: 15442 - DNA, 324 bp, Homo sapiens
  misc_feature 1..324: note = chr10:134940950-134941274
  misc_feature 1..324: note = hypo
  source 1..324: mol_type = genomic DNA
ggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaaccccatcgagtaggaacggcggtccagccatcagtgcccagagccagcctggaacctctcattcagggccctcagttccttctgcggccccaggatggcccgcccgtctgccctccgccttgccccgccc

SEQ ID NO: 15443 - DNA, 30 bp, Homo sapiens
  misc_feature 1..30: note = chr10:134941647-134941677
  misc_feature 1..30: note = hypo
  source 1..30: mol_type = genomic DNA
agggccaatagggcccggttcccatccaca

SEQ ID NO: 15444 - DNA, 594 bp, Homo sapiens; identical to SEQ ID NO: 5113
  misc_feature 1..594: note = chr10:134942531-134943125
  misc_feature 1..594: note = hypo
  source 1..594: mol_type = genomic DNA

SEQ ID NO: 15445 - DNA, 510 bp, Homo sapiens
  misc_feature 1..510: note = chr10:134996387-134996897
  misc_feature 1..510: note = hypo
  source 1..510: mol_type = genomic DNA
caagggcatgggtggcgtgggtgcgagcaatgtgggcacggacggtgtgggcacaggcggtgtgggcacaggcggtgtgggcacaggcggtgtgggcacaggcggcgtgggcacaggcggcaagggcatgggtggcatgggtgcgagcagcatgggcggcgtgggtacaagtgaggagggtgtgggcggcgtgggcacgggcagtgtggacgtgggtggcggcaggggcggcaaaagtgtgggcggtatgggtgtgagcagcgtgggcgcgggcggcgagggtgccagcggcgtgggcgcgggcggcaagggtgtgggcagcgtgggcacgggtgctgcttcccctcaggggaatctcacgattcctgaaacttgagctcctggcccggagaagtgctggccgcggtcggggtggcgcacacgcagagactctggagctgacagcctgtcgtgcccacaggcgcacatctactctctgggggccacgctgaaggccgccctcgagtacgt

SEQ ID NO: 15446 - DNA, 173 bp, Homo sapiens
  misc_feature 1..173: note = chr10:135002007-135002180
  misc_feature 1..173: note = hypo
  source 1..173: mol_type = genomic DNA
tgtccacactgacctcgccgctctcctgcccacagtgggtgtccctgcaggacctcctgtcccagctgggccggcccttccgggagtacgagctgtgggccctgtgcctggcctgcctccgcgcactgcagacacgccctgagcacccaggtgacgcacgcaccatcccatcc

SEQ ID NO: 15447 - DNA, 205 bp, Homo sapiens
  misc_feature 1..205: note = chr10:135011834-135012039
  misc_feature 1..205: note = hypo
  source 1..205: mol_type = genomic DNA
ccccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccaggtgagcatcgtccccacaccccggagctgctgggtc

SEQ ID NO: 15448 - DNA, 195 bp, Homo sapiens
  misc_feature 1..195: note = chr10:135015152-135015347
  misc_feature 1..195: note = hypo
  source 1..195: mol_type = genomic DNA
gcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgt

SEQ ID NO: 15449 - DNA, 32 bp, Homo sapiens
  misc_feature 1..32: note = chr10:135017129-135017161
  misc_feature 1..32: note = hypo
  source 1..32: mol_type = genomic DNA
tgtggagctggcatccgcgtctcctgctgtta

SEQ ID NO: 15450 - DNA, 30 bp, Homo sapiens
  misc_feature 1..30: note = chr10:135017385-135017415
  misc_feature 1..30: note = hypo
  source 1..30: mol_type = genomic DNA
actgtgaacggaggccgtggaggtgccggc

SEQ ID NO: 15451 - DNA, 106 bp, Homo sapiens
  misc_feature 1..106: note = chr10:135020767-135020873
  misc_feature 1..106: note = hypo
  source 1..106: mol_type = genomic DNA
acgtcaacaagcacccgggcggccggcagaaggcccgcatcctgcaggccggcacgccgctggggctcatggcctacctgtactccaggtgcgttgggagaaaagc

SEQ ID NO: 15452 - DNA, 30 bp, Homo sapiens
  misc_feature 1..30: note = chr10:135023111-135023141
  misc_feature 1..30: note = hypo
  source 1..30: mol_type = genomic DNA
ttgtggcttgcatggcgtgagtgtgagtgc

SEQ ID NO: 15453 - DNA, 66 bp, Homo sapiens
  misc_feature 1..66: note = chr10:135023434-135023500
  misc_feature 1..66: note = hypo
  source 1..66: mol_type = genomic DNA
gtctcctgagggtggcgcggtttcacccagtgaagacccagaacctttgagcgtgcagcattgcgc

SEQ ID NO: 15454 - DNA, 30 bp, Homo sapiens
  misc_feature 1..30: note = chr10:135035009-135035039
  misc_feature 1..30: note = hypo
  source 1..30: mol_type = genomic DNA
aatctcccaccctcccgtctcatctcatcg

SEQ ID NO: 15455 - DNA, 49 bp, Homo sapiens
  misc_feature 1..49: note = chr10:135069848-135069897
  misc_feature 1..49: note = hypo
  source 1..49: mol_type = genomic DNA
ttttgccaccaaaggcgatcactgtggatcatgccggttcctgcacacc

SEQ ID NO: 15456 - DNA, 167 bp, Homo sapiens
  misc_feature 1..167: note = chr11:394801-394968
  misc_feature 1..167: note = hypo
  source 1..167: mol_type = genomic DNA
ttggcacatggcaggcgggccaggccactcggtcggcaaacccggaacacgcacgcgcctggccccggtagcacagactcacatagggtctcagggacacccagacacccacgctcctcccatacctcacgggaatgagcagaacgggaaagcggggagaggtgtgg

SEQ ID NO: 15457 - DNA, 139 bp, Homo sapiens
  misc_feature 1..139: note = chr11:445925-446064
  misc_feature 1..139: note = hypo
  source 1..139: mol_type = genomic DNA
cacttcagaagaccccgtccaccagaccgcctccccctgaggcccaacatgcagcagaggcagctcctccgtccctgcagcctccttttaactgtgggatatggcagccacccgtggagcggtccgggtgacaaagcca

SEQ ID NO: 15458 - DNA, 18 bp, Homo sapiens
  misc_feature 1..18: note = chr11:447613-447631
  misc_feature 1..18: note = hypo
  source 1..18: mol_type = genomic DNA
gcccggccttctctgcca

SEQ ID NO: 15459 - DNA, 78 bp, Homo sapiens
  misc_feature 1..78: note = chr11:449595-449673
  misc_feature 1..78: note = hypo
  source 1..78: mol_type = genomic DNA
taaaatcagcgtgtccgcaccattttcgcccgcccaatttcacgcgatcctgcgaaagaatgacccagaccggtccgg

SEQ ID NO: 15460 - DNA, 470 bp, Homo sapiens
  misc_feature 1..470: note = chr11:562246-562716
  misc_feature 1..470: note = hypo
  source 1..470: mol_type = genomic DNA
acagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggag

SEQ ID NO: 15461 - DNA, 30 bp, Homo sapiens
  misc_feature 1..30: note = chr11:762939-762969
  misc_feature 1..30: note = hypo
  source 1..30: mol_type = genomic DNA
tctgggatgaggtgacggcctggcgcaaga

SEQ ID NO: 15462 - DNA, 58 bp, Homo sapiens
  misc_feature 1..58: note = chr11:763318-763376
  misc_feature 1..58: note = hypo
  source 1..58: mol_type = genomic DNA
gccctcacctgtccccgccccgcagggagctcgaggagcagcacggcatccactgcaa

SEQ ID NO: 15463 - DNA, 30 bp, Homo sapiens
  misc_feature 1..30: note = chr11:763637-763667
  misc_feature 1..30: note = hypo
  source 1..30: mol_type = genomic DNA
ggcaggcaggggtggcggctcaaggtagtg

SEQ ID NO: 15464 - DNA, 268 bp, Homo sapiens
  misc_feature 1..268: note = chr11:850555-850823
  misc_feature 1..268: note = hypo
  source 1..268: mol_type = genomic DNA
caccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcag

SEQ ID NO: 15465 - DNA, 80 bp, Homo sapiens
  misc_feature 1..80: note = chr11:859292-859372
  misc_feature 1..80: note = hypo
  source 1..80: mol_type = genomic DNA
gcaccccggctcacacgcaccccccctttcacacgcaccccgggctcacacgcaccccgggctcacacgcaccccccctt

SEQ ID NO: 15466 - DNA, 180 bp, Homo sapiens
  misc_feature 1..180: note = chr11:862671-862851
  misc_feature 1..180: note = hypo
  source 1..180: mol_type = genomic DNA
ctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctc

SEQ ID NO: 15467 - DNA, 68 bp, Homo sapiens
  misc_feature 1..68: note = chr11:864749-864817
  misc_feature 1..68: note = hypo
  source 1..68: mol_type = genomic DNA
ccccaggttgtcccccgccctctgacgcagcgtcctgagccgtctgctcccagcgccccatccgggcc

SEQ ID NO: 15468 - DNA, 123 bp, Homo sapiens
  misc_feature 1..123: note = chr11:865692-865815
  misc_feature 1..123: note = hypo
  source 1..123: mol_type = genomic DNA
gttccgctgctgtggcgtctccaactacactgactggttcgaggtgtacaacgccacgcgggtacctgactcctgctgcttggagttcagtgagagctgtgggctgcacgcccccggcacctg

SEQ ID NO: 15469 - DNA, 30 bp, Homo sapiens
  misc_feature 1..30: note = chr11:866956-866986
  misc_feature 1..30: note = hypo
  source 1..30: mol_type = genomic DNA
tggaaaacaggttggcgctggaggagccgg

SEQ ID NO: 15470 - DNA, 30 bp, Homo sapiens
  misc_feature 1..30: note = chr11:875487-875517
  misc_feature 1..30: note = hypo
  source 1..30: mol_type = genomic DNA
agacactgagggccccgggtgtggagaaga

SEQ ID NO: 15471 - DNA, 61 bp, Homo sapiens
  misc_feature 1..61: note = chr11:985399-985460
  misc_feature 1..61: note = hypo
  source 1..61: mol_type = genomic DNA
gagactggtgagcaccgttctgtcttgcccagaagaccctgcagtgcgaggccgcctgact

SEQ ID NO: 15472 - DNA, 30 bp, Homo sapiens
  misc_feature 1..30: note = chr11:986983-987013
  misc_feature 1..30: note = hypo
  source 1..30: mol_type = genomic DNA
tccctgagcaggtgccgtgggtcttcctgt

SEQ ID NO: 15473 - DNA, 231 bp, Homo sapiens
  misc_feature 1..231: note = chr11:1029190-1029421
  misc_feature 1..231: note = hypo
  source 1..231: mol_type = genomic DNA
gagcgcccctccccacgggccacagggctcgtcctacctggaggaggatgtaggtgcaggtgccgtggaagcggtagggcctggcgtcaaatgtggtaacaaaggagccaccttccagggagcagtgtccggggcacggccgctccgtgcacacccagcggcccagggtgcaccggctgtgggtgggcgtgggggtagcggcatggtgggcagggccgctggagccagaca

SEQ ID NO: 15474 - DNA, 112 bp, Homo sapiens
  misc_feature 1..112: note = chr11:1030184-1030296
  misc_feature 1..112: note = hypo
  source 1..112: mol_type = genomic DNA
gagagagagtgcctgcgactgccctcaccttccgggcagaagcacccgaaggtgcaggagctggagcagctgtgctgcgggttggagcaggtcttcacgcaggccgagccgc

SEQ ID NO: 15475 - DNA, 59 bp, Homo sapiens
  misc_feature 1..59: note = chr11:1075796-1075855
  misc_feature 1..59: note = hypo
  source 1..59: mol_type = genomic DNA
gctgtgcacctgaagcggggtccgggccaggctgaggcccccgccggggtggagtccat

SEQ ID NO: 15476 - DNA, 35 bp, Homo sapiens
  misc_feature 1..35: note = chr11:1077652-1077687
  misc_feature 1..35: note = hypo
  source 1..35: mol_type = genomic DNA
accaaagtctactcccgcgccggcctcaccctcat

SEQ ID NO: 15477 - DNA, 57 bp, Homo sapiens
  misc_feature 1..57: note = chr11:1095083-1095140
  misc_feature 1..57: note = hypo
  source 1..57: mol_type = genomic DNA
agccctgcctctggacggtgtgatcgtgggtctgtctcccttcgcaggtgaggaggt

SEQ ID NO: 15478 - DNA, 30 bp, Homo sapiens
  misc_feature 1..30: note = chr11:1104124-1104154
  misc_feature 1..30: note = hypo
  source 1..30: mol_type = genomic DNA
gagctgccccaatggcggctcgctgacaca

SEQ ID NO: 15479 - DNA, 30 bp, Homo sapiens
  misc_feature 1..30: note = chr11:1142462-1142492
  misc_feature 1..30: note = hypo
  source 1..30: mol_type = genomic DNA
ctactgctgccatgtcgctgcagttcaatg

SEQ ID NO: 15480 - DNA, 30 bp, Homo sapiens
  misc_feature 1..30: note = chr11:1151771-1151801
  misc_feature 1..30: note = hypo
  source 1..30: mol_type = genomic DNA
ctttgccctgggttccgggcaggctgcatg

SEQ ID NO: 15481 - DNA, 169 bp, Homo sapiens
  misc_feature 1..169: note = chr11:1214764-1214933
  misc_feature 1..169: note = hypo
  source 1..169: mol_type = genomic DNA
aacgtcatctccctgcgcccgcgcacgtgcccgagggtggagaagcccacttgtgccaacggctacccggctgtgaaggtggctgaccaagatggctgctgccatcactaccagtgccagtgtgagtggagcgccgagcgggacccagggcagccggggcagccactcc

SEQ ID NO: 15482 - DNA, 123 bp, Homo sapiens
  misc_feature 1..123: note = chr11:1215867-1215990
  misc_feature 1..123: note = hypo
  source 1..123: mol_type = genomic DNA
gtttgccaacaacaccgagggccagtgcggtgaggccacagggctcccgggcatcgtctggcattcgcgggggcgggggtgccgggcaggggcgaggccaccacgtgccgcgtgtgccggtgt

SEQ ID NO: 15483 - DNA, 177 bp, Homo sapiens
  misc_feature 1..177: note = chr11:1244354-1244531
  misc_feature 1..177: note = hypo
  source 1..177: mol_type = genomic DNA
tgggtgccccgagcgcgtgccggacgctggtgttggctctggcggccatgctcgtggtgccgcaggcaggtaagagccccccactccgccccctctcgatgctgtcttcacggcgggggtctctgcaggtcgcttgcctgggagcttctcctgcagagtgcacgggcagatccccct

SEQ ID NO: 15484 - DNA, 67 bp, Homo sapiens
  misc_feature 1..67: note = chr11:1247815-1247882
  misc_feature 1..67: note = hypo
  source 1..67: mol_type = genomic DNA
ggatgggcctcatcccgcgctccccacagccctgaacccggcgcacaatgggcgggtgtgcagcacc

SEQ ID NO: 15485 - DNA, 129 bp, Homo sapiens
  misc_feature 1..129: note = chr11:1250889-1251018
  misc_feature 1..129: note = hypo
  source 1..129: mol_type = genomic DNA
gccggccctgcctcacgccgcgccccacaggcacggtgctggatgacatcacgcactctggctgcctgcccctcgggcagtgcccctgcacccacggcggccgcacctacagcccgggcacctccttca

SEQ ID NO: 15486 - DNA, 105 bp, Homo sapiens
  misc_feature 1..105: note = chr11:1252902-1253007
  misc_feature 1..105: note = hypo
  source 1..105: mol_type = genomic DNA
gcccccagggcatggcggagatcctggtgccagcgcaggacaccagcattggaccagcggccccggaagcagccagctgggaggatggagcgggcagccctgccc

SEQ ID NO: 15487 - DNA, 279 bp, Homo sapiens
  misc_feature 1..279: note = chr11:1255015-1255294
  misc_feature 1..279: note = hypo
  source 1..279: mol_type = genomic DNA
cttgtagttcatgtacgggtgggaagctaagctgcctgggagcctctctgcagaaaagcacaggtaagtgccacccctgccctgccctgccctgccccgccccgcatcaccccgcctggcctggccccaacacgccccaccctgccccaccccacctgaaccctgccgggccaggtcagtcctcacctgggctctgccacaggcacccatgccctgacacgccagggacggaggggccagtgggtctctgccccgcagtgtggccggggtgtcctgggg

SEQ ID NO: 15488 - DNA, 30 bp, Homo sapiens
  misc_feature 1..30: note = chr11:1256469-1256499
  misc_feature 1..30: note = hypo
  source 1..30: mol_type = genomic DNA
cccactcctgcaggccgggcacactccagc

SEQ ID NO: 15489 - DNA, 106 bp, Homo sapiens
  misc_feature 1..106: note = chr11:1257713-1257819
  misc_feature 1..106: note = hypo
  source 1..106: mol_type = genomic DNA
ggtcatcgagacccacgggatggccgtgtcctgggaccggaagaccagcgtgttcatccgactgcaccaggactacaaggtgagctcgggccgtgcactcctaggc

SEQ ID NO: 15490 - DNA, 42 bp, Homo sapiens
  misc_feature 1..42: note = chr11:1263602-1263644
  misc_feature 1..42: note = hypo
  source 1..42: mol_type = genomic DNA
ggcggagaactaccccgaggtaagcatcgaccaggtcgggca

SEQ ID NO: 15491 - DNA, 30 bp, Homo sapiens
  misc_feature 1..30: note = chr11:1276708-1276738
  misc_feature 1..30: note = hypo
  source 1..30: mol_type = genomic DNA
gagcctggaggcttacgcagagctctgccg

SEQ ID NO: 15492 - DNA, 161 bp, Homo sapiens
  misc_feature 1..161: note = chr11:1382237-1382398
  misc_feature 1..161: note = hypo
  source 1..161: mol_type = genomic DNA
gggcggccacctgaacgagtgggaggagtgcagtcccaggccctcccagagactgtgccatagtctccaccccaagtgacggtggagggatgctgggaacggtaagctttaatgcttggtgaatcttgcattgcctcattcatgaccggtaggtcacgtgg

SEQ ID NO: 15493 - DNA, 76 bp, Homo sapiens
  misc_feature 1..76: note = chr11:1430992-1431068
  misc_feature 1..76: note = hypo
  source 1..76: mol_type = genomic DNA
agcttcaggaaccaccgagatggggagcctgccggagacacaggttttctgagcgcaccagcggctccaaaagcag

SEQ ID NO: 15494 - DNA, 30 bp, Homo sapiens
  misc_feature 1..30: note = chr11:1444922-1444952
  misc_feature 1..30: note = hypo
  source 1..30: mol_type = genomic DNA
gccccaggcctcccccgctgggcgttccgg

SEQ ID NO: 15495 - DNA, 30 bp, Homo sapiens
  misc_feature 1..30: note = chr11:1455198-1455228
  misc_feature 1..30: note = hypo
  source 1..30: mol_type = genomic DNA
cacagatgaaactgacggaaagggcaaaat

SEQ ID NO: 15496 - DNA, 30 bp, Homo sapiens
  misc_feature 1..30: note = chr11:1461990-1462020
  misc_feature 1..30: note = hypo
  source 1..30: mol_type = genomic DNA
gcgcactggtggccccgtctcctgcaggta

SEQ ID NO: 15497 - DNA, 257 bp, Homo sapiens; identical to SEQ ID NO: 5114
  misc_feature 1..257: note = chr11:1464204-1464461
  misc_feature 1..257: note = hypo
  source 1..257: mol_type = genomic DNA

SEQ ID NO: 15498 - DNA, 243 bp, Homo sapiens
  misc_feature 1..243: note = chr11:1464674-1464917
  misc_feature 1..243: note = hypo
  source 1..243: mol_type = genomic DNA
aaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggg

SEQ ID NO: 15499 - DNA, 127 bp, Homo sapiens
  misc_feature 1..127: note = chr11:1466979-1467106
  misc_feature 1..127: note = hypo
  source 1..127: mol_type = genomic DNA
tactcagaccctccccggaagcgtgtggactccccgatgctgaaccggcacggcaagcggcggccagaacgcaaatccatggaggtgctcagcgtgacggacggcggctccccggtgcctgcgcggc

SEQ ID NO: 15500 - DNA, 209 bp, Homo sapiens
  misc_feature 1..209: note = chr11:1469157-1469366
  misc_feature 1..209: note = hypo
  source 1..209: mol_type = genomic DNA
gggcaggcacatgggcgggtctggtggcgggctgggctgcagggctcctgctgcggtgaagccagccagcaagccaggcaagggcccgcgggccaggcagaggccgaggaggggtggggctgctgaggcgtggcccacgcctgcctgtgagggaccacgcaccatggcttacagggcctggggctagagcccggcgtggctgcaggccg

SEQ ID NO: 15501 - DNA, 178 bp, Homo sapiens
  misc_feature 1..178: note = chr11:1471880-1472058
  misc_feature 1..178: note = hypo
  source 1..178: mol_type = genomic DNA
cgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaaggtgagtgtctgcccggaggcgccagagtggggct

SEQ ID NO: 15502 - DNA, 33 bp, Homo sapiens
  misc_feature 1..33: note = chr11:1477820-1477853
  misc_feature 1..33: note = hypo
  source 1..33: mol_type = genomic DNA
cccctaggccccagccgtcgcttcaagagggtg

SEQ ID NO: 15503 - DNA, 62 bp, Homo sapiens
  misc_feature 1..62: note = chr11:1669565-1669627
  misc_feature 1..62: note = hypo
  source 1..62: mol_type = genomic DNA
tcaccggccagagggcgcagccacccggccttcccgaagcaggacagcggcctttccaagac

SEQ ID NO: 15504 - DNA, 33 bp, Homo sapiens
  misc_feature 1..33: note = chr11:1856532-1856565
  misc_feature 1..33: note = hypo
  source 1..33: mol_type = genomic DNA
ctgggctctcattgccggcgcccttgccgcggg

SEQ ID NO: 15505 - DNA, 48 bp, Homo sapiens; identical to SEQ ID NO: 5115
  misc_feature 1..48: note = chr11:1868130-1868178
  misc_feature 1..48: note = hypo
  source 1..48: mol_type = genomic DNA

SEQ ID NO: 15506 - DNA, 33 bp, Homo sapiens
  misc_feature 1..33: note = chr11:1955358-1955391
  misc_feature 1..33: note = hypo
  source 1..33: mol_type = genomic DNA
cactggctaaggccccggcgccctgcagaaccc

SEQ ID NO: 15507 - DNA, 49 bp, Homo sapiens
  misc_feature 1..49: note = chr11:1957372-1957421
  misc_feature 1..49: note = hypo
  source 1..49: mol_type = genomic DNA
aagctagcccacagccgggcctcgatgccccagccgcccatccagcctt

SEQ ID NO: 15508 - DNA, 120 bp, Homo sapiens
  misc_feature 1..120: note = chr11:1958184-1958304
  misc_feature 1..120: note = hypo
  source 1..120: mol_type = genomic DNA
gttcacagatcaccacgctcaggagccgcattgaccaggcccagaagcagtgagtagccctgccgtcctcgctccgcactgggcacaggggcccttggggccagccgctgtagccagtcc

SEQ ID NO: 15509 - DNA, 190 bp, Homo sapiens
  misc_feature 1..190: note = chr11:1959032-1959222
  misc_feature 1..190: note = hypo
  source 1..190: mol_type = genomic DNA
ctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctca

SEQ ID NO: 15510 - DNA, 41 bp, Homo sapiens
  misc_feature 1..41: note = chr11:1981275-1981316
  misc_feature 1..41: note = hypo
  source 1..41: mol_type = genomic DNA
ggggtggagggccctcgggaccgcaccgggctgtgctcata

SEQ ID NO: 15511 - DNA, 30 bp, Homo sapiens
  misc_feature 1..30: note = chr11:2037043-2037073
  misc_feature 1..30: note = hypo
  source 1..30: mol_type = genomic DNA
tgtgctgggtgtgcacgatgcccgtgggcc

SEQ ID NO: 15512 - DNA, 43 bp, Homo sapiens
  misc_feature 1..43: note = chr11:2040105-2040148
  misc_feature 1..43: note = hypo
  source 1..43: mol_type = genomic DNA
caaaggggcctgcatcgcgccaacctctcgcagctctccagcg

SEQ ID NO: 15513 - DNA, 238 bp, Homo sapiens
  misc_feature 1..238: note = chr11:2210040-2210278
  misc_feature 1..238: note = hypo
  source 1..238: mol_type = genomic DNA
tgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaa

SEQ ID NO: 15514 - DNA, 40 bp, Homo sapiens
  misc_feature 1..40: note = chr11:2278423-2278463
  misc_feature 1..40: note = hypo
  source 1..40: mol_type = genomic DNA
aggttcgacctgagccggcactgcccggctgccctggggc

SEQ ID NO: 15515 - DNA, 79 bp, Homo sapiens
  misc_feature 1..79: note = chr11:2278708-2278787
  misc_feature 1..79: note = hypo
  source 1..79: mol_type = genomic DNA
ccacgtcaggagacccgcctcaggcagcagtggcccggtggctgcttctgcctagcccgcagcacgtgccaccctgggc

SEQ ID NO: 15516 - DNA, 75 bp, Homo sapiens
  misc_feature 1..75: note = chr11:2438114-2438189
  misc_feature 1..75: note = hypo
  source 1..75: mol_type = genomic DNA
gctggaacctgactccgccttacaaaaggaatgaagcatggaatggcatacgcttcaacacggaggaaccgtcaa

SEQ ID NO: 15517 - DNA, 30 bp, Homo sapiens
  misc_feature 1..30: note = chr11:2543418-2543448
  misc_feature 1..30: note = hypo
  source 1..30: mol_type = genomic DNA
gctcatgcagctccccgccccccgcatgac

SEQ ID NO: 15518 - DNA, 76 bp, Homo sapiens
  misc_feature 1..76: note = chr11:2596517-2596593
  misc_feature 1..76: note = hypo
  source 1..76: mol_type = genomic DNA
ctgcagcccgagcctcggccatcgcgcgccctggcctggccattgttcccgccaggccccgcgcccctggtcgccc

SEQ ID NO: 15519 - DNA, 30 bp, Homo sapiens
  misc_feature 1..30: note = chr11:2818227-2818257
  misc_feature 1..30: note = hypo
  source 1..30: mol_type = genomic DNA
ggagagattttacaacgtatgggctggtgg

SEQ ID NO: 15520 - DNA, 30 bp, Homo sapiens
  misc_feature 1..30: note = chr11:2829204-2829234
  misc_feature 1..30: note = hypo
  source 1..30: mol_type = genomic DNA
aggatgagacaggaacggtctctctggggg

SEQ ID NO: 15521 - DNA, 30 bp, Homo sapiens
  misc_feature 1..30: note = chr11:3169805-3169835
  misc_feature 1..30: note = hypo
  source 1..30: mol_type = genomic DNA
gcagggcgggggcaccgtcctctgcacttt

SEQ ID NO: 15522 - DNA, 30 bp, Homo sapiens
  misc_feature 1..30: note = chr11:3828932-3828962
  misc_feature 1..30: note = hypo
  source 1..30: mol_type = genomic DNA
ttaagtggaaaagtgcgatgttaggtatgg

SEQ ID NO: 15523 - DNA, 26 bp, Homo sapiens
  misc_feature 1..26: note = chr11:5169023-5169049
  misc_feature 1..26: note = hypo
  source 1..26: mol_type = genomic DNA
tttttttttttttttcggagacagag

SEQ ID NO: 15524 - DNA, 159 bp, Homo sapiens
  misc_feature 1..159: note = chr11:5192016-5192175
  misc_feature 1..159: note = hypo
  source 1..159: mol_type = genomic DNA
ccacagaaaggcagacgcctcaggagaaagagcagtgggagcataagcattacactgcgcaaggcaatggcggcacccgtcccagaaatgcaggcaattgtcagaatggttgtgtagcgcagtgggctgtagatggccacaaagcggtccactgacatt

SEQ ID NO: 15525 - DNA, 80 bp, Homo sapiens
  misc_feature 1..80: note = chr11:6497229-6497309
  misc_feature 1..80: note = hypo
  source 1..80: mol_type = genomic DNA
ttcaaactgacatccccatttccaccccagtccatgccagatgcccctcctttgtgctcccacagcgccctctgtacttc

SEQ ID NO: 15526 - DNA, 30 bp, Homo sapiens
  misc_feature 1..30: note = chr11:6731043-6731073
  misc_feature 1..30: note = hypo
  source 1..30: mol_type = genomic DNA
actcctgaggtctctcgccccagtgccacc

SEQ ID NO: 15527 - DNA, 163 bp, Homo sapiens; identical to SEQ ID NO: 1591
  misc_feature 1..163: note = chr11:9405392-9405555
  misc_feature 1..163: note = hypo
  source 1..163: mol_type = genomic DNA

SEQ ID NO: 15528 - DNA, 20 bp, Homo sapiens
  misc_feature 1..20: note = chr11:10815867-10815887
  misc_feature 1..20: note = hypo
  source 1..20: mol_type = genomic DNA
acatttgaagctgggcgcgg

SEQ ID NO: 15529 - DNA, 101 bp, Homo sapiens
  misc_feature 1..101: note = chr11:10865201-10865302
  misc_feature 1..101: note = hypo
  source 1..101: mol_type = genomic DNA
ggagtcttgaaatgactgcagctcttgctaacaccttcatcgcagccagtgagagactctgaagctaagctccacctgattcctgacgtatagcaactgtg

SEQ ID NO: 15530 - DNA, 87 bp, Homo sapiens
  misc_feature 1..87: note = chr11:14564357-14564444
  misc_feature 1..87: note = hypo
  source 1..87: mol_type = genomic DNA
atctttgcaggttggcgaagctaatggattccttctcagaatgatttttttctttctttcttgagacggagtctagctctgtctccc

SEQ ID NO: 15531 - DNA, 88 bp, Homo sapiens
  misc_feature 1..88: note = chr11:17100697-17100785
  misc_feature 1..88: note = hypo
  source 1..88: mol_type = genomic DNA
aagtaactggcaagacgctgggaaactagatactgaaacatccgctcttaacttttaacctgtcactatttgaaataaagttatcagg

SEQ ID NO: 15532 - DNA, 37 bp, Homo sapiens
  misc_feature 1..37: note = chr11:19137271-19137308
  misc_feature 1..37: note = hypo
  source 1..37: mol_type = genomic DNA
tacaggtgtgagccaccacgcccggccagaaagctct

SEQ ID NO: 15533 - DNA, 139 bp, Homo sapiens
  misc_feature 1..139: note = chr11:27495284-27495423
  misc_feature 1..139: note = hypo
  source 1..139: mol_type = genomic DNA
gctttaagggtacttcgtttcttgctctctgccatggcgttgagtcgttttactctataatggagacatttttaatgaatacattaaaacaagcaggattcggccgggcgcggtggctcacgcctgtaatcccaacact

SEQ ID NO: 15534 - DNA, 17 bp, Homo sapiens
  misc_feature 1..17: note = chr11:33181188-33181205
  misc_feature 1..17: note = hypo
  source 1..17: mol_type = genomic DNA
cgcgcctgtactcccag

SEQ ID NO: 15535 - DNA, 29 bp, Homo sapiens
  misc_feature 1..29: note = chr11:33202774-33202803
  misc_feature 1..29: note = hypo
  source 1..29: mol_type = genomic DNA
acacctgtaattagccgggtgtggtggtg

SEQ ID NO: 15536 - DNA, 30 bp, Homo sapiens
  misc_feature 1..30: note = chr11:33270025-33270055
  misc_feature 1..30: note = hypo
  source 1..30: mol_type = genomic DNA
aattgaacttcaacccgggaggcggaagtt

SEQ ID NO: 15537 - DNA, 19 bp, Homo sapiens
  misc_feature 1..19: note = chr11:33277689-33277708
  misc_feature 1..19: note = hypo
  source 1..19: mol_type = genomic DNA
ccaccgcgcccggcctcct

SEQ ID NO: 15538 - DNA, 30 bp, Homo sapiens
  misc_feature 1..30: note = chr11:34534277-34534307
  misc_feature 1..30: note = hypo
  source 1..30: mol_type = genomic DNA
ccaaactgaaaactccggcccgagaatacc

SEQ ID NO: 15539 - DNA, 134 bp, Homo sapiens
  misc_feature 1..134: note = chr11:34535069-34535203
  misc_feature 1..134: note = hypo
  source 1..134: mol_type = genomic DNA
gtgtcaaacagctcccggaggccctgggactgcacccagcgcaggtgccggccctggagctggagatggacgagcagacccaggccccaggccgagcctctgagccctgacaccccttacgattcatccaaaaa

SEQ ID NO: 15540 - DNA, 30 bp, Homo sapiens
  misc_feature 1..30: note = chr11:35134309-35134339
  misc_feature 1..30: note = hypo
  source 1..30: mol_type = genomic DNA
agttaaacttggggccgagcagagccaaga

SEQ ID NO: 15541 - DNA, 35 bp, Homo sapiens
  misc_feature 1..35: note = chr11:35685096-35685131
  misc_feature 1..35: note = hypo
  source 1..35: mol_type = genomic DNA
agaagaaggggaatccgaggcggagggagaaactg

SEQ ID NO: 15542 - DNA, 83 bp, Homo sapiens
  misc_feature 1..83: note = chr11:44922891-44922974
  misc_feature 1..83: note = hypo
  source 1..83: mol_type = genomic DNA
taaatacaggtagtccgtttatgagctgccatatttattacaccccttaattgctaaagagccagagccggctgaagctggat

SEQ ID NO: 15543 - DNA, 32 bp, Homo sapiens
  misc_feature 1..32: note = chr11:46298483-46298515
  misc_feature 1..32: note = hypo
  source 1..32: mol_type = genomic DNA
ttacaagctgaaaatcggctgggcatggtggc

SEQ ID NO: 15544 - DNA, 137 bp, Homo sapiens
  misc_feature 1..137: note = chr11:47358971-47359108
  misc_feature 1..137: note = hypo
  source 1..137: mol_type = genomic DNA
tgggcctggacatgccgatggcgttgaccgcgtagacgcgcatctcgtacaccacgccctcgatcatgcgccgcgcttcatgactcagctcctgaatcaggtcgaagttcagccgcatccaccggtagctcttcttc

SEQ ID NO: 15545 - DNA, 30 bp, Homo sapiens
  misc_feature 1..30: note = chr11:57150498-57150528
  misc_feature 1..30: note = hypo
  source 1..30: mol_type = genomic DNA
gcagattggtaggaccgggcacggtggctc

SEQ ID NO: 15546 - DNA, 106 bp, Homo sapiens
  misc_feature 1..106: note = chr11:57235330-57235436
  misc_feature 1..106: note = hypo
  source 1..106: mol_type = genomic DNA
tctccaccatctacccgggcactttccgccacttgcaagccctggaggagctggacctcggtgacaaccggcacctgcgctcgctggagcccgacaccttccaggg

SEQ ID NO: 15547 - DNA, 30 bp, Homo sapiens
  misc_feature 1..30: note = chr11:59312651-59312681
  misc_feature 1..30: note = hypo
  source 1..30: mol_type = genomic DNA
attccaggacagagacgacagaaacctgaa

SEQ ID NO: 15548 - DNA, 30 bp, Homo sapiens
  misc_feature 1..30: note = chr11:59609810-59609840
  misc_feature 1..30: note = hypo
  source 1..30: mol_type = genomic DNA
tcctcctccatgggacgctctcctttgtca

SEQ ID NO: 15549 - DNA, 32 bp, Homo sapiens
  misc_feature 1..32: note = chr11:59841410-59841442
  misc_feature 1..32: note = hypo
  source 1..32: mol_type = genomic DNA
agagagaccgtggggagcggcagcgggagcag

SEQ ID NO: 15550 - DNA, 30 bp, Homo sapiens
  misc_feature 1..30: note = chr11:60897879-60897909
  misc_feature 1..30: note = hypo
  source 1..30: mol_type = genomic DNA
gcagcgctgacctagcgtcacgcggatggc

SEQ ID NO: 15551 - DNA, 171 bp, Homo sapiens; identical to SEQ ID NO: 5117
  misc_feature 1..171: note = chr11:60941596-60941767
  misc_feature 1..171: note = hypo
  source 1..171: mol_type = genomic DNA

SEQ ID NO: 15552 - DNA, 30 bp, Homo sapiens
  misc_feature 1..30: note = chr11:61039084-61039114
  misc_feature 1..30: note = hypo
  source 1..30: mol_type = genomic DNA
ctcctctgggtgaggcggggcagccaggta

SEQ ID NO: 15553 - DNA, 37 bp, Homo sapiens
  misc_feature 1..37: note = chr11:61049497-61049534
  misc_feature 1..37: note = hypo
  source 1..37: mol_type = genomic DNA
ggtccatgcctgccccgaggtgcgggatgtgactcag

SEQ ID NO: 15554 - DNA, 78 bp, Homo sapiens
  misc_feature 1..78: note = chr11:61664613-61664691
  misc_feature 1..78: note = hypo
  source 1..78: mol_type = genomic DNA
agtaagtggtgatggcggaggtggggtggcttcaggatttgggtttaatcccaagcacgagggcgggcagggaaagga

SEQ ID NO: 15555 - DNA, 30 bp, Homo sapiens
  misc_feature 1..30: note = chr11:61666106-61666136
  misc_feature 1..30: note = hypo
  source 1..30: mol_type = genomic DNA
tgtcacatgccacagcggtggtccagacct

SEQ ID NO: 15556 - DNA, 41 bp, Homo sapiens
  misc_feature 1..41: note = chr11:61669905-61669946
  misc_feature 1..41: note = hypo
  source 1..41: mol_type = genomic DNA
tgactcaccctggcccgggaagatggcgagatgtagtaatg

SEQ ID NO: 15557 - DNA, 30 bp, Homo sapiens
  misc_feature 1..30: note = chr11:61736670-61736700
  misc_feature 1..30: note = hypo
  source 1..30: mol_type = genomic DNA
ttgcctggggctgggcgcggtggctcatgc

SEQ ID NO: 15558 - DNA, 30 bp, Homo sapiens
  misc_feature 1..30: note = chr11:62370720-62370750
  misc_feature 1..30: note = hypo
  source 1..30: mol_type = genomic DNA
tggggagagggagcccgcccagctcagctc

SEQ ID NO: 15559 - DNA, 30 bp, Homo sapiens
  misc_feature 1..30: note = chr11:62445455-62445485
  misc_feature 1..30: note = hypo
  source 1..30: mol_type = genomic DNA
tcatcttcctgtagccgctgtcgtgctgct

SEQ ID NO: 15560 - DNA, 30 bp, Homo sapiens
  misc_feature 1..30: note = chr11:63783752-63783782
  misc_feature 1..30: note = hypo
  source 1..30: mol_type = genomic DNA
tccgcagcctgcgtccgtggtaactgccag

SEQ ID NO: 15561 - DNA, 39 bp, Homo sapiens
  misc_feature 1..39: note = chr11:63849387-63849426
  misc_feature 1..39: note = hypo
  source 1..39: mol_type = genomic DNA
tggactcccggctctcgagtgccgcgttctacctgctgt

SEQ ID NO: 15562 - DNA, 77 bp, Homo sapiens
  misc_feature 1..77: note = chr11:63955145-63955222
  misc_feature 1..77: note = hypo
  source 1..77: mol_type = genomic DNA
atttctggaataagacgttgctcttttacctttaagaaaggatctggggccgggcaccgtggctcagcctgtaatcc

SEQ ID NO: 15563 - DNA, 28 bp, Homo sapiens
  misc_feature 1..28: note = chr11:64578577-64578605
  misc_feature 1..28: note = hypo
  source 1..28: mol_type = genomic DNA
gtttgttttgagacacggtctttctctt

SEQ ID NO: 15564 - DNA, 30 bp, Homo sapiens
  misc_feature 1..30: note = chr11:64668004-64668034
  misc_feature 1..30: note = hypo
  source 1..30: mol_type = genomic DNA
cccgctgcccccctgcgtgcgccatgagtt

SEQ ID NO: 15565 - DNA, 30 bp, Homo sapiens
  misc_feature 1..30: note = chr11:64977482-64977512
  misc_feature 1..30: note = hypo
  source 1..30: mol_type = genomic DNA
cctcagtccatcttccggaagtttgacctg

SEQ ID NO: 15566 - DNA, 30 bp, Homo sapiens
  misc_feature 1..30: note = chr11:65091387-65091417
  misc_feature 1..30: note = hypo
  source 1..30: mol_type = genomic DNA
agcagggaagagtttcgctggccaggctga

SEQ ID NO: 15567 - DNA, 30 bp, Homo sapiens
  misc_feature 1..30: note = chr11:65127486-65127516
  misc_feature 1..30: note = hypo
  source 1..30: mol_type = genomic DNA
tctgaaactccttgacgatgagactgttcc

SEQ ID NO: 15568 - DNA, 34 bp, Homo sapiens
  misc_feature 1..34: note = chr11:65511036-65511070
  misc_feature 1..34: note = hypo
  source 1..34: mol_type = genomic DNA
gattacaggcgtgagccaccgcaccctcttggcc

SEQ ID NO: 15569 - DNA, 95 bp, Homo sapiens
  misc_feature 1..95: note = chr11:65551629-65551724
  misc_feature 1..95: note = hypo
  source 1..95: mol_type = genomic DNA
ggcttgttcaggggacgcgggagacagcagtgtggctggcatacagggacccagctggaaggggattgggaggtcaacggcggccccagcacgcc

SEQ ID NO: 15570 - DNA, 35 bp, Homo sapiens
  misc_feature 1..35: note = chr11:65722789-65722824
  misc_feature 1..35: note = hypo
  source 1..35: mol_type = genomic DNA
tactcggctgtacgccgtggctcacacctgtaatc

SEQ ID NO: 15571 - DNA, 30 bp, Homo sapiens
  misc_feature 1..30: note = chr11:66048072-66048102
  misc_feature 1..30: note = hypo
  source 1..30: mol_type = genomic DNA
ggggggctgagtcagcgccaggcagcctgg

SEQ ID NO: 15572 - DNA, 104 bp, Homo sapiens
  misc_feature 1..104: note = chr11:66325272-66325376
  misc_feature 1..104: note = hypo
  source 1..104: mol_type = genomic DNA
ggcgtctgcacaagccgccccgcattcaggaaaagtgccagctggagatcaacttcaacacactgcagaccaagttgcggctcagccaccggcctgccttcatg

SEQ ID NO: 15573 - DNA, 93 bp, Homo sapiens
  misc_feature 1..93: note = chr11:66411368-66411461
  misc_feature 1..93: note = hypo
  source 1..93: mol_type = genomic DNA
tgctgcagcagcagccgctgctgctgttactgcagcttccacttcatattacgggcgggatcggagccccctgcgtcgcgctacagccccagt

SEQ ID NO: 15574 - DNA, 99 bp, Homo sapiens; identical to SEQ ID NO: 5119
  misc_feature 1..99: note = chr11:66511245-66511344
  misc_feature 1..99: note = hypo
  source 1..99: mol_type = genomic DNA

SEQ ID NO: 15575 - DNA, 82 bp, Homo sapiens; identical to SEQ ID NO: 1592
  misc_feature 1..82: note = chr11:66513182-66513264
  misc_feature 1..82: note = hypo
  source 1..82: mol_type = genomic DNA

SEQ ID NO: 15576 - DNA, 82 bp, Homo sapiens; identical to SEQ ID NO: 1593
  misc_feature 1..82: note = chr11:66513564-66513646
  misc_feature 1..82: note = hypo
  source 1..82: mol_type = genomic DNA

SEQ ID NO: 15577 - DNA, 16 bp, Homo sapiens
  misc_feature 1..16: note = chr11:66515380-66515396
  misc_feature 1..16: note = hypo
  source 1..16: mol_type = genomic DNA
gcgcagggcagcatta

SEQ ID NO: 15578 - DNA, 190 bp, Homo sapiens
  misc_feature 1..190: note = chr11:66625148-66625338
  misc_feature 1..190: note = hypo
  source 1..190: mol_type = genomic DNA
ccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgttt

SEQ ID NO: 15579 - DNA, 343 bp, Homo sapiens
  misc_feature 1..343: note = chr11:66625538-66625881
  misc_feature 1..343: note = hypo
  source 1..343: mol_type = genomic DNA
ggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcc

SEQ ID NO: 15580 - DNA, 207 bp, Homo sapiens
  misc_feature 1..207: note = chr11:66631300-66631507
  misc_feature 1..207: note = hypo
  source 1..207: mol_type = genomic DNA
tggggtggtctttgccgtgggcaatgactttgaccagcagggagtcgtagtggggcgagatgacggctccttggaaggcggaagcattatccaggcggatgcccatgccctctccgctccggaacacctgtgggaagggtgaggcgtgaggacctgcgccagaaactgcggtcaaaagtgccccacccaccccgaggctggccaggt

SEQ ID NO: 15581 - DNA, 157 bp, Homo sapiens; identical to SEQ ID NO: 1594
  misc_feature 1..157: note = chr11:67072239-67072396
  misc_feature 1..157: note = hypo
  source 1..157: mol_type = genomic DNA

SEQ ID NO: 15582 - DNA, 40 bp, Homo sapiens
  misc_feature 1..40: note = chr11:67210017-67210057
  misc_feature 1..40: note = hypo
  source 1..40: mol_type = genomic DNA
cctcatagcactggtcgttcttgaccggctgcccgaacac

SEQ ID NO: 15583 - DNA, 36 bp, Homo sapiens
  misc_feature 1..36: note = chr11:67462643-67462679
  misc_feature 1..36: note = hypo
  source 1..36: mol_type = genomic DNA
cgtatgaggtagccacggaaccgcaggcaagactca

SEQ ID NO: 15584 - DNA, 59 bp, Homo sapiens
  misc_feature 1..59: note = chr11:67764182-67764241
  misc_feature 1..59: note = hypo
  source 1..59: mol_type = genomic DNA
tgttgccccagcccacgctgcgcagatcgatctcctccgtgggccggtaagcggctccg

SEQ ID NO: 15585 - DNA, 147 bp, Homo sapiens
  misc_feature 1..147: note = chr11:67781462-67781609
  misc_feature 1..147: note = hypo
  source 1..147: mol_type = genomic DNA
gaccggagcaggtcccgccctcaaggtggccacttaacaatcacccacagccttgcgctcaccgatgctgggccctgggctcagaaccgactgtgtggtctcatcattagctggcaggtgccatcattacaccggtaacatgagagg

SEQ ID NO: 15586 - DNA, 93 bp, Homo sapiens; identical to SEQ ID NO: 5123
  misc_feature 1..93: note = chr11:67797202-67797295
  misc_feature 1..93: note = hypo
  source 1..93: mol_type = genomic DNA

SEQ ID NO: 15587 - DNA, 154 bp, Homo sapiens
  misc_feature 1..154: note = chr11:68111091-68111245
  misc_feature 1..154: note = hypo
  source 1..154: mol_type = genomic DNA
ctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccagga

SEQ ID NO: 15588 - DNA, 142 bp, Homo sapiens
  misc_feature 1..142: note = chr11:68133031-68133173
  misc_feature 1..142: note = hypo
  source 1..142: mol_type = genomic DNA
ttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtg

SEQ ID NO: 15589 - DNA, 45 bp, Homo sapiens
  misc_feature 1..45: note = chr11:69192566-69192611
  misc_feature 1..45: note = hypo
  source 1..45: mol_type = genomic DNA
tgggaaagtcctgggcgagccgggacaagtcgctcaccctactag

SEQ ID NO: 15590 - DNA, 72 bp, Homo sapiens; identical to SEQ ID NO: 1595
  misc_feature 1..72: note = chr11:69280561-69280633
  misc_feature 1..72: note = hypo
  source 1..72: mol_type = genomic DNA

SEQ ID NO: 15591 - DNA, 30 bp, Homo sapiens
  misc_feature 1..30: note = chr11:69339953-69339983
  misc_feature 1..30: note = hypo
  source 1..30: mol_type = genomic DNA
catccctgcccgccccgtccccatgcttgc

SEQ ID NO: 15592 - DNA, 30 bp, Homo sapiens
  misc_feature 1..30: note = chr11:69970448-69970478
  misc_feature 1..30: note = hypo
  source 1..30: mol_type = genomic DNA
ccctcagctcctgtacgaagagtgggcacg

SEQ ID NO: 15593 - DNA, 30 bp, Homo sapiens
  misc_feature 1..30: note = chr11:70051066-70051096
  misc_feature 1..30: note = hypo
  source 1..30: mol_type = genomic DNA
agaagttcagcatagcggttaagggtcgac

SEQ ID NO: 15594 - DNA, 34 bp, Homo sapiens
  misc_feature 1..34: note = chr11:71117681-71117715
  misc_feature 1..34: note = hypo
  source 1..34: mol_type = genomic DNA
cgctgctccctaccacggacgattggaacttcca

SEQ ID NO: 15595 - DNA, 34 bp, Homo sapiens; identical to SEQ ID NO: 5125
  misc_feature 1..34: note = chr11:72475677-72475711
  misc_feature 1..34: note = hypo
  source 1..34: mol_type = genomic DNA

SEQ ID NO: 15596 - DNA, 30 bp, Homo sapiens
  misc_feature 1..30: note = chr11:72532300-72532330
  misc_feature 1..30: note = hypo
  source 1..30: mol_type = genomic DNA
ctgggaacatcatggcgcccgagggccgga

SEQ ID NO: 15597 - DNA, 30 bp, Homo sapiens
  misc_feature 1..30: note = chr11:72905832-72905862
  misc_feature 1..30: note = hypo
  source 1..30: mol_type = genomic DNA
cttccttcagcctgccgccctgtcctgagt

SEQ ID NO: 15598 - DNA, 62 bp, Homo sapiens
  misc_feature 1..62: note = chr11:73073174-73073236
  misc_feature 1..62: note = hypo
  source 1..62: mol_type = genomic DNA
tgcctgctgagcctgcgcgccgagccggacgtggaggcctgcatcgccgtctgttccgcccg

SEQ ID NO: 15599 - DNA, 20 bp, Homo sapiens
  misc_feature 1..20: note = chr11:73310437-73310457
  misc_feature 1..20: note = hypo
  source 1..20: mol_type = genomic DNA
gcaacctctgcctcccgggt

SEQ ID NO: 15600 - DNA, 24 bp, Homo sapiens
  misc_feature 1..24: note = chr11:74246632-74246656
  misc_feature 1..24: note = hypo
  source 1..24: mol_type = genomic DNA
tatgagccacggcacccagcccaa

SEQ ID NO: 15601 - DNA, 91 bp, Homo sapiens
  misc_feature 1..91: note = chr11:75459473-75459564
  misc_feature 1..91: note = hypo
  source 1..91: mol_type = genomic DNA
cagataaacaaaaggcgttaggttggtgcgaaagtcattgaggtttttgccaatagcatccctacaatggactattatttgatcgtaaaaa

SEQ ID NO: 15602 - DNA, 348 bp, Homo sapiens; identical to SEQ ID NO: 5126
  misc_feature 1..348: note = chr11:76371738-76372086
  misc_feature 1..348: note = hypo
  source 1..348: mol_type = genomic DNA

SEQ ID NO: 15603 - DNA, 30 bp, Homo sapiens
  misc_feature 1..30: note = chr11:95488699-95488729
  misc_feature 1..30: note = hypo
  source 1..30: mol_type = genomic DNA
gacatgaaggaagcccgttagatatctctg

SEQ ID NO: 15604 - DNA, 30 bp, Homo sapiens
  misc_feature 1..30: note = chr11:95658721-95658751
  misc_feature 1..30: note = hypo
  source 1..30: mol_type = genomic DNA
gtcggttgcacagtacggtctcactaagta

SEQ ID NO: 15605 - DNA, 45 bp, Homo sapiens; identical to SEQ ID NO: 1596
  misc_feature 1..45: note = chr11:102961347-102961392
  misc_feature 1..45: note = hypo
  source 1..45: mol_type = genomic DNA

SEQ ID NO: 15606 - DNA, 185 bp, Homo sapiens
  misc_feature 1..185: note = chr11:113552799-113552984
  misc_feature 1..185: note = hypo
  source 1..185: mol_type = genomic DNA
ataacatgctgagcccgcaccgggctctaggaaccagaaatcagagtgaccaggggaaactgggacatcgatatgcatggcttgccggagtaacactacacctgactcaccttcctagcctcccgcaaattgccagagaagttctgggcctaggagggccaggctgtttgcgcaaaacattaggt

SEQ ID NO: 15607 - DNA, 32 bp, Homo sapiens
  misc_feature 1..32: note = chr11:116890012-116890044
  misc_feature 1..32: note = hypo
  source 1..32: mol_type = genomic DNA
gggtgagccaccgcacacggtctttattgtaa

SEQ ID NO: 15608 - DNA, 16 bp, Homo sapiens
  misc_feature 1..16: note = chr11:116952332-116952348
  misc_feature 1..16: note = hypo
  source 1..16: mol_type = genomic DNA
ccgtctcaaaataaat

SEQ ID NO: 15609 - DNA, 40 bp, Homo sapiens
  misc_feature 1..40: note = chr11:120008098-120008138
  misc_feature 1..40: note = hypo
  source 1..40: mol_type = genomic DNA
agcagctggtggtctcggaaggcggcgccctccaggtggg

SEQ ID NO: 15610 - DNA, 30 bp, Homo sapiens
  misc_feature 1..30: note = chr11:120367603-120367633
  misc_feature 1..30: note = hypo
  source 1..30: mol_type = genomic DNA
ccctctactgtccatcgtgagccctcttcc

SEQ ID NO: 15611 - DNA, 30 bp, Homo sapiens
  misc_feature 1..30: note = chr11:121023674-121023704
  misc_feature 1..30: note = hypo
  source 1..30: mol_type = genomic DNA
ctgcagccactactgcgtggagggctgtca

SEQ ID NO: 15612 - DNA, 54 bp, Homo sapiens
  misc_feature 1..54: note = chr11:125755569-125755623
  misc_feature 1..54: note = hypo
  source 1..54: mol_type = genomic DNA
ccaacccccaggccacggacaggcacctaggaaccaggccgcaaggcagggggt

SEQ ID NO: 15613 - DNA, 22 bp, Homo sapiens
  misc_feature 1..22: note = chr11:126083949-126083971
  misc_feature 1..22: note = hypo
  source 1..22: mol_type = genomic DNA
aagaatttatgtggccgggcgc

SEQ ID NO: 15614 - DNA, 37 bp, Homo sapiens
  misc_feature 1..37: note = chr11:126273042-126273079
  misc_feature 1..37: note = hypo
  source 1..37: mol_type = genomic DNA
cccacaaggggagggcgtggctcgtgaaattcctgat

SEQ ID NO: 15615 - DNA, 30 bp, Homo sapiens
  misc_feature 1..30: note = chr11:129867029-129867059
  misc_feature 1..30: note = hypo
  source 1..30: mol_type = genomic DNA
aaaatatggattttacgtgtaggttatgtt

SEQ ID NO: 15616 - DNA, 30 bp, Homo sapiens
  misc_feature 1..30: note = chr11:130717573-130717603
  misc_feature 1..30: note = hypo
  source 1..30: mol_type = genomic DNA
ttacctgtgcttaaccgcagtccagaaata

SEQ ID NO: 15617 - DNA, 103 bp, Homo sapiens
  misc_feature 1..103: note = chr11:131522763-131522866
  misc_feature 1..103: note = hypo
  source 1..103: mol_type = genomic DNA
gggtggcggtcactccgccttcagaaagccacttggaatgcaacctgcacaattgccttcatcctttaccgccctgccagattgttgacggaagcaaccttat

SEQ ID NO: 15618 - DNA, 34 bp, Homo sapiens
  misc_feature 1..34: note = chr11:131766926-131766960
  misc_feature 1..34: note = hypo
  source 1..34: mol_type = genomic DNA
ctggcaggcatttgacgtccgtggctgaatagcc

SEQ ID NO: 15619 - DNA, 104 bp, Homo sapiens
  misc_feature 1..104: note = chr11:133231728-133231832
  misc_feature 1..104: note = hypo
  source 1..104: mol_type = genomic DNA
aatgagctcagcatgcgggacagcagcgccggccctcactctccagggacgcatggagctctgtcaaatgacccgacaaacctttgcagcgcagaggcttctag

SEQ ID NO: 15620 - DNA, 125 bp, Homo sapiens
  misc_feature 1..125: note = chr11:134011075-134011200
  misc_feature 1..125: note = hypo
  source 1..125: mol_type = genomic DNA
tggtgctggggttgccgatggggagaaaacacggtgtaccctgaagtgacatcctcccgggtgggaggatggtggtcagggaaggctccccaaagtggcctctctgggtgcggtgtgaagggtgg

SEQ ID NO: 15621 - DNA, 30 bp, Homo sapiens
  misc_feature 1..30: note = chr12:1948142-1948172
  misc_feature 1..30: note = hypo
  source 1..30: mol_type = genomic DNA
cacgaccagtgacaccgggcttctacccgg

SEQ ID NO: 15622 - DNA, 52 bp, Homo sapiens
  misc_feature 1..52: note = chr12:1948496-1948548
  misc_feature 1..52: note = hypo
  source 1..52: mol_type = genomic DNA
aacaagggtaaggagcgcttcatcgcagggacctgatcgttctcagacagct

SEQ ID NO: 15623 - DNA, 194 bp, Homo sapiens; identical to SEQ ID NO: 5128
  misc_feature 1..194: note = chr12:2566053-2566247
  misc_feature 1..194: note = hypo
  source 1..194: mol_type = genomic DNA

SEQ ID NO: 15624 - DNA, 30 bp, Homo sapiens
  misc_feature 1..30: note = chr12:2590465-2590495
  misc_feature 1..30: note = hypo
  source 1..30: mol_type = genomic DNA
taacctcaaaaccaccgtagagaaaggtgc

SEQ ID NO: 15625 - DNA, 295 bp, Homo sapiens; identical to SEQ ID NO: 5129
  misc_feature 1..295: note = chr12:2964499-2964794
  misc_feature 1..295: note = hypo
  source 1..295: mol_type = genomic DNA

SEQ ID NO: 15626 - DNA, 55 bp, Homo sapiens
  misc_feature 1..55: note = chr12:4405652-4405707
  misc_feature 1..55: note = hypo
  source 1..55: mol_type = genomic DNA
agctattgtctaccacgcctcgtgtgcacacgcacacacacgcaagttccctcag

SEQ ID NO: 15627 - DNA, 30 bp, Homo sapiens
  misc_feature 1..30: note = chr12:4554801-4554831
  misc_feature 1..30: note = hypo
  source 1..30: mol_type = genomic DNA
ctccctccggcatggcggcaggggcttatt

SEQ ID NO: 15628 - DNA, 103 bp, Homo sapiens
  misc_feature 1..103: note = chr12:5335946-5336049
  misc_feature 1..103: note = hypo
  source 1..103: mol_type = genomic DNA
acatcatagatcactcgctgacaggctgaactgggcgccatcttgaagaacgtaggctgcatgctaatgacgcccaggaggagctgcgcgctgcattgtggag

SEQ ID NO: 15629 - DNA, 185 bp, Homo sapiens
  misc_feature 1..185: note = chr12:6483568-6483753
  misc_feature 1..185: note = hypo
  source 1..185: mol_type = genomic DNA
gaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtgg

SEQ ID NO: 15630 - DNA, 30 bp, Homo sapiens
  misc_feature 1..30: note = chr12:8060661-8060691
  misc_feature 1..30: note = hypo
  source 1..30: mol_type = genomic DNA
tgctgggattacaggcgtgagccacctcag

SEQ ID NO: 15631 - DNA, 30 bp, Homo sapiens
  misc_feature 1..30: note = chr12:8117682-8117712
  misc_feature 1..30: note = hypo
  source 1..30: mol_type = genomic DNA
agatgtggagaacagcgcaggaataataac

SEQ ID NO: 15632 - DNA, 18 bp, Homo sapiens
  misc_feature 1..18: note = chr12:8127122-8127140
  misc_feature 1..18: note = hypo
  source 1..18: mol_type = genomic DNA
gcccggccaaggtcataa

SEQ ID NO: 15633 - DNA, 118 bp, Homo sapiens
  misc_feature 1..118: note = chr12:8790007-8790125
  misc_feature 1..118: note = hypo
  source 1..118: mol_type = genomic DNA
tgcagagggagacatcgcagctgtctttgggcttggcttcccgccttgttttggagggcctttctgctttgtggctctgtatggcccccagaagatagtggcccggctcaagaagtat

SEQ ID NO: 15634 - DNA, 30 bp, Homo sapiens
  misc_feature 1..30: note = chr12:8799975-8800005
  misc_feature 1..30: note = hypo
  source 1..30: mol_type = genomic DNA
tgaaaaattggatagcgaattatgagtcca

SEQ ID NO: 15635 - DNA, 81 bp, Homo sapiens
  misc_feature 1..81: note = chr12:8808559-8808640
  misc_feature 1..81: note = hypo
  source 1..81: mol_type = genomic DNA
tacaataatgacaaacgattgatgacttctttgcaatacttatttaaaatgaaatcggatataccaaaggcattgtgattt

SEQ ID NO: 15636 - DNA, 31 bp, Homo sapiens
  misc_feature 1..31: note = chr12:10363278-10363309
  misc_feature 1..31: note = hypo
  source 1..31: mol_type = genomic DNA
agtttaattttcagtcgctcatgttaggttt

SEQ ID NO: 15637 - DNA, 89 bp, Homo sapiens; identical to SEQ ID NO: 1597
  misc_feature 1..89: note = chr12:12848467-12848556
  misc_feature 1..89: note = hypo
  source 1..89: mol_type = genomic DNA

SEQ ID NO: 15638 - DNA, 181 bp, Homo sapiens
  misc_feature 1..181: note = chr12:13079830-13080011
  misc_feature 1..181: note = hypo
  source 1..181: mol_type = genomic DNA
aacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctcc

SEQ ID NO: 15639 - DNA, 94 bp, Homo sapiens
  misc_feature 1..94: note = chr12:13215216-13215310
  misc_feature 1..94: note = hypo
  source 1..94: mol_type = genomic DNA
ttagtactgctgggccgtgtgctcacgtggagcggaataaataacatccttcccaggtttagaggttggagtttggtcgcggggtgcttctgag

SEQ ID NO: 15640 - DNA, 65 bp, Homo sapiens
  misc_feature 1..65: note = chr12:17629461-17629526
  misc_feature 1..65: note = hypo
  source 1..65: mol_type = genomic DNA
ttccagctcccactccgacgggccagtatttttgtctcctctatcactcccgcctactcttctga

SEQ ID NO: 15641 - DNA, 45 bp, Homo sapiens
  misc_feature 1..45: note = chr12:21833068-21833113
  misc_feature 1..45: note = hypo
  source 1..45: mol_type = genomic DNA
aattcaagtttgggccgaagtttaaagacttttgtttgggccggg

SEQ ID NO: 15642 - DNA, 83 bp, Homo sapiens
  misc_feature 1..83: note = chr12:22698113-22698196
  misc_feature 1..83: note = hypo
  source 1..83: mol_type = genomic DNA
gagatcactcctctgtctccaaaaaaagaaaaaaaagaaagaaagaaatagagataccaggcacatctcgaatagtgaaataa

SEQ ID NO: 15643 - DNA, 77 bp, Homo sapiens
  misc_feature 1..77: note = chr12:25081492-25081569
  misc_feature 1..77: note = hypo
  source 1..77: mol_type = genomic DNA
gagcccacaaaatcgaagctgcagcgagctgtgattgtgccatgccagcctgcaatacagagcgagacagtctcaaa

SEQ ID NO: 15644 - DNA, 16 bp, Homo sapiens
  misc_feature 1..16: note = chr12:27489593-27489609
  misc_feature 1..16: note = hypo
  source 1..16: mol_type = genomic DNA
ttaaacctggctgggc

SEQ ID NO: 15645 - DNA, 20 bp, Homo sapiens
  misc_feature 1..20: note = chr12:30859424-30859444
  misc_feature 1..20: note = hypo
  source 1..20: mol_type = genomic DNA
acaagcgtaagccactgtac

SEQ ID NO: 15646 - DNA, 19 bp, Homo sapiens
  misc_feature 1..19: note = chr12:32340317-32340336
  misc_feature 1..19: note = hypo
  source 1..19: mol_type = genomic DNA
aatctatgggctgggcgcg

SEQ ID NO: 15647 - DNA, 151 bp, Homo sapiens
  misc_feature 1..151: note = chr12:32597645-32597796
  misc_feature 1..151: note = hypo
  source 1..151: mol_type = genomic DNA
tgatttttgacaagaattttctcctttcaaaaagtgcttaattgtggcaaggtgagacctgaggtgaagataaaggatgggtgggtatttcttcagaattcagcagaaagatttgccaacctttaagtagacacgccgttccaaatttgta

SEQ ID NO: 15648 - DNA, 33 bp, Homo sapiens
  misc_feature 1..33: note = chr12:32831140-32831173
  misc_feature 1..33: note = hypo
  source 1..33: mol_type = genomic DNA
ttttttcatgaacaccgccccccgctgctccga

SEQ ID NO: 15649 - DNA, 92 bp, Homo sapiens
  misc_feature 1..92: note = chr12:32831293-32831385
  misc_feature 1..92: note = hypo
  source 1..92: mol_type = genomic DNA
gggattacaccgcgctcggtcctgaacacacattttgtttgtttgtttgtttgtttacaaaacccctggagaacccgcgtattctaacctgg

SEQ ID NO: 15650 - DNA, 68 bp, Homo sapiens
  misc_feature 1..68: note = chr12:34494888-34494956
  misc_feature 1..68: note = hypo
  source 1..68: mol_type = genomic DNA
accacgcaccccattcggtgcatacacggggtcccgggtttgcactccccgagcggctggacactgcg

SEQ ID NO: 15651 - DNA, 99 bp, Homo sapiens
  misc_feature 1..99: note = chr12:34502764-34502863
  misc_feature 1..99: note = hypo
  source 1..99: mol_type = genomic DNA
cttccaccagtgtttcggcctccccgttcaagcctccctgcggctgtgggcggctaccccaggggaccagctgctccgagggcgcgagcctaggaccct

SEQ ID NO: 15652 - DNA, 40 bp, Homo sapiens
  misc_feature 1..40: note = chr12:34520176-34520216
  misc_feature 1..40: note = hypo
  source 1..40: mol_type = genomic DNA
gcaccttgggctagccgcctttggccggaggcgctcagtg

SEQ ID NO: 15653 - DNA, 94 bp, Homo sapiens
  misc_feature 1..94: note = chr12:38550728-38550822
  misc_feature 1..94: note = hypo
  source 1..94: mol_type = genomic DNA
aaggggaaagcatgtcggtcttaaagagggacgttgaggcagcccggagaaaaaaacagggaggctggggtccttccaccgatgacagtgcctt

SEQ ID NO: 15654 - DNA, 147 bp, Homo sapiens; identical to SEQ ID NO: 1598
  misc_feature 1..147: note = chr12:49657607-49657754
  misc_feature 1..147: note = hypo
  source 1..147: mol_type = genomic DNA

SEQ ID NO: 15655 - DNA, 235 bp, Homo sapiens; identical to SEQ ID NO: 5132
  misc_feature 1..235: note = chr12:51421351-51421586
  misc_feature 1..235: note = hypo
  source 1..235: mol_type = genomic DNA

SEQ ID NO: 15656 - DNA, 21 bp, Homo sapiens
  misc_feature 1..21: note = chr12:51565449-51565470
  misc_feature 1..21: note = hypo
  source 1..21: mol_type = genomic DNA
cgcacccggccgaaaggagat

SEQ ID NO: 15657 - DNA, 20 bp, Homo sapiens
  misc_feature 1..20: note = chr12:51930773-51930793
  misc_feature 1..20: note = hypo
  source 1..20: mol_type = genomic DNA
gagcatgaagctgggcgctg

SEQ ID NO: 15658 - DNA, 144 bp, Homo sapiens
  misc_feature 1..144: note = chr12:53189513-53189657
  misc_feature 1..144: note = hypo
  source 1..144: mol_type = genomic DNA
agccacctccatagccgctcccaaagccacctccatagccacctgcaaaggcacagctgctccgccctcccccaaagcctccagcccgggagccgccagctgccacgctgatggagatgctcttgttgccgcccaggttgtaga

SEQ ID NO: 15659 - DNA, 198 bp, Homo sapiens
  misc_feature 1..198: note = chr12:53663026-53663224
  misc_feature 1..198: note = hypo
  source 1..198: mol_type = genomic DNA
ctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgca

SEQ ID NO: 15660 - DNA, 97 bp, Homo sapiens; identical to SEQ ID NO: 1599
  misc_feature 1..97: note = chr12:54720206-54720303
  misc_feature 1..97: note = hypo
  source 1..97: mol_type = genomic DNA

SEQ ID NO: 15661 - DNA, 43 bp, Homo sapiens
  misc_feature 1..43: note = chr12:56441277-56441320
  misc_feature 1..43: note = hypo
  source 1..43: mol_type = genomic DNA
acctgccagataggccgggcgcggtggctcacgcctgtaatcc

SEQ ID NO: 15662 - DNA, 30 bp, Homo sapiens
  misc_feature 1..30: note = chr12:57559766-57559796
  misc_feature 1..30: note = hypo
  source 1..30: mol_type = genomic DNA
gcctgcagggcagctcggctctggcagtgc

SEQ ID NO: 15663 - DNA, 212 bp, Homo sapiens; identical to SEQ ID NO: 5136
  misc_feature 1..212: note = chr12:57881112-57881324
  misc_feature 1..212: note = hypo
  source 1..212: mol_type = genomic DNA

SEQ ID NO: 15664 - DNA, 75 bp, Homo sapiens; identical to SEQ ID NO: 5137
  misc_feature 1..75: note = chr12:58241524-58241599
  misc_feature 1..75: note = hypo
  source 1..75: mol_type = genomic DNA

SEQ ID NO: 15665 - DNA, 19 bp, Homo sapiens
  misc_feature 1..19: note = chr12:62539074-62539093
  misc_feature 1..19: note = hypo
  source 1..19: mol_type = genomic DNA
cctcctgtcagttggcggt

SEQ ID NO: 15666 - DNA, 22 bp, Homo sapiens
  misc_feature 1..22: note = chr12:62563354-62563376
  misc_feature 1..22: note = hypo
  source 1..22: mol_type = genomic DNA
gggcacagtggctcacgcctgt

SEQ ID NO: 15667 - DNA, 149 bp, Homo sapiens
  misc_feature 1..149: note = chr12:64783185-64783334
  misc_feature 1..149: note = hypo
  source 1..149: mol_type = genomic DNA
ttggatcaagtgagccgcctgagattgccaagcgtcctgtgcgcatctcattaacgcatctgcttattcatgcatttattcttttgctggggagggggtggaggggaacggtgtctcactcattctgtagctcaggctggagtgcaggt

SEQ ID NO: 15668 - DNA, 23 bp, Homo sapiens
  misc_feature 1..23: note = chr12:64797450-64797473
  misc_feature 1..23: note = hypo
  source 1..23: mol_type = genomic DNA
aaataaattttggaccggacacc

SEQ ID NO: 15669 - DNA, 170 bp, Homo sapiens
  misc_feature 1..170: note = chr12:65516360-65516530
  misc_feature 1..170: note = hypo
  source 1..170: mol_type = genomic DNA
ttttttaaaagttgccgaattcacaggtgcgtgggggcaaaaccaaggctctggcctcgtctgtgagaagcatgcttggccggcagtgggctgcagcataacctatccacctggcccagcagaaagaactgatttttgcctcctgcctaattcctcggatgcacaaagaa

SEQ ID NO: 15670 - DNA, 19 bp, Homo sapiens
  misc_feature 1..19: note = chr12:65562067-65562086
  misc_feature 1..19: note = hypo
  source 1..19: mol_type = genomic DNA
ctaacgtttttctgtacag

SEQ ID NO: 15671 - DNA, 38 bp, Homo sapiens
  misc_feature 1..38: note = chr12:66208320-66208358
  misc_feature 1..38: note = hypo
  source 1..38: mol_type = genomic DNA
aatagacagataggccgggcgccgtggctcacgcctgt

SEQ ID NO: 15672 - DNA, 29 bp, Homo sapiens
  misc_feature 1..29: note = chr12:68978592-68978621
  misc_feature 1..29: note = hypo
  source 1..29: mol_type = genomic DNA
aaaagctttttttccgttttcactagaaa

SEQ ID NO: 15673 - DNA, 17 bp, Homo sapiens
  misc_feature 1..17: note = chr12:69754451-69754468
  misc_feature 1..17: note = hypo
  source 1..17: mol_type = genomic DNA
tttttttttttgagacg

SEQ ID NO: 15674 - DNA, 114 bp, Homo sapiens
  misc_feature 1..114: note = chr12:69964176-69964290
  misc_feature 1..114: note = hypo
  source 1..114: mol_type = genomic DNA
ctgattttatacacccgcaaacgtgactcagtaaaatggcactacctctgcctgcgacgctatggctatgactcgaatctcttttcttttgaaagtggtcgaaggtgtcaaact

SEQ ID NO: 15675 - DNA, 181 bp, Homo sapiens
  misc_feature 1..181: note = chr12:70087493-70087674
  misc_feature 1..181: note = hypo
  source 1..181: mol_type = genomic DNA
cacagcagtgctcaccgagcgaaagatgagcagggaggtgagattgacgtagcgcatcagcgtccttctaagcaggcgcccgtgctcgtcgcttccgtgaacactgctagagatgaggaacattagcctgtctggccagggcaaattcacaaactggttccaccatcggttcactaccaga

SEQ ID NO: 15676 - DNA, 25 bp, Homo sapiens
  misc_feature 1..25: note = chr12:74930406-74930431
  misc_feature 1..25: note = hypo
  source 1..25: mol_type = genomic DNA
catgtaaggcactgtcgcaagattt

SEQ ID NO: 15677 - DNA, 30 bp, Homo sapiens
  misc_feature 1..30: note = chr12:77150018-77150048
  misc_feature 1..30: note = hypo
  source 1..30: mol_type = genomic DNA
gggagggtgcaaagacgtgcataccaggag

SEQ ID NO: 15678 - DNA, 30 bp, Homo sapiens
  misc_feature 1..30: note = chr12:94641622-94641652
  misc_feature 1..30: note = hypo
  source 1..30: mol_type = genomic DNA
atcacagctgggattcgttaacaaagttac

SEQ ID NO: 15679 - DNA, 81 bp, Homo sapiens
  misc_feature 1..81: note = chr12:95465839-95465920
  misc_feature 1..81: note = hypo
  source 1..81: mol_type = genomic DNA
gatagaaatacacatcgctttttcagatatactaactggacttaaagcaaagtttaaaaacaatcatcggccgggcgcggt

SEQ ID NO: 15680 - DNA, 23 bp, Homo sapiens
  misc_feature 1..23: note = chr12:96881015-96881038
  misc_feature 1..23: note = hypo
  source 1..23: mol_type = genomic DNA
gtgagccacgacacccagccaat

SEQ ID NO: 15681 - DNA, 42 bp, Homo sapiens
  misc_feature 1..42: note = chr12:98948376-98948418
  misc_feature 1..42: note = hypo
  source 1..42: mol_type = genomic DNA
aacaaggcaactttagtgaagctattgcgtaccagtttatga

SEQ ID NO: 15682 - DNA, 30 bp, Homo sapiens
  misc_feature 1..30: note = chr12:104690709-104690739
  misc_feature 1..30: note = hypo
  source 1..30: mol_type = genomic DNA
cacctgtgttgacatcgggctaggcactat

SEQ ID NO: 15683 - DNA, 66 bp, Homo sapiens
  misc_feature 1..66: note = chr12:110717680-110717746
  misc_feature 1..66: note = hypo
  source 1..66: mol_type = genomic DNA
tggcttctctcagtgcgttgccatatagtataattttttgtttgtttgtttcgtgtagggttttgt

SEQ ID NO: 15684 - DNA, 30 bp, Homo sapiens
  misc_feature 1..30: note = chr12:110782730-110782760
  misc_feature 1..30: note = hypo
  source 1..30: mol_type = genomic DNA
gttcattgctgctgacggtggtccaagagt

SEQ ID NO: 15685 - DNA, 41 bp, Homo sapiens
  misc_feature 1..41: note = chr12:110908130-110908171
  misc_feature 1..41: note = hypo
  source 1..41: mol_type = genomic DNA
ctgacctcgtgatccgcccgcatggccgtcctttttgtctc

SEQ ID NO: 15686 - DNA, 30 bp, Homo sapiens
  misc_feature 1..30: note = chr12:111296630-111296660
  misc_feature 1..30: note = hypo
  source 1..30: mol_type = genomic DNA
gttggggtgcatattcgtgatgccttaggc

SEQ ID NO: 15687 - DNA, 30 bp, Homo sapiens
  misc_feature 1..30: note = chr12:111369069-111369099
  misc_feature 1..30: note = hypo
  source 1..30: mol_type = genomic DNA
caggatcccagagctcggatccagcctcaa

SEQ ID NO: 15688 - DNA, 30 bp, Homo sapiens
  misc_feature 1..30: note = chr12:112628549-112628579
  misc_feature 1..30: note = hypo
  source 1..30: mol_type = genomic DNA
ccccaccctagattccgatccccagggaag

SEQ ID NO: 15689 - DNA, 16 bp, Homo sapiens
  misc_feature 1..16: note = chr12:112826001-112826017
  misc_feature 1..16: note = hypo
  source 1..16: mol_type = genomic DNA
acgagtccatctcaaa

SEQ ID NO: 15690 - DNA, 30 bp, Homo sapiens
  misc_feature 1..30: note = chr12:112919571-112919601
  misc_feature 1..30: note = hypo
  source 1..30: mol_type = genomic DNA
aggcatgagccactgcgccccagctgattc

SEQ ID NO: 15691 - DNA, 30 bp, Homo sapiens
  misc_feature 1..30: note = chr12:114240315-114240345
  misc_feature 1..30: note = hypo
  source 1..30: mol_type = genomic DNA
gggaggcgacacgcccgggtgcgctcagtt

SEQ ID NO: 15692 - DNA, 30 bp, Homo sapiens
  misc_feature 1..30: note = chr12:117474645-117474675
  misc_feature 1..30: note = hypo
  source 1..30: mol_type = genomic DNA
catctgggctccgtgcgtttgcagccttaa

SEQ ID NO: 15693 - DNA, 108 bp, Homo sapiens
  misc_feature 1..108: note = chr12:117530039-117530147
  misc_feature 1..108: note = hypo
  source 1..108: mol_type = genomic DNA
gatgagacatctgagcgaagtggcacaggacggctccagcaccgagctcagtgcacatggaacgccatcctccagggtcccgctctgtggctgcgacagatggtgaga

SEQ ID NO: 15694 - DNA, 39 bp, Homo sapiens
  misc_feature 1..39: note = chr12:117531034-117531073
  misc_feature 1..39: note = hypo
  source 1..39: mol_type = genomic DNA
aattggtgaatgagccgaggccaccgtctgaggccactt

SEQ ID NO: 15695 - DNA, 25 bp, Homo sapiens
  misc_feature 1..25: note = chr12:117532499-117532524
  misc_feature 1..25: note = hypo
  source 1..25: mol_type = genomic DNA
acaataatgagcattcgtttcataa

SEQ ID NO: 15696 - DNA, 30 bp, Homo sapiens
  misc_feature 1..30: note = chr12:118198752-118198782
  misc_feature 1..30: note = hypo
  source 1..30: mol_type = genomic DNA
caaggggcagcccctcgcaggccgggtttc

SEQ ID NO: 15697 - DNA, 85 bp, Homo sapiens
  misc_feature 1..85: note = chr12:118860397-118860482
  misc_feature 1..85: note = hypo
  source 1..85: mol_type = genomic DNA
aaagtcaaatagtagcgtgtgtttaacatacatcacaagccttgaactttttttcttttttctttttttttagacagagtcttgc

SEQ ID NO: 15698 - DNA, 30 bp, Homo sapiens
  misc_feature 1..30: note = chr12:120148366-120148396
  misc_feature 1..30: note = hypo
  source 1..30: mol_type = genomic DNA
cagttcatgtctagacggtcatcaccttcc

SEQ ID NO: 15699 - DNA, 30 bp, Homo sapiens
  misc_feature 1..30: note = chr12:120574326-120574356
  misc_feature 1..30: note = hypo
  source 1..30: mol_type = genomic DNA
tgtctcgagcagagccgccttcacattcca

SEQ ID NO: 15700 - DNA, 46 bp, Homo sapiens
  misc_feature 1..46: note = chr12:122141060-122141106
  misc_feature 1..46: note = hypo
  source 1..46: mol_type = genomic DNA
agagaagagtccctccgattcgcaacctgaccgcctggctgacctg

SEQ ID NO: 15701 - DNA, 101 bp, Homo sapiens; identical to SEQ ID NO: 1601
  misc_feature 1..101: note = chr12:122278479-122278580
  misc_feature 1..101: note = hypo
  source 1..101: mol_type = genomic DNA

SEQ ID NO: 15702 - DNA, 81 bp, Homo sapiens
  misc_feature 1..81: note = chr12:122285027-122285108
  misc_feature 1..81: note = hypo
  source 1..81: mol_type = genomic DNA
gccaccacaatggatcgcagagagctatattccgtgtgcacctgcgtgtcatccacggaccagaagcggtggaactgcagg

SEQ ID NO: 15703 - DNA, 30 bp, Homo sapiens
  misc_feature 1..30: note = chr12:122292767-122292797
  misc_feature 1..30: note = hypo
  source 1..30: mol_type = genomic DNA
gcctggtggcctctgcgtggtcctgcaggc

SEQ ID NO: 15704 - DNA, 45 bp, Homo sapiens
  misc_feature 1..45: note = chr12:122439448-122439493
  misc_feature 1..45: note = hypo
  source 1..45: mol_type = genomic DNA
gtttggcctgaatcccgagggatggaaatccgagcctgcaacctg

SEQ ID NO: 15705 - DNA, 30 bp, Homo sapiens
  misc_feature 1..30: note = chr12:122458643-122458673
  misc_feature 1..30: note = hypo
  source 1..30: mol_type = genomic DNA
ctaggaaaaggcctgcggtctctccatttc

SEQ ID NO: 15706 - DNA, 30 bp, Homo sapiens
  misc_feature 1..30: note = chr12:122602863-122602893
  misc_feature 1..30: note = hypo
  source 1..30: mol_type = genomic DNA
ggtaaagcacaataccgcagaaaagggagg

SEQ ID NO: 15707 - DNA, 30 bp, Homo sapiens
  misc_feature 1..30: note = chr12:122622042-122622072
  misc_feature 1..30: note = hypo
  source 1..30: mol_type = genomic DNA
cctctccgtgtgcatcggagcagagcccca

SEQ ID NO: 15708 - DNA, 30 bp, Homo sapiens
  misc_feature 1..30: note = chr12:122622344-122622374
  misc_feature 1..30: note = hypo
  source 1..30: mol_type = genomic DNA
aagcctgggagccaacgctgagtccacgta

SEQ ID NO: 15709 - DNA, 28 bp, Homo sapiens
  misc_feature 1..28: note = chr12:124117199-124117227
  misc_feature 1..28: note = hypo
  source 1..28: mol_type = genomic DNA
aaagctactggtggccgggcgcggtggc

SEQ ID NO: 15710 - DNA, 30 bp, Homo sapiens
  misc_feature 1..30: note = chr12:124404180-124404210
  misc_feature 1..30: note = hypo
  source 1..30: mol_type = genomic DNA
gtccctggcagtcaccgctctgccttccat

SEQ ID NO: 15711 - DNA, 173 bp, Homo sapiens
  misc_feature 1..173: note = chr12:124778198-124778371
  misc_feature 1..173: note = hypo
  source 1..173: mol_type = genomic DNA
gcagcagacttccagcgttctttcctgggcgacatggaaatgggctgtaaattcacctggtgacaggtgcatgcctgtcaccctgtgggctctcaggaagcggccccaccctctgtcagtgtccggcatgcaccttactcctgctgctgcagggcctgcgccctgctgttccc

SEQ ID NO: 15712 - DNA, 30 bp, Homo sapiens
  misc_feature 1..30: note = chr12:124843833-124843863
  misc_feature 1..30: note = hypo
  source 1..30: mol_type = genomic DNA
tgtcatctatcacgccgcctccagatgaac

SEQ ID NO: 15713 - DNA, 46 bp, Homo sapiens
  misc_feature 1..46: note = chr12:124893479-124893525
  misc_feature 1..46: note = hypo
  source 1..46: mol_type = genomic DNA
ccagttccaagtcagcggcagcacgttgtcacgtggcactgggcac

SEQ ID NO: 15714 - DNA, 54 bp, Homo sapiens
  misc_feature 1..54: note = chr12:125009346-125009400
  misc_feature 1..54: note = hypo
  source 1..54: mol_type = genomic DNA
tgaatgcctgaacctcgtcctcacaaccctcaccacccgcgatagcacttgctt

SEQ ID NO: 15715 - DNA, 41 bp, Homo sapiens
  misc_feature 1..41: note = chr12:125092426-125092467
  misc_feature 1..41: note = hypo
  source 1..41: mol_type = genomic DNA
ccgaaagccaagctccgtgtccatcgcgaaggcactgggca

SEQ ID NO: 15716 - DNA, 33 bp, Homo sapiens
  misc_feature 1..33: note = chr12:125102143-125102176
  misc_feature 1..33: note = hypo
  source 1..33: mol_type = genomic DNA
ggagccccccaaccccggcgtgcccccattttg

SEQ ID NO: 15717 - DNA, 30 bp, Homo sapiens
  misc_feature 1..30: note = chr12:125119323-125119353
  misc_feature 1..30: note = hypo
  source 1..30: mol_type = genomic DNA
ctttgctctgtgtcccgtggttacaaaatg

SEQ ID NO: 15718 - DNA, 59 bp, Homo sapiens
  misc_feature 1..59: note = chr12:125152108-125152167
  misc_feature 1..59: note = hypo
  source 1..59: mol_type = genomic DNA
cttgctaaatgcttgcgtagtgaggcccctgcatctccttttgccgagactgggggagg

SEQ ID NO: 15719 - DNA, 30 bp, Homo sapiens
  misc_feature 1..30: note = chr12:125167715-125167745
  misc_feature 1..30: note = hypo
  source 1..30: mol_type = genomic DNA
tttatctacctgccacgtcctgagtgtcta

SEQ ID NO: 15720 - DNA, 27 bp, Homo sapiens
  misc_feature 1..27: note = chr12:126243097-126243124
  misc_feature 1..27: note = hypo
  source 1..27: mol_type = genomic DNA
catgagccaccgcgcccggctgatgat

SEQ ID NO: 15721 - DNA, 35 bp, Homo sapiens
  misc_feature 1..35: note = chr12:128311016-128311051
  misc_feature 1..35: note = hypo
  source 1..35: mol_type = genomic DNA
ctgcagaccttcgcagtgaacgttacagctcttaa

SEQ ID NO: 15722 - DNA, 122 bp, Homo sapiens
  misc_feature 1..122: note = chr12:128899719-128899841
  misc_feature 1..122: note = hypo
  source 1..122: mol_type = genomic DNA
gaaaccagagaggtgcggggcagctgccggctgaagggggacctggggctgtgtgtggctgagctggagctcctgtccagctggttcagtgccccgacggtgggtgccgggaggaagaagtc

SEQ ID NO: 15723 - DNA, 301 bp, Homo sapiens; identical to SEQ ID NO: 5141
  misc_feature 1..301: note = chr12:130821371-130821672
  misc_feature 1..301: note = hypo
  source 1..301: mol_type = genomic DNA

SEQ ID NO: 15724 - DNA, 30 bp, Homo sapiens
  misc_feature 1..30: note = chr12:130920621-130920651
  misc_feature 1..30: note = hypo
  source 1..30: mol_type = genomic DNA
caggagagatgagagcgggttctgggtggg

SEQ ID NO: 15725 - DNA, 36 bp, Homo sapiens
  misc_feature 1..36: note = chr12:131268446-131268482
  misc_feature 1..36: note = hypo
  source 1..36: mol_type = genomic DNA
gatgagggacatcaacgcctacgtaccagagacagg

SEQ ID NO: 15726 - DNA, 30 bp, Homo sapiens
  misc_feature 1..30: note = chr12:131433415-131433445
  misc_feature 1..30: note = hypo
  source 1..30: mol_type = genomic DNA
ggctcgagtacctcacgtttctgggtgctt

SEQ ID NO: 15727 - DNA, 27 bp, Homo sapiens
  misc_feature 1..27: note = chr12:131547329-131547356
  misc_feature 1..27: note = hypo
  source 1..27: mol_type = genomic DNA
atacaagggtcacgtggtaaatatatt

SEQ ID NO: 15728 - DNA, 177 bp, Homo sapiens
  misc_feature 1..177: note = chr12:132044061-132044238
  misc_feature 1..177: note = hypo
  source 1..177: mol_type = genomic DNA
tctatgaaccagcagcgctgaggtcactggtgctgaggccatgggactcgtggaggtgttctgtccatgggagagaagccctgagcatctgggagccatgaggaggaatctccagagacaaacgggagaattaaccagaggccccgccccattatcataactcggctccactcacat

SEQ ID NO: 15729 - DNA, 30 bp, Homo sapiens
  misc_feature 1..30: note = chr12:132168275-132168305
  misc_feature 1..30: note = hypo
  source 1..30: mol_type = genomic DNA
tggggccgtgcctggcgctaggaggtgagc

SEQ ID NO: 15730 - DNA, 522 bp, Homo sapiens; identical to SEQ ID NO: 1602
  misc_feature 1..522: note = chr12:132221602-132222124
  misc_feature 1..522: note = hypo
  source 1..522: mol_type = genomic DNA

SEQ ID NO: 15731 - DNA, 30 bp, Homo sapiens
  misc_feature 1..30: note = chr12:132240239-132240269
  misc_feature 1..30: note = hypo
  source 1..30: mol_type = genomic DNA
attgtttgtccagcacgttctaaacaaaca

SEQ ID NO: 15732 - DNA, 133 bp, Homo sapiens
  misc_feature 1..133: note = chr12:132280877-132281010
  misc_feature 1..133: note = hypo
  source 1..133: mol_type = genomic DNA
agaccaggtggaagccgaagggtcggcctctccaggcaggagagaaggatgatctaagggcaggtgcaggccagaatgtctggaaagcatttctggtgcgggattgccagtttggtgacgtggactctgggaa

SEQ ID NO: 15733 - DNA, 30 bp, Homo sapiens
  misc_feature 1..30: note = chr12:132284463-132284493
  misc_feature 1..30: note = hypo
  source 1..30: mol_type = genomic DNA
gcctcctgcggtcaccgcacaccccttctt

SEQ ID NO: 15734 - DNA, 118 bp, Homo sapiens
  misc_feature 1..118: note = chr12:132329877-132329995
  misc_feature 1..118: note = hypo
  source 1..118: mol_type = genomic DNA
tggtgtccctgcagccggcacagatgcaccgcttctggcggggcctgccgctgcacctggacagcgtggacgccgtgtacgagcgcaccagcgaccacaagatcgtcttctttaaagg

SEQ ID NO: 15735 - DNA, 30 bp, Homo sapiens
  misc_feature 1..30: note = chr12:132333412-132333442
  misc_feature 1..30: note = hypo
  source 1..30: mol_type = genomic DNA
gcgtgagtgtgcaaacgtctctccaagacc

SEQ ID NO: 15736 - DNA, 52 bp, Homo sapiens
  misc_feature 1..52: note = chr12:132377978-132378030
  misc_feature 1..52: note = hypo
  source 1..52: mol_type = genomic DNA
gcactaacttttccccggtcctctctcccagagcaatcgctgttggctgtgt

SEQ ID NO: 15737 - DNA, 158 bp, Homo sapiens; identical to SEQ ID NO: 5143
  misc_feature 1..158: note = chr12:132423555-132423713
  misc_feature 1..158: note = hypo
  source 1..158: mol_type = genomic DNA

SEQ ID NO: 15738 - DNA, 130 bp, Homo sapiens
  misc_feature 1..130: note = chr12:132617233-132617363
  misc_feature 1..130: note = hypo
  source 1..130: mol_type = genomic DNA
tgggatgtgccaaaccgctgcgtggagcctgggctgacttctctggatcttggtgcaactggcgtggcccttccaggaagccgggccacctggctcagagacgccagaccctggccggcaatggggctgc

SEQ ID NO: 15739 - DNA, 67 bp, Homo sapiens
  misc_feature 1..67: note = chr12:132643941-132644008
  misc_feature 1..67: note = hypo
  source 1..67: mol_type = genomic DNA
ttcgctgtggccccccggggtctgtcccctgcagcactgttctctgggggctcgtggtccgagttct

SEQ ID NO: 15740 - DNA, 48 bp, Homo sapiens
  misc_feature 1..48: note = chr12:132682618-132682666
  misc_feature 1..48: note = hypo
  source 1..48: mol_type = genomic DNA
tggagcctcccaccccggggacgctgttgcgggcgggagaggaccgcc

SEQ ID NO: 15741 - DNA, 30 bp, Homo sapiens
  misc_feature 1..30: note = chr12:132688204-132688234
  misc_feature 1..30: note = hypo
  source 1..30: mol_type = genomic DNA
gcacctccatgctgccgccacactgccaca

SEQ ID NO: 15742 - DNA, 174 bp, Homo sapiens
  misc_feature 1..174: note = chr12:132986465-132986639
  misc_feature 1..174: note = hypo
  source 1..174: mol_type = genomic DNA
ccgtcctgtgggtgacggcagaacatctggctgccgggtggcctccgtaaccgccacacacctgcctctgctggaatcacctgaggctctggtgcctcacacggattggccaaaacagggagcggagccgggaaggccacggacatctgtgtggtgtcacgaacaaggtccggc

SEQ ID NO: 15743 - DNA, 101 bp, Homo sapiens
  misc_feature 1..101: note = chr12:133002917-133003018
  misc_feature 1..101: note = hypo
  source 1..101: mol_type = genomic DNA
cactggcatgtctgccgacgtgcgattttccagcctttccctagagctgcggtttcgtcaggttcatggtccaacttccaagttgccgagtccagtctgac

SEQ ID NO: 15744 - DNA, 30 bp, Homo sapiens
  misc_feature 1..30: note = chr12:133100990-133101020
  misc_feature 1..30: note = hypo
  source 1..30: mol_type = genomic DNA
aattcgcactggcaccgtctgccttgtgtg

SEQ ID NO: 15745 - DNA, 30 bp, Homo sapiens
  misc_feature 1..30: note = chr12:133122176-133122206
  misc_feature 1..30: note = hypo
  source 1..30: mol_type = genomic DNA
cagacctgaaacccacggggagatccgtaa

SEQ ID NO: 15746 - DNA, 30 bp, Homo sapiens
  misc_feature 1..30: note = chr12:133169847-133169877
  misc_feature 1..30: note = hypo
  source 1..30: mol_type = genomic DNA
gggcctgcatagaaacggaagctcacagtc

SEQ ID NO: 15747 - DNA, 102 bp, Homo sapiens
  misc_feature 1..102: note = chr12:133188357-133188459
  misc_feature 1..102: note = hypo
  source 1..102: mol_type = genomic DNA
ctgtgctcagctgggcggttctcacacgtgttgcttaggcatcagctttcaggtagtttgactgtgctcagctgggcggttctcacacgtgttgcttaggca

SEQ ID NO: 15748 - DNA, 30 bp, Homo sapiens
  misc_feature 1..30: note = chr12:133200007-133200037
  misc_feature 1..30: note = hypo
  source 1..30: mol_type = genomic DNA
gctgactggcgcccacggctgcaccgggcg

SEQ ID NO: 15749 - DNA, 30 bp, Homo sapiens
  misc_feature 1..30: note = chr12:133705743-133705773
  misc_feature 1..30: note = hypo
  source 1..30: mol_type = genomic DNA
atctaaaacagaatacgaactaaaaaacct

SEQ ID NO: 15750 - DNA, 82 bp, Homo sapiens
  misc_feature 1..82: note = chr13:19517769-19517851
  misc_feature 1..82: note = hypo
  source 1..82: mol_type = genomic DNA
accccctgggccccacgcaggggctgcagggaaggcactggcctctgagggatgatcccagcctcctcggcctcaccgcttt

SEQ ID NO: 15751 - DNA, 81 bp, Homo sapiens
  misc_feature 1..81: note = chr13:20078191-20078272
  misc_feature 1..81: note = hypo
  source 1..81: mol_type = genomic DNA
tatttatgtctcacagttcactgatagctccactccagggtactgatttgaatttagacttggcagcgctacagaatttaa

SEQ ID NO: 15752 - DNA, 15 bp, Homo sapiens
  misc_feature 1..15: note = chr13:20692250-20692265
  misc_feature 1..15: note = hypo
  source 1..15: mol_type = genomic DNA
cgtgagccactgcgc

SEQ ID NO: 15753 - DNA, 71 bp, Homo sapiens
  misc_feature 1..71: note = chr13:25670585-25670656
  misc_feature 1..71: note = hypo
  source 1..71: mol_type = genomic DNA
atcatgtggtctcagcgtgatccatcacttcgaaaaagtggagtgggcaacatattcgttaaaaatctgga

SEQ ID NO: 15754 - DNA, 33 bp, Homo sapiens
  misc_feature 1..33: note = chr13:28240066-28240099
  misc_feature 1..33: note = hypo
  source 1..33: mol_type = genomic DNA
gaaaagcggtccaaccggcggtgaggctggaac

SEQ ID NO: 15755 - DNA, 23 bp, Homo sapiens
  misc_feature 1..23: note = chr13:30149065-30149088
  misc_feature 1..23: note = hypo
  source 1..23: mol_type = genomic DNA
ccaccgtgcgtggccagagcagc

SEQ ID NO: 15756 - DNA, 94 bp, Homo sapiens
  misc_feature 1..94: note = chr13:30707267-30707361
  misc_feature 1..94: note = hypo
  source 1..94: mol_type = genomic DNA
gctgggagaaggtcccggggatcactcctcctaggccgccggggcagtctctccagccaccctctttccccagagccagcgggctggggttctt

SEQ ID NO: 15757 - DNA, 30 bp, Homo sapiens
  misc_feature 1..30: note = chr13:30761001-30761031
  misc_feature 1..30: note = hypo
  source 1..30: mol_type = genomic DNA
attaacaagccagagcgggggcaccagagt

SEQ ID NO: 15758 - DNA, 33 bp, Homo sapiens
  misc_feature 1..33: note = chr13:31742917-31742950
  misc_feature 1..33: note = hypo
  source 1..33: mol_type = genomic DNA
cccaggcagataacccgccggctggtgcctccc

SEQ ID NO: 15759 - DNA, 233 bp, Homo sapiens
  misc_feature 1..233: note = chr13:37643739-37643972
  misc_feature 1..233: note = hypo
  source 1..233: mol_type = genomic DNA
acccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctatgaggccaggccaagtcgcccagcccagagg

SEQ ID NO: 15760 - DNA, 53 bp, Homo sapiens
  misc_feature 1..53: note = chr13:41681520-41681573
  misc_feature 1..53: note = hypo
  source 1..53: mol_type = genomic DNA
gggcagggctgcagccgcccaaaatgcagcaatggatccgagcctccctgtac

SEQ ID NO: 15761 - DNA, 30 bp, Homo sapiens
  misc_feature 1..30: note = chr13:45564773-45564803
  misc_feature 1..30: note = hypo
  source 1..30: mol_type = genomic DNA
tttgtagactagcaccgacacccagttgga

SEQ ID NO: 15762 - DNA, 22 bp, Homo sapiens
  misc_feature 1..22: note = chr13:45905242-45905264
  misc_feature 1..22: note = hypo
  source 1..22: mol_type = genomic DNA
cttttgtcgatttgtcttttgt

SEQ ID NO: 15763 - DNA, 30 bp, Homo sapiens
  misc_feature 1..30: note = chr13:46659310-46659340
  misc_feature 1..30: note = hypo
  source 1..30: mol_type = genomic DNA
ctttgatatttataacgctttgatatagac

SEQ ID NO: 15764 - DNA, 30 bp, Homo sapiens
  misc_feature 1..30: note = chr13:46661314-46661344
  misc_feature 1..30: note = hypo
  source 1..30: mol_type = genomic DNA
ggagcatgaggctgccgccctgccatcaca

SEQ ID NO: 15765 - DNA, 172 bp, Homo sapiens
  misc_feature 1..172: note = chr13:46920144-46920316
  misc_feature 1..172: note = hypo
  source 1..172: mol_type = genomic DNA
ctgttggctcagctgcgaaaattctcactcactcggcaagcctatgacttccaaatgcacgagtcaggcactgagcttaaggctcatgcagccaactgccagtggtcatggtccctagggcattcaaaacttcatcttctccaaacccggcaggtgtcgacctgaattctct

SEQ ID NO: 15766 - DNA, 30 bp, Homo sapiens
  misc_feature 1..30: note = chr13:48667877-48667907
  misc_feature 1..30: note = hypo
  source 1..30: mol_type = genomic DNA
ctgtctaggtgttttcgggttttcttccat

SEQ ID NO: 15767 - DNA, 35 bp, Homo sapiens
  misc_feature 1..35: note = chr13:49923030-49923065
  misc_feature 1..35: note = hypo
  source 1..35: mol_type = genomic DNA
cctccagggagaccacgccccgtccctcaccctcc

SEQ ID NO: 15768 - DNA, 24 bp, Homo sapiens
  misc_feature 1..24: note = chr13:50367862-50367886
  misc_feature 1..24: note = hypo
  source 1..24: mol_type = genomic DNA
gggtgtggtggctcacgcctgtaa

SEQ ID NO: 15769 - DNA, 20 bp, Homo sapiens
  misc_feature 1..20: note = chr13:96031715-96031735
  misc_feature 1..20: note = hypo
  source 1..20: mol_type = genomic DNA
atgaccggccgggcacggtg

SEQ ID NO: 15770 - DNA, 81 bp, Homo sapiens
  misc_feature 1..81: note = chr13:100356871-100356952
  misc_feature 1..81: note = hypo
  source 1..81: mol_type = genomic DNA
tatgagccaggtgctcgactgtgtacaaacttagaagaaccaggtgcacacgccaggtttgggggccgtttgacagtcagc

SEQ ID NO: 15771 - DNA, 23 bp, Homo sapiens
  misc_feature 1..23: note = chr13:103569159-103569182
  misc_feature 1..23: note = hypo
  source 1..23: mol_type = genomic DNA
accgcgcccggccgtcccccgtt

SEQ ID NO: 15772 - DNA, 462 bp, Homo sapiens; identical to SEQ ID NO: 5145
  misc_feature 1..462: note = chr13:110434424-110434886
  misc_feature 1..462: note = hypo
  source 1..462: mol_type = genomic DNA

SEQ ID NO: 15773 - DNA, 251 bp, Homo sapiens
  misc_feature 1..251: note = chr13:110435933-110436184
  misc_feature 1..251: note = hypo
  source 1..251: mol_type = genomic DNA
actggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactg

SEQ ID NO: 15774 - DNA, 34 bp, Homo sapiens
  misc_feature 1..34: note = chr13:110436410-110436444
  misc_feature 1..34: note = hypo
  source 1..34: mol_type = genomic DNA
ccgcgagggccgcgccgggcgtcatgggcatgta

SEQ ID NO: 15775 - DNA, 40 bp, Homo sapiens
  misc_feature 1..40: note = chr13:111277585-111277625
  misc_feature 1..40: note = hypo
  source 1..40: mol_type = genomic DNA
ttaaggcctacagcccggagctgatcgtccacccagttct

SEQ ID NO: 15776 - DNA, 35 bp, Homo sapiens; identical to SEQ ID NO: 5146
  misc_feature 1..35: note = chr13:111278361-111278396
  misc_feature 1..35: note = hypo
  source 1..35: mol_type = genomic DNA

SEQ ID NO: 15777 - DNA, 56 bp, Homo sapiens
  misc_feature 1..56: note = chr13:111289222-111289278
  misc_feature 1..56: note = hypo
  source 1..56: mol_type = genomic DNA
tgctgtgctacacagcggggtctggggcagcctcaccactgcgtgtcttggtttcc

SEQ ID NO: 15778 - DNA, 30 bp, Homo sapiens
  misc_feature 1..30: note = chr13:111978886-111978916
  misc_feature 1..30: note = hypo
  source 1..30: mol_type = genomic DNA
ggagactgcgggcaacgcgagcctggtgct

SEQ ID NO: 15779 - DNA, 45 bp, Homo sapiens
  misc_feature 1..45: note = chr13:113107030-113107075
  misc_feature 1..45: note = hypo
  source 1..45: mol_type = genomic DNA
actcctggcagcagacggaagggcggctgccgggccctcagaccc

SEQ ID NO: 15780 - DNA, 30 bp, Homo sapiens
  misc_feature 1..30: note = chr13:113400400-113400430
  misc_feature 1..30: note = hypo
  source 1..30: mol_type = genomic DNA
tgatggactcttgggcgtctgccgtaggcc

SEQ ID NO: 15781 - DNA, 101 bp, Homo sapiens
  misc_feature 1..101: note = chr13:113598563-113598664
  misc_feature 1..101: note = hypo
  source 1..101: mol_type = genomic DNA
atgaagggagggtcccgggtgaagagcaagctcatgaccctcatttactgggaatccattgctctggccccgtcatgagtggggttcgcagactgggccaa

SEQ ID NO: 15782 - DNA, 30 bp, Homo sapiens
  misc_feature 1..30: note = chr13:113776004-113776034
  misc_feature 1..30: note = hypo
  source 1..30: mol_type = genomic DNA
gaggaccaggctgtgcgtggtgcccgccgt

SEQ ID NO: 15783 - DNA, 30 bp, Homo sapiens
  misc_feature 1..30: note = chr13:113985679-113985709
  misc_feature 1..30: note = hypo
  source 1..30: mol_type = genomic DNA
gagtgaccacagctgcggggctgggatacc

SEQ ID NO: 15784 - DNA, 55 bp, Homo sapiens
  misc_feature 1..55: note = chr13:114055958-114056013
  misc_feature 1..55: note = hypo
  source 1..55: mol_type = genomic DNA
gggagctgtggggaccggccccccagagctcagcacagcccggccctccttccag

SEQ ID NO: 15785 - DNA, 141 bp, Homo sapiens
  misc_feature 1..141: note = chr13:114060112-114060253
  misc_feature 1..141: note = hypo
  source 1..141: mol_type = genomic DNA
ctctggggtggctttcggacaaggctctgcttccccactggcccagcgtctctggctctcccgctgtgcggtctccagggctctgggtgctgcctggcgctggtgcaggcgtggcgcggctcgcaacgctccctgcagctg

SEQ ID NO: 15786 - DNA, 575 bp, Homo sapiens
  misc_feature 1..575: note = chr13:114074574-114075149
  misc_feature 1..575: note = hypo
  source 1..575: mol_type = genomic DNA
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggagagggaagcccactttccggtaagcgggcaaaacaggtactacgaccgtgttacttatgctagcaacagttccgacttaccttaattgggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccct

SEQ ID NO: 15787 - DNA, 43 bp, Homo sapiens
  misc_feature 1..43: note = chr13:114122929-114122972
  misc_feature 1..43: note = hypo
  source 1..43: mol_type = genomic DNA
tctccttcagacaagcggcctatgaggacgcagcactaaaggg

SEQ ID NO: 15788 - DNA, 86 bp, Homo sapiens
  misc_feature 1..86: note = chr13:114188403-114188489
  misc_feature 1..86: note = hypo
  source 1..86: mol_type = genomic DNA
ttcttttttcactagcggcggtttttcttttatgtcttgttataaagaagtatctcattggaccctattatcggaagctgcacatg

SEQ ID NO: 15789 - DNA, 37 bp, Homo sapiens
  misc_feature 1..37: note = chr13:114221622-114221659
  misc_feature 1..37: note = hypo
  source 1..37: mol_type = genomic DNA
taaaccaccagtttccgacttctgtactaaaacatgt

SEQ ID NO: 15790 - DNA, 30 bp, Homo sapiens
  misc_feature 1..30: note = chr13:114271940-114271970
  misc_feature 1..30: note = hypo
  source 1..30: mol_type = genomic DNA
gctcacctgcagagccgctcacctgcagag

SEQ ID NO: 15791 - DNA, 159 bp, Homo sapiens; identical to SEQ ID NO: 5147
  misc_feature 1..159: note = chr13:114304752-114304911
  misc_feature 1..159: note = hypo
  source 1..159: mol_type = genomic DNA

SEQ ID NO: 15792 - DNA, 230 bp, Homo sapiens
  misc_feature 1..230: note = chr13:114497859-114498089
  misc_feature 1..230: note = hypo
  source 1..230: mol_type = genomic DNA
cgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagttctgtgaaagaagccccgacctcgagctgggactttgaattggtttgcgtttgaaaaccggggttggtaaaag

SEQ ID NO: 15793 - DNA, 106 bp, Homo sapiens
  misc_feature 1..106: note = chr13:114526504-114526610
  misc_feature 1..106: note = hypo
  source 1..106: mol_type = genomic DNA
acgtccagaggggtccgcactgcaatgaaagcggtgcattatagggtggtatgcacggtggagaggccacagtgaggtcggagcagggcctcgagagatgcagtcc

SEQ ID NO: 15794 - DNA, 30 bp, Homo sapiens
  misc_feature 1..30: note = chr13:114746822-114746852
  misc_feature 1..30: note = hypo
  source 1..30: mol_type = genomic DNA
ccactgtcagagcagcgctgcccatcacca

SEQ ID NO: 15795 - DNA, 265 bp, Homo sapiens; identical to SEQ ID NO: 5148
  misc_feature 1..265: note = chr13:114748399-114748664
  misc_feature 1..265: note = hypo
  source 1..265: mol_type = genomic DNA

SEQ ID NO: 15796 - DNA, 30 bp, Homo sapiens
  misc_feature 1..30: note = chr13:114749034-114749064
  misc_feature 1..30: note = hypo
  source 1..30: mol_type = genomic DNA
gcaagtacatgtgcacgtgtgctctccctg

SEQ ID NO: 15797 - DNA, 44 bp, Homo sapiens
  misc_feature 1..44: note = chr13:114760951-114760995
  misc_feature 1..44: note = hypo
  source 1..44: mol_type = genomic DNA
tggccacaacaacagcgaggtgcatctcacggagcataaccagg

SEQ ID NO: 15798 - DNA, 38 bp, Homo sapiens
  misc_feature 1..38: note = chr13:114765164-114765202
  misc_feature 1..38: note = hypo
  source 1..38: mol_type = genomic DNA
agtgggtgcgggccccgctgtcccggctggggtccggg

SEQ ID NO: 15799 - DNA, 184 bp, Homo sapiens
  misc_feature 1..184: note = chr13:114769986-114770170
  misc_feature 1..184: note = hypo
  source 1..184: mol_type = genomic DNA
tgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatgg

SEQ ID NO: 15800 - DNA, 30 bp, Homo sapiens
  misc_feature 1..30: note = chr13:114771035-114771065
  misc_feature 1..30: note = hypo
  source 1..30: mol_type = genomic DNA
tgagcaaagagccctcgggagcctggaggg

SEQ ID NO: 15801 - DNA, 528 bp, Homo sapiens; identical to SEQ ID NO: 1603
  misc_feature 1..528: note = chr13:114780555-114781083
  misc_feature 1..528: note = hypo
  source 1..528: mol_type = genomic DNA

SEQ ID NO: 15802 - DNA, 146 bp, Homo sapiens
  misc_feature 1..146: note = chr13:114807701-114807847
  misc_feature 1..146: note = hypo
  source 1..146: mol_type = genomic DNA
ccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctaggg

SEQ ID NO: 15803 - DNA, 18 bp, Homo sapiens
  misc_feature 1..18: note = chr13:114812180-114812198
  misc_feature 1..18: note = hypo
  source 1..18: mol_type = genomic DNA
gtccgagccctgccttca

SEQ ID NO: 15804 - DNA, 186 bp, Homo sapiens
  misc_feature 1..186: note = chr13:114855483-114855669
  misc_feature 1..186: note = hypo
  source 1..186: mol_type = genomic DNA
atgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaa

SEQ ID NO: 15805 - DNA, 80 bp, Homo sapiens
  misc_feature 1..80: note = chr13:114961773-114961853
  misc_feature 1..80: note = hypo
  source 1..80: mol_type = genomic DNA
gaatccctggtgccacgaaagaccccagagcagcacaatctgagctcactctgtttccaatactgcgcccaggtaacgct

SEQ ID NO: 15806 - DNA, 18 bp, Homo sapiens
  misc_feature 1..18: note = chr14:21289138-21289156
  misc_feature 1..18: note = hypo
  source 1..18: mol_type = genomic DNA
agcactttgagaggccga

SEQ ID NO: 15807 - DNA, 121 bp, Homo sapiens
  misc_feature 1..121: note = chr14:23707517-23707638
  misc_feature 1..121: note = hypo
  source 1..121: mol_type = genomic DNA
gaacaaataggacaacgaagctcgtggcactgtgggatgcgtttgcgttgagctgtttattcagtacattttttatcgtaaatcttacgaagtttgtatccctcagcggttacacacacac

SEQ ID NO: 15808 - DNA, 198 bp, Homo sapiens; identical to SEQ ID NO: 5150
  misc_feature 1..198: note = chr14:23776958-23777156
  misc_feature 1..198: note = hypo
  source 1..198: mol_type = genomic DNA

SEQ ID NO: 15809 - DNA, 153 bp, Homo sapiens
  misc_feature 1..153: note = chr14:24862082-24862235
  misc_feature 1..153: note = hypo
  source 1..153: mol_type = genomic DNA
aaagtctcccctttgcgggggcaagcagggtagtatcaggttacctgtcctctaacctggactccagtgatctaaaacaatcggaaggacactcctgacagtagtagtctctgttgttgttctccttctcctcctcctcttctctctctctct

SEQ ID NO: 15810 - DNA, 37 bp, Homo sapiens; identical to SEQ ID NO: 5151
  misc_feature 1..37: note = chr14:31027390-31027427
  misc_feature 1..37: note = hypo
  source 1..37: mol_type = genomic DNA

SEQ ID NO: 15811 - DNA, 38 bp, Homo sapiens
  misc_feature 1..38: note = chr14:32597741-32597779
  misc_feature 1..38: note = hypo
  source 1..38: mol_type = genomic DNA
gtgctgaggctggcccgcctctgcgtgggcaggatctt

SEQ ID NO: 15812 - DNA, 45 bp, Homo sapiens
  misc_feature 1..45: note = chr14:34921211-34921256
  misc_feature 1..45: note = hypo
  source 1..45: mol_type = genomic DNA
tagcgtggtggctcacgcctgtaatcccatgccagcactttggga

SEQ ID NO: 15813 - DNA, 136 bp, Homo sapiens
  misc_feature 1..136: note = chr14:35023186-35023322
  misc_feature 1..136: note = hypo
  source 1..136: mol_type = genomic DNA
agaagaattcgtccattcaacaaccgttcactgagcgcatagcctgtgcccagacactgttccaggcctctgggagcaaaaaggcctcggtgcccgtattctagttagacaacgagaagcgcggggaggtgggggg

SEQ ID NO: 15814 - DNA, 35 bp, Homo sapiens
  misc_feature 1..35: note = chr14:35507705-35507740
  misc_feature 1..35: note = hypo
  source 1..35: mol_type = genomic DNA
ttacgaatagagcgccgcccgggaggcagcggctg

SEQ ID NO: 15815 - DNA, 30 bp, Homo sapiens
  misc_feature 1..30: note = chr14:35866882-35866912
  misc_feature 1..30: note = hypo
  source 1..30: mol_type = genomic DNA
gctttcatctcatcacgcctttccatgcag

SEQ ID NO: 15816 - DNA, 30 bp, Homo sapiens
  misc_feature 1..30: note = chr14:50098049-50098079
  misc_feature 1..30: note = hypo
  source 1..30: mol_type = genomic DNA
cagaagatttgcagccgggcgcggtggctc

SEQ ID NO: 15817 - DNA, 120 bp, Homo sapiens
  misc_feature 1..120: note = chr14:50333967-50334087
  misc_feature 1..120: note = hypo
  source 1..120: mol_type = genomic DNA
cgtgagccaccgcgcccggccagccgtttgcttttttaacagtgcaaaaaacaaggccgtgtctggctatatggggctttgcttgttcaaaatgtaacctctatacggccgcgcgcagtg

SEQ ID NO: 15818 - DNA, 28 bp, Homo sapiens
  misc_feature 1..28: note = chr14:50334327-50334355
  misc_feature 1..28: note = hypo
  source 1..28: mol_type = genomic DNA
ctgggcaagactccgtctcaaaaaaaaa

SEQ ID NO: 15819 - DNA, 37 bp, Homo sapiens
  misc_feature 1..37: note = chr14:50433979-50434016
  misc_feature 1..37: note = hypo
  source 1..37: mol_type = genomic DNA
tacaggtgtaagccaccacacccggcccattcaggtc

SEQ ID NO: 15820 - DNA, 36 bp, Homo sapiens
  misc_feature 1..36: note = chr14:50681821-50681857
  misc_feature 1..36: note = hypo
  source 1..36: mol_type = genomic DNA
gggattacaggcgtgagccaccgcgcccggcaaggt

SEQ ID NO: 15821 - DNA, 15 bp, Homo sapiens
  misc_feature 1..15: note = chr14:54956536-54956551
  misc_feature 1..15: note = hypo
  source 1..15: mol_type = genomic DNA
cgctgggatcacagg

SEQ ID NO: 15822 - DNA, 30 bp, Homo sapiens
  misc_feature 1..30: note = chr14:55664068-55664098
  misc_feature 1..30: note = hypo
  source 1..30: mol_type = genomic DNA
agtgctgtatgccagcgtattttgtttctt

SEQ ID NO: 15823 - DNA, 234 bp, Homo sapiens
  misc_feature 1..234: note = chr14:55765372-55765606
  misc_feature 1..234: note = hypo
  source 1..234: mol_type = genomic DNA
tggagggggtaaggccggcaagggcggcctgaccctccaggaggccatccagcggctgcgggacacggaggagatgttaagcaagaaacaggagttcctggagaagaaaatcgagcagaggcacggcaccaaaaacaagcccgcggccctccaggcactgaagcgtaagaagaggtatgagaagcagctggcgcagatcgacggtacattatcaaccatcgagttccagcagca

SEQ ID NO: 15824 - DNA, 30 bp, Homo sapiens
  misc_feature 1..30: note = chr14:57045757-57045787
  misc_feature 1..30: note = hypo
  source 1..30: mol_type = genomic DNA
gattctttttttttgcgttacagctcattg

SEQ ID NO: 15825 - DNA, 23 bp, Homo sapiens
  misc_feature 1..23: note = chr14:58599589-58599612
  misc_feature 1..23: note = hypo
  source 1..23: mol_type = genomic DNA
actgcgcccggccaacccttgtc

SEQ ID NO: 15826 - DNA, 24 bp, Homo sapiens
  misc_feature 1..24: note = chr14:58893204-58893228
  misc_feature 1..24: note = hypo
  source 1..24: mol_type = genomic DNA
gagccaccgcgctcagactttaaa

SEQ ID NO: 15827 - DNA, 30 bp, Homo sapiens
  misc_feature 1..30: note = chr14:65233318-65233348
  misc_feature 1..30: note = hypo
  source 1..30: mol_type = genomic DNA
ggggaggatggagggcggggctgcgccagc

SEQ ID NO: 15828 - DNA, 96 bp, Homo sapiens
  misc_feature 1..96: note = chr14:65239506-65239602
  misc_feature 1..96: note = hypo
  source 1..96: mol_type = genomic DNA
ggtctgcccacatctcgttcagcccgtccttccactcggcgatggtggccgcctcgctgtggcccgcgtcgatgagtcgctcgatgaaggcattca

SEQ ID NO: 15829 - DNA, 64 bp, Homo sapiens
  misc_feature 1..64: note = chr14:65406323-65406387
  misc_feature 1..64: note = hypo
  source 1..64: mol_type = genomic DNA
caggccacatctgagcggcgcacagggctccaaatgatgagcttgggatcggtcatgagggaaa

SEQ ID NO: 15830 - DNA, 83 bp, Homo sapiens; identical to SEQ ID NO: 5152
  misc_feature 1..83: note = chr14:67886562-67886645
  misc_feature 1..83: note = hypo
  source 1..83: mol_type = genomic DNA

SEQ ID NO: 15831 - DNA, 91 bp, Homo sapiens
  misc_feature 1..91: note = chr14:68067690-68067781
  misc_feature 1..91: note = hypo
  source 1..91: mol_type = genomic DNA
actcttttcctgtgccgggtagtttgaggtgcttgaggatgcagcagtgaacgatgttgatgacagtctctgccctcgggcagcttccttt

SEQ ID NO: 15832 - DNA, 21 bp, Homo sapiens
  misc_feature 1..21: note = chr14:69866541-69866562
  misc_feature 1..21: note = hypo
  source 1..21: mol_type = genomic DNA
aaatggagggctgggcgcggt

SEQ ID NO: 15833 - DNA, 30 bp, Homo sapiens
  misc_feature 1..30: note = chr14:72892242-72892272
  misc_feature 1..30: note = hypo
  source 1..30: mol_type = genomic DNA
aaatagaataaataccgatggccaataaat

SEQ ID NO: 15834 - DNA, 74 bp, Homo sapiens
  misc_feature 1..74: note = chr14:73140612-73140686
  misc_feature 1..74: note = hypo
  source 1..74: mol_type = genomic DNA
cactacaagaaagcacgttgccttctctccaggtttttccactctacctcgctgtggtccgtaaaaacacgcac

SEQ ID NO: 15835 - DNA, 50 bp, Homo sapiens
  misc_feature 1..50: note = chr14:73147450-73147500
  misc_feature 1..50: note = hypo
  source 1..50: mol_type = genomic DNA
gcaggtggctaacaacgaaagccatggccagagggcgggcttctctggag

SEQ ID NO: 15836 - DNA, 149 bp, Homo sapiens; identical to SEQ ID NO: 5153
  misc_feature 1..149: note = chr14:73167750-73167899
  misc_feature 1..149: note = hypo
  source 1..149: mol_type = genomic DNA

SEQ ID NO: 15837 - DNA, 30 bp, Homo sapiens
  misc_feature 1..30: note = chr14:73172944-73172974
  misc_feature 1..30: note = hypo
  source 1..30: mol_type = genomic DNA
tcaattccatccatgcgccctaagggcctt

SEQ ID NO: 15838 - DNA, 30 bp, Homo sapiens
  misc_feature 1..30: note = chr14:73178859-73178889
  misc_feature 1..30: note = hypo
  source 1..30: mol_type = genomic DNA
ttccagaaagcctgccgtcaggcctcccag

SEQ ID NO: 15839 - DNA, 69 bp, Homo sapiens
  misc_feature 1..69: note = chr14:73180190-73180259
  misc_feature 1..69: note = hypo
  source 1..69: mol_type = genomic DNA
acccagagggagacccgtgccagggtccagcctcgactgtttcactgccatcctcgctgcagcctcttc

SEQ ID NO: 15840 - DNA, 166 bp, Homo sapiens
  misc_feature 1..166: note = chr14:73195193-73195359
  misc_feature 1..166: note = hypo
  source 1..166: mol_type = genomic DNA
ggaatggagaggacacgcccaggaaggtcacgctcatccttttcgatttatttagtgggaaacaacagttttttagcagagttttgctctagaacaaaaggacagctagcaaagtaggacatgtcagagacgggaagaactggggacagggcgattcctggaatct

SEQ ID NO: 15841 - DNA, 34 bp, Homo sapiens
  misc_feature 1..34: note = chr14:73195668-73195702
  misc_feature 1..34: note = hypo
  source 1..34: mol_type = genomic DNA
aggaaggccaggcaccgtggctcatgcctgtaat

SEQ ID NO: 15842 - DNA, 174 bp, Homo sapiens
  misc_feature 1..174: note = chr14:73209874-73210048
  misc_feature 1..174: note = hypo
  source 1..174: mol_type = genomic DNA
atcaccctcggaattcggcaagggtggcaaagagccaccctgctccccaagagtcctggagcagaagggatcgacaaggcctcaggtgcattccaggtacaggaggagcgtcaactgtaaagcccttttcatctgcgggtccaggataagtgagtgtgtcgggccttcaagcaa

SEQ ID NO: 15843 - DNA, 23 bp, Homo sapiens
  misc_feature 1..23: note = chr14:73226884-73226907
  misc_feature 1..23: note = hypo
  source 1..23: mol_type = genomic DNA
aaatacaatgatggccgggcgcg

SEQ ID NO: 15844 - DNA, 30 bp, Homo sapiens
  misc_feature 1..30: note = chr14:73275087-73275117
  misc_feature 1..30: note = hypo
  source 1..30: mol_type = genomic DNA
acaagcaggacatttcgaactcaaatagta

SEQ ID NO: 15845 - DNA, 32 bp, Homo sapiens
  misc_feature 1..32: note = chr14:73313912-73313944
  misc_feature 1..32: note = hypo
  source 1..32: mol_type = genomic DNA
cactctggaccagaccgcgtcctaagagcttc

SEQ ID NO: 15846 - DNA, 176 bp, Homo sapiens
  misc_feature 1..176: note = chr14:73318453-73318629
  misc_feature 1..176: note = hypo
  source 1..176: mol_type = genomic DNA
tacaaaatgtccactcgaggatctgttcctccccgtgtgggtaatcgccctcctaccacgggcaacgggtaggcaaccgatatgcccagaaaggcggccaatgggaggacagctcgcccagcctcccgattggccaggcccgccaccagctggaaccatggcgagctttgaggaca

SEQ ID NO: 15847 - DNA, 44 bp, Homo sapiens
  misc_feature 1..44: note = chr14:73333249-73333293
  misc_feature 1..44: note = hypo
  source 1..44: mol_type = genomic DNA
ttggagttttctcatcgataaaaaagttaatatggctgggtgtg

SEQ ID NO: 15848 - DNA, 30 bp, Homo sapiens
  misc_feature 1..30: note = chr14:73958845-73958875
  misc_feature 1..30: note = hypo
  source 1..30: mol_type = genomic DNA
caacttcagtcaggacgacctcggtgagcc

SEQ ID NO: 15849 - DNA, 30 bp, Homo sapiens
  misc_feature 1..30: note = chr14:73959199-73959229
  misc_feature 1..30: note = hypo
  source 1..30: mol_type = genomic DNA
tgttgatgctgtggccgaccagcgagccaa

SEQ ID NO: 15850 - DNA, 30 bp, Homo sapiens
  misc_feature 1..30: note = chr14:75389373-75389403
  misc_feature 1..30: note = hypo
  source 1..30: mol_type = genomic DNA
caaagggatgacagccgtggctgcgggaag

SEQ ID NO: 15851 - DNA, 30 bp, Homo sapiens
  misc_feature 1..30: note = chr14:78247790-78247820
  misc_feature 1..30: note = hypo
  source 1..30: mol_type = genomic DNA
aaaaataattaggtgcggccgggtgcggtg

SEQ ID NO: 15852 - DNA, 30 bp, Homo sapiens
  misc_feature 1..30: note = chr14:90983280-90983310
  misc_feature 1..30: note = hypo
  source 1..30: mol_type = genomic DNA
cactctccagggccacgggatggcagcctg

SEQ ID NO: 15853 - DNA, 30 bp, Homo sapiens
  misc_feature 1..30: note = chr14:91849705-91849735
  misc_feature 1..30: note = hypo
  source 1..30: mol_type = genomic DNA
cccaagaaagactgtcgttgtttccaccaa

SEQ ID NO: 15854 - DNA, 273 bp, Homo sapiens; identical to SEQ ID NO: 5154
  misc_feature 1..273: note = chr14:93154937-93155210
  misc_feature 1..273: note = hypo
  source 1..273: mol_type = genomic DNA

SEQ ID NO: 15855 - DNA, 37 bp, Homo sapiens
  misc_feature 1..37: note = chr14:93697020-93697057
  misc_feature 1..37: note = hypo
  source 1..37: mol_type = genomic DNA
aggactcaggcacaccgagccacgggaggctggggac

SEQ ID NO: 15856 - DNA, 18 bp, Homo sapiens
  misc_feature 1..18: note = chr14:96967299-96967317
  misc_feature 1..18: note = hypo
  source 1..18: mol_type = genomic DNA
gcccggcttacattttct

SEQ ID NO: 15857 - DNA, 30 bp, Homo sapiens
  misc_feature 1..30: note = chr14:97188235-97188265
  misc_feature 1..30: note = hypo
  source 1..30: mol_type = genomic DNA
ttcacaaggagagcacggaagtagatacag

SEQ ID NO: 15858 - DNA, 18 bp, Homo sapiens
  misc_feature 1..18: note = chr14:97262855-97262873
  misc_feature 1..18: note = hypo
  source 1..18: mol_type = genomic DNA
taaacacaatgcggccgg

SEQ ID NO: 15859 - DNA, 144 bp, Homo sapiens
  misc_feature 1..144: note = chr14:99849909-99850053
  misc_feature 1..144: note = hypo
  source 1..144: mol_type = genomic DNA
tgggtggagcacaggcgggaagccctgccccgtctctttgtgagctgtgggtgcgcttggcgagtcacaagcctctctgggcccagttctttctatggaagtcatgggttgcagtgttgttgagggagccggtggtgcacgtgg

SEQ ID NO: 15860 - DNA, 30 bp, Homo sapiens
  misc_feature 1..30: note = chr14:100611919-100611949
  misc_feature 1..30: note = hypo
  source 1..30: mol_type = genomic DNA
cctggaggctgaggccgccttccccaaggc

SEQ ID NO: 15861 - DNA, 131 bp, Homo sapiens
  misc_feature 1..131: note = chr14:100643350-100643481
  misc_feature 1..131: note = hypo
  source 1..131: mol_type = genomic DNA
gaaatgcctccagggcgtggtgggaggggccggaacagggagatggcgcgtgagtagcatctgttcttacagcaaaacctgtaaaagtaaaatatacgtaggtttgtcactaaagacgtgtctgcataaat

SEQ ID NO: 15862 - DNA, 79 bp, Homo sapiens
  misc_feature 1..79: note = chr14:100644399-100644478
  misc_feature 1..79: note = hypo
  source 1..79: mol_type = genomic DNA
agcccagcccagtgccgcgcctgtcctcgaacctggcccaacgctcgccgggagcagggacctgcgtgcagctatggaa

SEQ ID NO: 15863 - DNA, 30 bp, Homo sapiens
  misc_feature 1..30: note = chr14:101200688-101200718
  misc_feature 1..30: note = hypo
  source 1..30: mol_type = genomic DNA
agacctgcagccgcccggtgaccaactgcg

SEQ ID NO: 15864 - DNA, 185 bp, Homo sapiens
  misc_feature 1..185: note = chr14:101250109-101250294
  misc_feature 1..185: note = hypo
  source 1..185: mol_type = genomic DNA
tagggtccattgacccggaggtcgaggcttccagagcgggccagccggcagccccaacgtgtgaggctgtgcacctgctggggagggtttttttgatggcgacggcgtgaggtgagcgggtttgctctgggcggtcgaggattagcgccgactgagagggtcaggtgcaccggggctttgttcag

SEQ ID NO: 15865 - DNA, 51 bp, Homo sapiens
  misc_feature 1..51: note = chr14:102335848-102335899
  misc_feature 1..51: note = hypo
  source 1..51: mol_type = genomic DNA
ccaaagtggctgccccgtgtgattcccccaacagtgcgtgagttctcatgc

SEQ ID NO: 15866 - DNA, 138 bp, Homo sapiens
  misc_feature 1..138: note = chr14:102418540-102418678
  misc_feature 1..138: note = hypo
  source 1..138: mol_type = genomic DNA
tcgcatgagccaccacgcccagtgtattcagattttcttcgtgtttcttttctcttccgggatcccatgcaggacaccacgtcgcatttagttgtccaccacggtttttttgtttgtttgtttttttccgagacggag

SEQ ID NO: 15867 - DNA, 30 bp, Homo sapiens
  misc_feature 1..30: note = chr14:102530479-102530509
  misc_feature 1..30: note = hypo
  source 1..30: mol_type = genomic DNA
gctccttctccccagcgtggttcctaagag

SEQ ID NO: 15868 - DNA, 101 bp, Homo sapiens
  misc_feature 1..101: note = chr14:103007139-103007240
  misc_feature 1..101: note = hypo
  source 1..101: mol_type = genomic DNA
atgtttgtgtgtgtgcgttgggggtgtgtgtgcggtggggggctatgggctgggatgtcccttgaggtgatcagctctctacgttccgcacacacaaacac

SEQ ID NO: 15869 - DNA, 89 bp, Homo sapiens
  misc_feature 1..89: note = chr14:103820833-103820922
  misc_feature 1..89: note = hypo
  source 1..89: mol_type = genomic DNA
tagcaatgtaagaaacggctgaatgcatgcacactgtaataaattacttttacaagaatccccattgcaggtgccgcttataggaactt

SEQ ID NO: 15870 - DNA, 30 bp, Homo sapiens
  misc_feature 1..30: note = chr14:103996414-103996444
  misc_feature 1..30: note = hypo
  source 1..30: mol_type = genomic DNA
gcacagacccagacccggcatggtgtcctg

SEQ ID NO: 15871 - DNA, 30 bp, Homo sapiens
  misc_feature 1..30: note = chr14:104061854-104061884
  misc_feature 1..30: note = hypo
  source 1..30: mol_type = genomic DNA
ctggtggatgtgggccgcacccctccagct

SEQ ID NO: 15872 - DNA, 30 bp, Homo sapiens
  misc_feature 1..30: note = chr14:104202811-104202841
  misc_feature 1..30: note = hypo
  source 1..30: mol_type = genomic DNA
ctgttcttaaggtgacgcttagcaatcaca

SEQ ID NO: 15873 - DNA, 22 bp, Homo sapiens
  misc_feature 1..22: note = chr14:104355166-104355188
  misc_feature 1..22: note = hypo
  source 1..22: mol_type = genomic DNA
tttttttttccatgacggagtc

SEQ ID NO: 15874 - DNA, 414 bp, Homo sapiens
  misc_feature 1..414: note = chr14:104617714-104618128
  misc_feature 1..414: note = hypo
  source 1..414: mol_type = genomic DNA
agctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtg

SEQ ID NO: 15875 - DNA, 184 bp, Homo sapiens
  misc_feature 1..184: note = chr14:104620411-104620595
  misc_feature 1..184: note = hypo
  source 1..184: mol_type = genomic DNA
cctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacggggg

SEQ ID NO: 15876 - DNA, 34 bp, Homo sapiens
  misc_feature 1..34: note = chr14:104628653-104628687
  misc_feature 1..34: note = hypo
  source 1..34: mol_type = genomic DNA
tggaaccacagaggacgcccggtcccagcctctg

SEQ ID NO: 15877 - DNA, 64 bp, Homo sapiens
  misc_feature 1..64: note = chr14:104630091-104630155
  misc_feature 1..64: note = hypo
  source 1..64: mol_type = genomic DNA
cctggggcccaggcccgtgtgcctgagacccctggacctcacccggcatcgccagcatttaccc

SEQ ID NO: 15878 - DNA, 16 bp, Homo sapiens
  misc_feature 1..16: note = chr14:104631077-104631093
  misc_feature 1..16: note = hypo
  source 1..16: mol_type = genomic DNA
gcgtgtctgtgtgtgt

SEQ ID NO: 15879 - DNA, 617 bp, Homo sapiens
  misc_feature 1..617: note = chr14:104639155-104639772
  misc_feature 1..617: note = hypo
  source 1..617: mol_type = genomic DNA
aagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgagg

SEQ ID NO: 15880 - DNA, 30 bp, Homo sapiens
  misc_feature 1..30: note = chr14:104641364-104641394
  misc_feature 1..30: note = hypo
  source 1..30: mol_type = genomic DNA
gggcccgtcggcccccgcacctgcggccct

SEQ ID NO: 15881 - DNA, 74 bp, Homo sapiens
  misc_feature 1..74: note = chr14:104641701-104641775
  misc_feature 1..74: note = hypo
  source 1..74: mol_type = genomic DNA
aggtccaggtggcaccgacggagctcaggccagccccgcccgagggggccggaagccctcgccaccagaggctg

SEQ ID NO: 15882 - DNA, 32 bp, Homo sapiens
  misc_feature 1..32: note = chr14:104645126-104645158
  misc_feature 1..32: note = hypo
  source 1..32: mol_type = genomic DNA
tggtggggagcctgccgcggatggcagagtga

SEQ ID NO: 15883 - DNA, 88 bp, Homo sapiens
  misc_feature 1..88: note = chr14:104645975-104646063
  misc_feature 1..88: note = hypo
  source 1..88: mol_type = genomic DNA
cggccgagtacctggcggccctggagcgagccacggcggccctggagcagtgcgtgaacctgtgcaaggcgcacgtcatgatggtcac

SEQ ID NO: 15884 - DNA, 49 bp, Homo sapiens
  misc_feature 1..49: note = chr14:104647208-104647257
  misc_feature 1..49: note = hypo
  source 1..49: mol_type = genomic DNA
gaattaaagatgcatcgatggttcccacggctgccgagttcactgggcg

SEQ ID NO: 15885 - DNA, 38 bp, Homo sapiens
  misc_feature 1..38: note = chr14:104897616-104897654
  misc_feature 1..38: note = hypo
  source 1..38: mol_type = genomic DNA
atatctgttcattcatctcactgcggaggcagcaccat

SEQ ID NO: 15886 - DNA, 112 bp, Homo sapiens
  misc_feature 1..112: note = chr14:105196425-105196537
  misc_feature 1..112: note = hypo
  source 1..112: mol_type = genomic DNA
gcccaactagggtgacgctgggagaggagagggcttggaggagccacgggtcaaatgcaggaggccacacctgcctgcccaggaggactgcaggagccggatccttaacacc

SEQ ID NO: 15887 - DNA, 62 bp, Homo sapiens
  misc_feature 1..62: note = chr14:105658349-105658411
  misc_feature 1..62: note = hypo
  source 1..62: mol_type = genomic DNA
cttcctcctccacctcggctcccgagtgctgcttctcctgggacttccgacatggctccctc

SEQ ID NO: 15888 - DNA, 164 bp, Homo sapiens; identical to SEQ ID NO: 12077
  misc_feature 1..164: note = chr14:105714232-105714396
  misc_feature 1..164: note = hypo
  source 1..164: mol_type = genomic DNA

SEQ ID NO: 15889 - DNA, 21 bp, Homo sapiens
  misc_feature 1..21: note = chr15:20499486-20499507
  misc_feature 1..21: note = hypo
  source 1..21: mol_type = genomic DNA
gagcgcgctgactcacgcctg

SEQ ID NO: 15890 - DNA, 30 bp, Homo sapiens
  misc_feature 1..30: note = chr15:22515506-22515536
  misc_feature 1..30: note = hypo
  source 1..30: mol_type = genomic DNA
gcagcatgggcgtcacgctgcctgccgggc

SEQ ID NO: 15891 - DNA, 255 bp, Homo sapiens
  misc_feature 1..255: note = chr15:29133539-29133794
  misc_feature 1..255: note = hypo
  source 1..255: mol_type = genomic DNA
gtttggattgggcggcggtggctgtggtgagggctgttggagtggggagagtgggggttgagcctggcttcagagaccccctcgaggcctcagctcctctccggcgctcctggctgtcctctgccacgcatacctgccccggtgactcaacaggtgtgggcctcaggtgacaccatggtccgaagtcgtggagaaacctttactgtccaggggaggagaggactggcggtcggtggggatcgagacccagcacac

SEQ ID NO: 15892 - DNA, 30 bp, Homo sapiens
  misc_feature 1..30: note = chr15:29449033-29449063
  misc_feature 1..30: note = hypo
  source 1..30: mol_type = genomic DNA
cctcagcaggccaggcgcagtggctcatgc

SEQ ID NO: 15893 - DNA, 43 bp, Homo sapiens
  misc_feature 1..43: note = chr15:33632093-33632136
  misc_feature 1..43: note = hypo
  source 1..43: mol_type = genomic DNA
aaaaaaaaaaaattgccattaccttagtcgtggaacaccaaag

SEQ ID NO: 15894 - DNA, 30 bp, Homo sapiens
  misc_feature 1..30: note = chr15:40228636-40228666
  misc_feature 1..30: note = hypo
  source 1..30: mol_type = genomic DNA
ggagtttctctctgtcgcccgggctggagt

SEQ ID NO: 15895 - DNA, 300 bp, Homo sapiens
  misc_feature 1..300: note = chr15:41165245-41165545
  misc_feature 1..300: note = hypo
  source 1..300: mol_type = genomic DNA
ccatagctgctcaaacgaagcagaagaacttcttccagcggcagcgggagagggtgcgcacacctttggcattcagtttcttctccagccgggctttgtgctcaatggcactgagaatagccgagtcaaatacttccttcaagttcttctgcgtcaaggctgagcactcaaggtagcagcaggctcggatcttctcggccagaccctgagcctggggttggggcacggggccctcccggcccccctggtccagctgaattagtacgttgacatcgtccctcaggtcggcctgggtgccca

SEQ ID NO: 15896 - DNA, 40 bp, Homo sapiens
  misc_feature 1..40: note = chr15:42684673-42684713
  misc_feature 1..40: note = hypo
  source 1..40: mol_type = genomic DNA
gggccactgaaggtccgttcgtggtcgtgaggcacacttt

SEQ ID NO: 15897 - DNA, 30 bp, Homo sapiens
  misc_feature 1..30: note = chr15:43020330-43020360
  misc_feature 1..30: note = hypo
  source 1..30: mol_type = genomic DNA
agcctcagactactccgtgcacctccccac

SEQ ID NO: 15898 - DNA, 30 bp, Homo sapiens
  misc_feature 1..30: note = chr15:44037474-44037504
  misc_feature 1..30: note = hypo
  source 1..30: mol_type = genomic DNA
atgtacccacatctacgaactaggagcagt

SEQ ID NO: 15899 - DNA, 20 bp, Homo sapiens
  misc_feature 1..20: note = chr15:52967815-52967835
  misc_feature 1..20: note = hypo
  source 1..20: mol_type = genomic DNA
tagtgttaggccgggcgcgg

SEQ ID NO: 15900 - DNA, 145 bp, Homo sapiens
  misc_feature 1..145: note = chr15:53976280-53976425
  misc_feature 1..145: note = hypo
  source 1..145: mol_type = genomic DNA
gcatatctttgtatacgttaatatataaaagaaagaaaacattgcaggtataatagacgaacctttaacaatgattttctgcaaatgttgagattctactgtttttaagaattgccggaggagccaagatggctgaataggaaca

SEQ ID NO: 15901 - DNA, 90 bp, Homo sapiens
  misc_feature 1..90: note = chr15:55699080-55699170
  misc_feature 1..90: note = hypo
  source 1..90: mol_type = genomic DNA
ttttgactgaaattccgccctcagcgtaaaaggttaaaaattatgaattaacgcccgcgcggtgggtcacgcctgtaatcccagcactct

SEQ ID NO: 15902 - DNA, 49 bp, Homo sapiens; identical to SEQ ID NO: 5155
  misc_feature 1..49: note = chr15:59158488-59158537
  misc_feature 1..49: note = hypo
  source 1..49: mol_type = genomic DNA

SEQ ID NO: 15903 - DNA, 40 bp, Homo sapiens
  misc_feature 1..40: note = chr15:62367703-62367743
  misc_feature 1..40: note = hypo
  source 1..40: mol_type = genomic DNA
ccaatacagataggccgggcacggtgcctcacgtcggtaa

SEQ ID NO: 15904 - DNA, 45 bp, Homo sapiens
  misc_feature 1..45: note = chr15:65043594-65043639
  misc_feature 1..45: note = hypo
  source 1..45: mol_type = genomic DNA
ggcagcatgtgaattcgcagaaccaggacacgggctggacctgcc

SEQ ID NO: 15905 - DNA, 30 bp, Homo sapiens
  misc_feature 1..30: note = chr15:65622974-65623004
  misc_feature 1..30: note = hypo
  source 1..30: mol_type = genomic DNA
gcttgaagccgccctcgtgctgggccagcc

SEQ ID NO: 15906 - DNA, 96 bp, Homo sapiens; identical to SEQ ID NO: 5156
  misc_feature 1..96: note = chr15:66649845-66649941
  misc_feature 1..96: note = hypo
  source 1..96: mol_type = genomic DNA

SEQ ID NO: 15907 - DNA, 81 bp, Homo sapiens
  misc_feature 1..81: note = chr15:67545405-67545486
  misc_feature 1..81: note = hypo
  source 1..81: mol_type = genomic DNA
actatgtgccagactcggggataagcacaatcttgcgaaaattatccctattttatagatagaaggtgaaggggccgggcg

SEQ ID NO: 15908 - DNA, 30 bp, Homo sapiens
  misc_feature 1..30: note = chr15:70075720-70075750
  misc_feature 1..30: note = hypo
  source 1..30: mol_type = genomic DNA
ctgccctccccaaagcgtgactctaatcag

SEQ ID NO: 15909 - DNA, 176 bp, Homo sapiens
  misc_feature 1..176: note = chr15:72102772-72102948
  misc_feature 1..176: note = hypo
  source 1..176: mol_type = genomic DNA
ggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggca

SEQ ID NO: 15910 - DNA, 220 bp, Homo sapiens; identical to SEQ ID NO: 5157
  misc_feature 1..220: note = chr15:72412089-72412309
  misc_feature 1..220: note = hypo
  source 1..220: mol_type = genomic DNA

SEQ ID NO: 15911 - DNA, 187 bp, Homo sapiens
  misc_feature 1..187: note = chr15:72581494-72581681
  misc_feature 1..187: note = hypo
  source 1..187: mol_type = genomic DNA
cccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggccc

SEQ ID NO: 15912 - DNA, 39 bp, Homo sapiens
  misc_feature 1..39: note = chr15:76197482-76197521
  misc_feature 1..39: note = hypo
  source 1..39: mol_type = genomic DNA
ccacattttcactattaacaacaacgctgtgcagaacct

SEQ ID NO: 15913 - DNA, 30 bp, Homo sapiens
  misc_feature 1..30: note = chr15:76510088-76510118
  misc_feature 1..30: note = hypo
  source 1..30: mol_type = genomic DNA
cttccaaggggctttcggctgccttagctc

SEQ ID NO: 15914 - DNA, 30 bp, Homo sapiens
  misc_feature 1..30: note = chr15:77906968-77906998
  misc_feature 1..30: note = hypo
  source 1..30: mol_type = genomic DNA
cggatgcgggcgcggcggcaggtgaagtag

SEQ ID NO: 15915 - DNA, 44 bp, Homo sapiens
  misc_feature 1..44: note = chr15:78501806-78501850
  misc_feature 1..44: note = hypo
  source 1..44: mol_type = genomic DNA
cgaggcctcctgtgccgggcagacagaggcgtgtgaatgctgca

SEQ ID NO: 15916 - DNA, 85 bp, Homo sapiens; identical to SEQ ID NO: 1604
  misc_feature 1..85: note = chr15:78596048-78596133
  misc_feature 1..85: note = hypo
  source 1..85: mol_type = genomic DNA

SEQ ID NO: 15917 - DNA, 139 bp, Homo sapiens
  misc_feature 1..139: note = chr15:78609750-78609889
  misc_feature 1..139: note = hypo
  source 1..139: mol_type = genomic DNA
cacagcgtgctgctccgagcactgccatgccaggtgacttcactctcctgattttgaagatccctgtttccatgcctctccttcggtgaatcatatgttctgggcctgacctggatccccagtcctgacacccagccca

SEQ ID NO: 15918 - DNA, 95 bp, Homo sapiens
  misc_feature 1..95: note = chr15:83655934-83656029
  misc_feature 1..95: note = hypo
  source 1..95: mol_type = genomic DNA
ttgggattacagaggtgagccaccgcgcctggccttagagcacttttactccaattctttccttgaataagactcttatgcgccaccctccccta

SEQ ID NO: 15919 - DNA, 30 bp, Homo sapiens
  misc_feature 1..30: note = chr15:90630578-90630608
  misc_feature 1..30: note = hypo
  source 1..30: mol_type = genomic DNA
aatgcactctaatagcgaccttcccagggt

SEQ ID NO: 15920 - DNA, 82 bp, Homo sapiens
  misc_feature 1..82: note = chr15:90703242-90703324
  misc_feature 1..82: note = hypo
  source 1..82: mol_type = genomic DNA
ttgtttgtttttttgcgggggtgggtggtttgagacggcatctcactctgtcgcccaggctggagtgctgtcgcatgatctg

SEQ ID NO: 15921 - DNA, 104 bp, Homo sapiens
  misc_feature 1..104: note = chr15:90844295-90844399
  misc_feature 1..104: note = hypo
  source 1..104: mol_type = genomic DNA
agctggtctgttggggaccttccagacctgttacctgtatgctgcctggtgacgcgtgggggagtccacagggactgccatggcgcctacggggcacagtccgg

SEQ ID NO: 15922 - DNA, 116 bp, Homo sapiens
  misc_feature 1..116: note = chr15:91189343-91189459
  misc_feature 1..116: note = hypo
  source 1..116: mol_type = genomic DNA
acctgggccagctcccgccgtgtcccagctgctccccattccgtcccatggcccgtcgcgccttccccagcgtccctatgccttacgaggtcctgtttccacgtcaacctgacctt

SEQ ID NO: 15923 - DNA, 30 bp, Homo sapiens
  misc_feature 1..30: note = chr15:91313685-91313715
  misc_feature 1..30: note = hypo
  source 1..30: mol_type = genomic DNA
gtgagccaccgtgcccggccaatccccaca

SEQ ID NO: 15924 - DNA, 30 bp, Homo sapiens
  misc_feature 1..30: note = chr15:91409404-91409434
  misc_feature 1..30: note = hypo
  source 1..30: mol_type = genomic DNA
tcacatataactcatcgctatcacagcccc

SEQ ID NO: 15925 - DNA, 39 bp, Homo sapiens
  misc_feature 1..39: note = chr15:93364629-93364668
  misc_feature 1..39: note = hypo
  source 1..39: mol_type = genomic DNA
ggcaacaagagccagactctgtctcgggggaaaaaaaaa

SEQ ID NO: 15926 - DNA, 30 bp, Homo sapiens
  misc_feature 1..30: note = chr15:93609848-93609878
  misc_feature 1..30: note = hypo
  source 1..30: mol_type = genomic DNA
cgtcaccaccgccgccgcctccacctcgct

SEQ ID NO: 15927 - DNA, 30 bp, Homo sapiens
  misc_feature 1..30: note = chr15:94347602-94347632
  misc_feature 1..30: note = hypo
  source 1..30: mol_type = genomic DNA
aaaaaaaaaaagtcacgtggaaccatcgtg

SEQ ID NO: 15928 - DNA, 24 bp, Homo sapiens
  misc_feature 1..24: note = chr15:94478454-94478478
  misc_feature 1..24: note = hypo
  source 1..24: mol_type = genomic DNA
aaagaaggaggaggccgggcgccg

SEQ ID NO: 15929 - DNA, 30 bp, Homo sapiens
  misc_feature 1..30: note = chr15:97006359-97006389
  misc_feature 1..30: note = hypo
  source 1..30: mol_type = genomic DNA
tgtgacatccgtgagcgctgatggtgcacg

SEQ ID NO: 15930 - DNA, 31 bp, Homo sapiens
  misc_feature 1..31: note = chr15:98454964-98454995
  misc_feature 1..31: note = hypo
  source 1..31: mol_type = genomic DNA
tgccaaccacccggcccggcacatttatttt

SEQ ID NO: 15931 - DNA, 20 bp, Homo sapiens
  misc_feature 1..20: note = chr15:99295597-99295617
  misc_feature 1..20: note = hypo
  source 1..20: mol_type = genomic DNA
tagagtgtttattaacgaaa

SEQ ID NO: 15932 - DNA, 30 bp, Homo sapiens
  misc_feature 1..30: note = chr15:99460238-99460268
  misc_feature 1..30: note = hypo
  source 1..30: mol_type = genomic DNA
aaaagatgacaggttcggtgaagtgagtcc

SEQ ID NO: 15933 - DNA, 132 bp, Homo sapiens
  misc_feature 1..132: note = chr15:99484456-99484588
  misc_feature 1..132: note = hypo
  source 1..132: mol_type = genomic DNA
aggaaagcagcagcacgtgcctggcacagggcagggcctctccagatggcagttcctgtctgtgtcttattcccaccctccgggcacatggggggaactcagtttctccccactgcgcgtcaccctgggaga

SEQ ID NO: 15934 - DNA, 246 bp, Homo sapiens
  misc_feature 1..246: note = chr15:102043043-102043289
  misc_feature 1..246: note = hypo
  source 1..246: mol_type = genomic DNA
actccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagc

SEQ ID NO: 15935 - DNA, 57 bp, Homo sapiens
  misc_feature 1..57: note = chr16:142626-142683
  misc_feature 1..57: note = hypo
  source 1..57: mol_type = genomic DNA
ttctgacaaggagaccggcaaggagaacttggcaagaacggacggcaggtcatgaga

SEQ ID NO: 15936 - DNA, 30 bp, Homo sapiens
  misc_feature 1..30: note = chr16:189535-189565
  misc_feature 1..30: note = hypo
  source 1..30: mol_type = genomic DNA
aaaacacttggaagccgacaggagatcttt

SEQ ID NO: 15937 - DNA, 22 bp, Homo sapiens
  misc_feature 1..22: note = chr16:319924-319946
  misc_feature 1..22: note = hypo
  source 1..22: mol_type = genomic DNA
aaacaaggtaggccacgcatgg

SEQ ID NO: 15938 - DNA, 30 bp, Homo sapiens
  misc_feature 1..30: note = chr16:337748-337778
  misc_feature 1..30: note = hypo
  source 1..30: mol_type = genomic DNA
acccagacctgggtacgtgggcaaatccca

SEQ ID NO: 15939 - DNA, 188 bp, Homo sapiens
  misc_feature 1..188: note = chr16:410258-410446
  misc_feature 1..188: note = hypo
  source 1..188: mol_type = genomic DNA
taggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacc

SEQ ID NO: 15940 - DNA, 419 bp, Homo sapiens
  misc_feature 1..419: note = chr16:411085-411504
  misc_feature 1..419: note = hypo
  source 1..419: mol_type = genomic DNA
ctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagcc

SEQ ID NO: 15941 - DNA, 30 bp, Homo sapiens
  misc_feature 1..30: note = chr16:612290-612320
  misc_feature 1..30: note = hypo
  source 1..30: mol_type = genomic DNA
ggggccatgctgggacgtccactccccaca

SEQ ID NO: 15942 - DNA, 154 bp, Homo sapiens; identical to SEQ ID NO: 5159
  misc_feature 1..154: note = chr16:612869-613023
  misc_feature 1..154: note = hypo
  source 1..154: mol_type = genomic DNA

SEQ ID NO: 15943 - DNA, 30 bp, Homo sapiens
  misc_feature 1..30: note = chr16:613572-613602
  misc_feature 1..30: note = hypo
  source 1..30: mol_type = genomic DNA
tggggagtccgaccccggcaggcaacccca

SEQ ID NO: 15944 - DNA, 411 bp, Homo sapiens
  misc_feature 1..411: note = chr16:614790-615201
  misc_feature 1..411: note = hypo
  source 1..411: mol_type = genomic DNA
cccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatga

SEQ ID NO: 15945 - DNA, 65 bp, Homo sapiens
  misc_feature 1..65: note = chr16:667484-667549
  misc_feature 1..65: note = hypo
  source 1..65: mol_type = genomic DNA
cggaaaacctgattccgtggtggctgtgagccccttccctccccttctgtcggcttcaccttaaa

SEQ ID NO: 15946 - DNA, 30 bp, Homo sapiens
  misc_feature 1..30: note = chr16:677879-677909
  misc_feature 1..30: note = hypo
  source 1..30: mol_type = genomic DNA
cctgggcttgaccggcggggagcctggttg

SEQ ID NO: 15947 - DNA, 42 bp, Homo sapiens
  misc_feature 1..42: note = chr16:700572-700614
  misc_feature 1..42: note = hypo
  source 1..42: mol_type = genomic DNA
gacctgcctgcagctcgatctgcaggacgttctcctggtcta

SEQ ID NO: 15948 - DNA, 283 bp, Homo sapiens; identical to SEQ ID NO: 1605
  misc_feature 1..283: note = chr16:726729-727012
  misc_feature 1..283: note = hypo
  source 1..283: mol_type = genomic DNA

SEQ ID NO: 15949 - DNA, 158 bp, Homo sapiens
  misc_feature 1..158: note = chr16:731412-731570
  misc_feature 1..158: note = hypo
  source 1..158: mol_type = genomic DNA
gtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactccta

SEQ ID NO: 15950 - DNA, 748 bp, Homo sapiens; identical to SEQ ID NO: 5161
  misc_feature 1..748: note = chr16:734930-735678
  misc_feature 1..748: note = hypo
  source 1..748: mol_type = genomic DNA

SEQ ID NO: 15951 - DNA, 30 bp, Homo sapiens
  misc_feature 1..30: note = chr16:735921-735951
  misc_feature 1..30: note = hypo
  source 1..30: mol_type = genomic DNA
gcatctcctttgctgcggtccagccgcgtc

SEQ ID NO: 15952 - DNA, 145 bp, Homo sapiens
  misc_feature 1..145: note = chr16:741376-741521
  misc_feature 1..145: note = hypo
  source 1..145: mol_type = genomic DNA
tttactggttgttgtcggtcacatacgagtgtgaattccaccaaggcaggaatcacattctggctcaatccccaccgaatgcccagtgcctgacacacctgttcaaccagttgctctcgttcttttttttaaaaaactttttgag

SEQ ID NO: 15953 - DNA, 30 bp, Homo sapiens
  misc_feature 1..30: note = chr16:809500-809530
  misc_feature 1..30: note = hypo
  source 1..30: mol_type = genomic DNA
gctcaggcctctcctcgagctctgggccct

SEQ ID NO: 15954 - DNA, 180 bp, Homo sapiens
  misc_feature 1..180: note = chr16:809840-810020
  misc_feature 1..180: note = hypo
  source 1..180: mol_type = genomic DNA
acatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccg

SEQ ID NO: 15955 - DNA, 273 bp, Homo sapiens
  misc_feature 1..273: note = chr16:824939-825212
  misc_feature 1..273: note = hypo
  source 1..273: mol_type = genomic DNA
ggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctca

SEQ ID NO: 15956 - DNA, 230 bp, Homo sapiens; identical to SEQ ID NO: 5162
  misc_feature 1..230: note = chr16:837308-837538
  misc_feature 1..230: note = hypo
  source 1..230: mol_type = genomic DNA

SEQ ID NO: 15957 - DNA, 205 bp, Homo sapiens; identical to SEQ ID NO: 1606
  misc_feature 1..205: note = chr16:845955-846160
  misc_feature 1..205: note = hypo
  source 1..205: mol_type = genomic DNA

SEQ ID NO: 15958 - DNA, 66 bp, Homo sapiens
  misc_feature 1..66: note = chr16:846426-846492
  misc_feature 1..66: note = hypo
  source 1..66: mol_type = genomic DNA
gtcctgctgccccagcgacggcaccaacttgcaggacgctgagtcactctccgtggcagccatcgg

SEQ ID NO: 15959 - DNA, 53 bp, Homo sapiens
  misc_feature 1..53: note = chr16:858748-858801
  misc_feature 1..53: note = hypo
  source 1..53: mol_type = genomic DNA
gaggccgagaagtcccgggagggatgccatctgcaagccggagacctgggatg

SEQ ID NO: 15960 - DNA, 30 bp, Homo sapiens
  misc_feature 1..30: note = chr16:882403-882433
  misc_feature 1..30: note = hypo
  source 1..30: mol_type = genomic DNA
ggtgtagggtgaaggcgtgagccacagtgc

SEQ ID NO: 15961 - DNA, 65 bp, Homo sapiens
  misc_feature 1..65: note = chr16:888904-888969
  misc_feature 1..65: note = hypo
  source 1..65: mol_type = genomic DNA
ctgggaagatggatccgtcccagtgtggccgcgcggctgtcaggagggcacggggactgggcgcg

SEQ ID NO: 15962 - DNA, 80 bp, Homo sapiens
  misc_feature 1..80: note = chr16:924620-924700
  misc_feature 1..80: note = hypo
  source 1..80: mol_type = genomic DNA
ggaggctgctcatgccgcaactccccaacggaaggatcacgggaaccaggacaggctccgggggacggtgctcagatggg

SEQ ID NO: 15963 - DNA, 128 bp, Homo sapiens
  misc_feature 1..128: note = chr16:943459-943587
  misc_feature 1..128: note = hypo
  source 1..128: mol_type = genomic DNA
ggatgagcccaaagtcggagggagcacccagtgcacacgcgtctcagccccgccccctgcggcacaaagggagccgaggcgcaggccccgtgtgtctcccacacactgcagctcgcctgctgtgagga

SEQ ID NO: 15964 - DNA, 63 bp, Homo sapiens
  misc_feature 1..63: note = chr16:963320-963383
  misc_feature 1..63: note = hypo
  source 1..63: mol_type = genomic DNA
gaacattcacttccacggccgctgctctccttcctgcgacacagacagcgttggcccaatcag

SEQ ID NO: 15965 - DNA, 30 bp, Homo sapiens
  misc_feature 1..30: note = chr16:981776-981806
  misc_feature 1..30: note = hypo
  source 1..30: mol_type = genomic DNA
agtgacgtgctgagccgctgcagggtcaga

SEQ ID NO: 15966 - DNA, 134 bp, Homo sapiens
  misc_feature 1..134: note = chr16:1052493-1052627
  misc_feature 1..134: note = hypo
  source 1..134: mol_type = genomic DNA
cccgatgtccctccccgggtgaaggaacccacggacgtggctcatccataccgcggaacgtgagccatgaaaaggggcagcctcggctcagccaccgcagggaaggactcgacacacgccgagcagaagaggcc

SEQ ID NO: 15967 - DNA, 30 bp, Homo sapiens
  misc_feature 1..30: note = chr16:1077608-1077638
  misc_feature 1..30: note = hypo
  source 1..30: mol_type = genomic DNA
tacccccgtgggctgcgagttctggaacgt

SEQ ID NO: 15968 - DNA, 217 bp, Homo sapiens
  misc_feature 1..217: note = chr16:1081773-1081990
  misc_feature 1..217: note = hypo
  source 1..217: mol_type = genomic DNA
acccgccctggattgcgggcacagcggcccccacaccggctgccggggctgcacaggctctggtgggctttagggtggcaaacatgcccaggttggggcctacaccccccaggttgagggagtggctccctggggtggctgccgcccatcccggcgtttctgggcttgtggacgtgtcgccccagccctgccggtcttcacgcggccttctctgtgt

SEQ ID NO: 15969 - DNA, 30 bp, Homo sapiens
  misc_feature 1..30: note = chr16:1128984-1129014
  misc_feature 1..30: note = hypo
  source 1..30: mol_type = genomic DNA
ggcggtgctggtgcccgtgctgtacctgct

SEQ ID NO: 15970 - DNA, 30 bp, Homo sapiens
  misc_feature 1..30: note = chr16:1166711-1166741
  misc_feature 1..30: note = hypo
  source 1..30: mol_type = genomic DNA
agagaaaatcagccacggctcccaggcccc

SEQ ID NO: 15971 - DNA, 30 bp, Homo sapiens
  misc_feature 1..30: note = chr16:1171222-1171252
  misc_feature 1..30: note = hypo
  source 1..30: mol_type = genomic DNA
ggcgacacccctccacgcacccgtagtggc

SEQ ID NO: 15972 - DNA, 118 bp, Homo sapiens
  misc_feature 1..118: note = chr16:1173263-1173381
  misc_feature 1..118: note = hypo
  source 1..118: mol_type = genomic DNA
cccggcacctggggccgatctacaggtgcattttgtacatagaatctgacccacaggttgtttgttggataaggggaaaatcccggaatccaggaggcccgtgcgccttcacctccgg

SEQ ID NO: 15973 - DNA, 95 bp, Homo sapiens
  misc_feature 1..95: note = chr16:1195687-1195782
  misc_feature 1..95: note = hypo
  source 1..95: mol_type = genomic DNA
cacaggcccccgccccgggtctggctcagctggttcctcagatgtccctgggcggcctggcaccttctctgaggagcccccgggtgaaattcccc

SEQ ID NO: 15974 - DNA, 30 bp, Homo sapiens
  misc_feature 1..30: note = chr16:1217473-1217503
  misc_feature 1..30: note = hypo
  source 1..30: mol_type = genomic DNA
ttaatgagcttggtgcggttgccatgggaa

SEQ ID NO: 15975 - DNA, 151 bp, Homo sapiens
  misc_feature 1..151: note = chr16:1228780-1228931
  misc_feature 1..151: note = hypo
  source 1..151: mol_type = genomic DNA
ccaagctccagaagtcggggttggggtgaagagatgtggcggagtggccggggcaggcaggtgtggctgccagggcagaggaaggaccgaacggtggcatctccccagcagggtggccccgcgcccttgccagccccggaggaccagatgg

SEQ ID NO: 15976 - DNA, 143 bp, Homo sapiens
  misc_feature 1..143: note = chr16:1230054-1230197
  misc_feature 1..143: note = hypo
  source 1..143: mol_type = genomic DNA
catctggttgccgggtgatactgagggggccgggctctgcaggcacagggctgaggggcgtcgtgtggatggacggccagcccgttgggtgccctggctgggtccctgtccctgcacaccgggtcagccggctcctgggtgca

SEQ ID NO: 15977 - DNA, 54 bp, Homo sapiens
  misc_feature 1..54: note = chr16:1236842-1236896
  misc_feature 1..54: note = hypo
  source 1..54: mol_type = genomic DNA
cggcagacttcagggcggtccgtcccactcccgtggcctcgagggtcctttgga

SEQ ID NO: 15978 - DNA, 77 bp, Homo sapiens
  misc_feature 1..77: note = chr16:1251702-1251779
  misc_feature 1..77: note = hypo
  source 1..77: mol_type = genomic DNA
ttgccacgcagttctcggagacgaagcagcgggagagtcagctgatgcgggagcagcgggcacgccacctgtccaac

SEQ ID NO: 15979 - DNA, 91 bp, Homo sapiens
  misc_feature 1..91: note = chr16:1268128-1268219
  misc_feature 1..91: note = hypo
  source 1..91: mol_type = genomic DNA
gcagggggaaggggacggcactgccagggtggcacccgcgggtgggtgtggaccccggcccacagctgtcccccaccgcaggacacgctgc

SEQ ID NO: 15980 - DNA, 51 bp, Homo sapiens
  misc_feature 1..51: note = chr16:1312476-1312527
  misc_feature 1..51: note = hypo
  source 1..51: mol_type = genomic DNA
ccagcactggtccttcggggtgagctccagcgagaccggggagagcttgac

SEQ ID NO: 15981 - DNA, 45 bp, Homo sapiens
  misc_feature 1..45: note = chr16:1324031-1324076
  misc_feature 1..45: note = hypo
  source 1..45: mol_type = genomic DNA
gaccttcacctgctgcgggcggtaaggaggcggcagcatatctgc

SEQ ID NO: 15982 - DNA, 144 bp, Homo sapiens
  misc_feature 1..144: note = chr16:1391751-1391895
  misc_feature 1..144: note = hypo
  source 1..144: mol_type = genomic DNA
tggactccctgaccccggcctgggcagagcctcgccggggaccctcatgggcatctctgttctccttgtagcgagattgaggatgtgagcacggaccagctgcacctggacatctggtacaggcccctgcgccatgcagggcgg

SEQ ID NO: 15983 - DNA, 62 bp, Homo sapiens
  misc_feature 1..62: note = chr16:1397548-1397610
  misc_feature 1..62: note = hypo
  source 1..62: mol_type = genomic DNA
ctgaaggaggagctgcggctgcacaaatgttccacccgcgagtgcatcgagcagttctacct

SEQ ID NO: 15984 - DNA, 28 bp, Homo sapiens
  misc_feature 1..28: note = chr16:1407453-1407481
  misc_feature 1..28: note = hypo
  source 1..28: mol_type = genomic DNA
agtcacccagcacctcgtgtgtatttcg

SEQ ID NO: 15985 - DNA, 190 bp, Homo sapiens
  misc_feature 1..190: note = chr16:1417148-1417338
  misc_feature 1..190: note = hypo
  source 1..190: mol_type = genomic DNA
gcaggggaatggtgccgatgtccccacagccccgcagccccggcagtgtggaggctacgcccaggccctccagctcctcctgcagctgcttcacctgtgcctccacctcctccttcttctgcagcgccagctgccggtcgctatcggccacacgggcacgctccttggcctcctgcgcctctcgctgcca

SEQ ID NO: 15986 - DNA, 243 bp, Homo sapiens
  misc_feature 1..243: note = chr16:1417675-1417918
  misc_feature 1..243: note = hypo
  source 1..243: mol_type = genomic DNA
gactcctcccactgccggatcttcctcttggcctcgtccagctgccgcctgacccgggccagctcagctccgtttggacttgcactcgaagaggatggggggccggcactcaggatgggggaggggctgggggagaagctgccggaaacaaagtcccagatgctcccggggacaccgttcaaacctgagtgtgaaacggtcgatgacggcccagccctgctgtgctcgcggcctggtgggatt

SEQ ID NO: 15987 - DNA, 30 bp, Homo sapiens
  misc_feature 1..30: note = chr16:1425654-1425684
  misc_feature 1..30: note = hypo
  source 1..30: mol_type = genomic DNA
taacaggttgggggtcggggcagccaggcc

SEQ ID NO: 15988 - DNA, 43 bp, Homo sapiens
  misc_feature 1..43: note = chr16:1428212-1428255
  misc_feature 1..43: note = hypo
  source 1..43: mol_type = genomic DNA
actgaggacaggcaccgaccccccaacccgcaggcctgcccac

SEQ ID NO: 15989 - DNA, 145 bp, Homo sapiens; identical to SEQ ID NO: 5165
  misc_feature 1..145: note = chr16:1428508-1428653
  misc_feature 1..145: note = hypo
  source 1..145: mol_type = genomic DNA

SEQ ID NO: 15990 - DNA, 30 bp, Homo sapiens
  misc_feature 1..30: note = chr16:1428877-1428907
  misc_feature 1..30: note = hypo
  source 1..30: mol_type = genomic DNA
gcccactttctcacccgcagcttctccccc

SEQ ID NO: 15991 - DNA, 30 bp, Homo sapiens
  misc_feature 1..30: note = chr16:1486627-1486657
  misc_feature 1..30: note = hypo
  source 1..30: mol_type = genomic DNA
gggagaagggtcccacgccacctccaaggc

SEQ ID NO: 15992 - DNA, 37 bp, Homo sapiens
  misc_feature 1..37: note = chr16:1491115-1491152
  misc_feature 1..37: note = hypo
  source 1..37: mol_type = genomic DNA
tctcaaaacaaaaaacgagtgtcggcctggctttgct

SEQ ID NO: 15993 - DNA, 77 bp, Homo sapiens
  misc_feature 1..77: note = chr16:1493574-1493651
  misc_feature 1..77: note = hypo
  source 1..77: mol_type = genomic DNA
agccctgcagctgcacgcgggcccgcacctggagcagctcccgcagcaggctccgcgtggcgcgctcacagcgctgc

SEQ ID NO: 15994 - DNA, 82 bp, Homo sapiens
  misc_feature 1..82: note = chr16:1730551-1730633
  misc_feature 1..82: note = hypo
  source 1..82: mol_type = genomic DNA
tcatctgaacggggtcgagtcgcagggcgggcgccttgtaagcgtcacatttagttttgctgtgaagcgagtcaggtggtgg

SEQ ID NO: 15995 - DNA, 122 bp, Homo sapiens
  misc_feature 1..122: note = chr16:1741761-1741883
  misc_feature 1..122: note = hypo
  source 1..122: mol_type = genomic DNA
gtctccaaagcactgcgggggtggggtggggtggggtccggtggacgtctggttgctcagtgttctgtgatcgtttctgcagggggtaaaggaagtggtatctttgacgaatcaacccccgt

SEQ ID NO: 15996 - DNA, 120 bp, Homo sapiens
  misc_feature 1..120: note = chr16:1813598-1813718
  misc_feature 1..120: note = hypo
  source 1..120: mol_type = genomic DNA
gggcactgtgggggccgctcaccctggacagagacatcacccatcattcttccactcagcgactgcacgtcctccgcccgtcgagagcagaagcgcgagcagtaccgccaggtgcgtgag

SEQ ID NO: 15997 - DNA, 30 bp, Homo sapiens
  misc_feature 1..30: note = chr16:2028658-2028688
  misc_feature 1..30: note = hypo
  source 1..30: mol_type = genomic DNA
ggaaacccataaaggcgcactgccctagcc

SEQ ID NO: 15998 - DNA, 147 bp, Homo sapiens; identical to SEQ ID NO: 5166
  misc_feature 1..147: note = chr16:2029023-2029170
  misc_feature 1..147: note = hypo
  source 1..147: mol_type = genomic DNA

SEQ ID NO: 15999 - DNA, 30 bp, Homo sapiens
  misc_feature 1..30: note = chr16:2213693-2213723
  misc_feature 1..30: note = hypo
  source 1..30: mol_type = genomic DNA
ctgcatacctgggatcggggtgaaggacct

SEQ ID NO: 16000 - DNA, 24 bp, Homo sapiens
  misc_feature 1..24: note = chr16:2232798-2232822
  misc_feature 1..24: note = hypo
  source 1..24: mol_type = genomic DNA
ttgctttgtttgagacggagcctc

SEQ ID NO: 16001 - DNA, 84 bp, Homo sapiens
  misc_feature 1..84: note = chr16:2233062-2233146
  misc_feature 1..84: note = hypo
  source 1..84: mol_type = genomic DNA
caggcgtgagccaccgcgcccggccgcacctccgtgttaatgacgattggccatggcgtgtgcaggtatcgctgagaatggggg

SEQ ID NO: 16002 - DNA, 336 bp, Homo sapiens; identical to SEQ ID NO: 1608
  misc_feature 1..336: note = chr16:2234684-2235020
  misc_feature 1..336: note = hypo
  source 1..336: mol_type = genomic DNA

SEQ ID NO: 16003 - DNA, 367 bp, Homo sapiens
  misc_feature 1..367: note = chr16:2278403-2278770
  misc_feature 1..367: note = hypo
  source 1..367: mol_type = genomic DNA
ccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggc

SEQ ID NO: 16004 - DNA, 34 bp, Homo sapiens
  misc_feature 1..34: note = chr16:2466336-2466370
  misc_feature 1..34: note = hypo
  source 1..34: mol_type = genomic DNA
gggccacagagcgagactccgcctcaaaaaaaaa

SEQ ID NO: 16005 - DNA, 30 bp, Homo sapiens
  misc_feature 1..30: note = chr16:2531804-2531834
  misc_feature 1..30: note = hypo
  source 1..30: mol_type = genomic DNA
agccacagttaggcacgtttgcacttccaa

SEQ ID NO: 16006 - DNA, 37 bp, Homo sapiens
  misc_feature 1..37: note = chr16:2540828-2540865
  misc_feature 1..37: note = hypo
  source 1..37: mol_type = genomic DNA
ctctcactccctccccggccaccgcctccggctctgc

SEQ ID NO: 16007 - DNA, 18 bp, Homo sapiens
  misc_feature 1..18: note = chr16:2589100-2589118
  misc_feature 1..18: note = hypo
  source 1..18: mol_type = genomic DNA
atggagtctccctctcga

SEQ ID NO: 16008 - DNA, 74 bp, Homo sapiens
  misc_feature 1..74: note = chr16:2764635-2764709
  misc_feature 1..74: note = hypo
  source 1..74: mol_type = genomic DNA
cctgaaaggctggctcggagagaaccaccctccaggtgcagcagggccagccccacctgcgggcctctggcagg

SEQ ID NO: 16009 - DNA, 117 bp, Homo sapiens; identical to SEQ ID NO: 5168
  misc_feature 1..117: note = chr16:2770122-2770239
  misc_feature 1..117: note = hypo
  source 1..117: mol_type = genomic DNA

SEQ ID NO: 16010 - DNA, 82 bp, Homo sapiens; identical to SEQ ID NO: 5169
  misc_feature 1..82: note = chr16:2770456-2770538
  misc_feature 1..82: note = hypo
  source 1..82: mol_type = genomic DNA

SEQ ID NO: 16011 - DNA, 30 bp, Homo sapiens
  misc_feature 1..30: note = chr16:2877506-2877536
  misc_feature 1..30: note = hypo
  source 1..30: mol_type = genomic DNA
gaggaggagtgtcctcgtgtgtgcatgccc

SEQ ID NO: 16012 - DNA, 20 bp, Homo sapiens
  misc_feature 1..20: note = chr16:3211706-3211726
  misc_feature 1..20: note = hypo
  source 1..20: mol_type = genomic DNA
aatgtggttggaaatcgcgg

SEQ ID NO: 16013 - DNA, 120 bp, Homo sapiens
  misc_feature 1..120: note = chr16:3211846-3211966
  misc_feature 1..120: note = hypo
  source 1..120: mol_type = genomic DNA
aaacaattttaaaagttagcagggcgtggtggtgcgcgcctgtgatccaagctactcctgtgtctgaggcaggaggatcgcttgagcctgtctcaaataaacaaagggcggggcgcggtg

SEQ ID NO: 16014 - DNA, 78 bp, Homo sapiens
  misc_feature 1..78: note = chr16:3492662-3492740
  misc_feature 1..78: note = hypo
  source 1..78: mol_type = genomic DNA
agactctgtatcaaaaaaaaaaaaaaaagaacttttaaaagtagccagacactgtggtatgcgcgcctctcagatact

SEQ ID NO: 16015 - DNA, 33 bp, Homo sapiens
  misc_feature 1..33: note = chr16:3598920-3598953
  misc_feature 1..33: note = hypo
  source 1..33: mol_type = genomic DNA
accaggtgaagcagacggcgtcacactagcctc

SEQ ID NO: 16016 - DNA, 37 bp, Homo sapiens
  misc_feature 1..37: note = chr16:3957870-3957907
  misc_feature 1..37: note = hypo
  source 1..37: mol_type = genomic DNA
agggagactgagtggcgagaaccgagatgttggcaaa

SEQ ID NO: 16017 - DNA, 30 bp, Homo sapiens
  misc_feature 1..30: note = chr16:4410956-4410986
  misc_feature 1..30: note = hypo
  source 1..30: mol_type = genomic DNA
ccctgcagcttcagccgatcagctccagcc

SEQ ID NO: 16018 - DNA, 30 bp, Homo sapiens
  misc_feature 1..30: note = chr16:4840446-4840476
  misc_feature 1..30: note = hypo
  source 1..30: mol_type = genomic DNA
cttctggggaactcccgctccttcctggag

SEQ ID NO: 16019 - DNA, 31 bp, Homo sapiens
  misc_feature 1..31: note = chr16:4846424-4846455
  misc_feature 1..31: note = hypo
  source 1..31: mol_type = genomic DNA
gagctggtctcaggccgggcgcggtggctca

SEQ ID NO: 16020 - DNA, 30 bp, Homo sapiens
  misc_feature 1..30: note = chr16:5439313-5439343
  misc_feature 1..30: note = hypo
  source 1..30: mol_type = genomic DNA
gcataacaggcttttcgaccttggctctat

SEQ ID NO: 16021 - DNA, 136 bp, Homo sapiens
  misc_feature 1..136: note = chr16:8781018-8781154
  misc_feature 1..136: note = hypo
  source 1..136: mol_type = genomic DNA
acggaaagtgtttgccgagagcacttggccgcctgccctcccacggagcaggtgctagtcttgggtcccgctcttccgggttcttcagaagctgagctccggtctgtaatcccagcactttgggaggctgaggcgg

SEQ ID NO: 16022 - DNA, 30 bp, Homo sapiens
  misc_feature 1..30: note = chr16:8870353-8870383
  misc_feature 1..30: note = hypo
  source 1..30: mol_type = genomic DNA
ccccctcccctgccccgcccccaccaccca

SEQ ID NO: 16023 - DNA, 76 bp, Homo sapiens
  misc_feature 1..76: note = chr16:9005728-9005804
  misc_feature 1..76: note = hypo
  source 1..76: mol_type = genomic DNA
aaccttcagagctcacgacaggctgggaagtctgtgttcccaccagccaccgtggaaaaaccgctgaacacctggg

SEQ ID NO: 16024 - DNA, 30 bp, Homo sapiens
  misc_feature 1..30: note = chr16:9010029-9010059
  misc_feature 1..30: note = hypo
  source 1..30: mol_type = genomic DNA
gtgactcaggaccaacgggacagccaacaa

SEQ ID NO: 16025 - DNA, 30 bp, Homo sapiens
  misc_feature 1..30: note = chr16:10804588-10804618
  misc_feature 1..30: note = hypo
  source 1..30: mol_type = genomic DNA
tatcctctccctccccgcctagatattagg

SEQ ID NO: 16026 - DNA, 94 bp, Homo sapiens
  misc_feature 1..94: note = chr16:14725771-14725865
  misc_feature 1..94: note = hypo
  source 1..94: mol_type = genomic DNA
tgaactgggaagcagcgtattaataaatctgtataaataactgtttaatgggggcctggcgccatgactcacacctgtaatcccagcgttttcg

SEQ ID NO: 16027 - DNA, 30 bp, Homo sapiens
  misc_feature 1..30: note = chr16:15762701-15762731
  misc_feature 1..30: note = hypo
  source 1..30: mol_type = genomic DNA
gcccggatcatcctccgttgggagggactg

SEQ ID NO: 16028 - DNA, 68 bp, Homo sapiens
  misc_feature 1..68: note = chr16:15820825-15820893
  misc_feature 1..68: note = hypo
  source 1..68: mol_type = genomic DNA
gcctggcccaggacccgcagctccccggccaggtctgcgttctctttctccagcgtctgcttattctt

SEQ ID NO: 16029 - DNA, 30 bp, Homo sapiens; identical to SEQ ID NO: 5170
  misc_feature 1..30: note = chr16:18802453-18802483
  misc_feature 1..30: note = hypo
  source 1..30: mol_type = genomic DNA

SEQ ID NO: 16030 - DNA, 45 bp, Homo sapiens; identical to SEQ ID NO: 5171
  misc_feature 1..45: note = chr16:18950973-18951018
  misc_feature 1..45: note = hypo
  source 1..45: mol_type = genomic DNA

SEQ ID NO: 16031 - DNA, 30 bp, Homo sapiens
  misc_feature 1..30: note = chr16:19534836-19534866
  misc_feature 1..30: note = hypo
  source 1..30: mol_type = genomic DNA
aggcgtaagccatcacgcccggtgggttca

SEQ ID NO: 16032 - DNA, 30 bp, Homo sapiens
  misc_feature 1..30: note = chr16:23303315-23303345
  misc_feature 1..30: note = hypo
  source 1..30: mol_type = genomic DNA
tgtttttttctctcacgccccacatccaat

SEQ ID NO: 16033 - DNA, 18 bp, Homo sapiens
  misc_feature 1..18: note = chr16:26664757-26664775
  misc_feature 1..18: note = hypo
  source 1..18: mol_type = genomic DNA
acccggcccttttgtcca

SEQ ID NO: 16034 - DNA, 42 bp, Homo sapiens
  misc_feature 1..42: note = chr16:28560194-28560236
  misc_feature 1..42: note = hypo
  source 1..42: mol_type = genomic DNA
cccagacatcattgtcgccctccgcaacggtgcatctgtgct

SEQ ID NO: 16035 - DNA, 78 bp, Homo sapiens
  misc_feature 1..78: note = chr16:28878714-28878792
  misc_feature 1..78: note = hypo
  source 1..78: mol_type = genomic DNA
ctggagatgcctgaccgggagaacacgtttgtggttaaggtaggaattcaacttcccagccgccggcagtgcttgtgt

SEQ ID NO: 16036 - DNA, 34 bp, Homo sapiens
  misc_feature 1..34: note = chr16:29139111-29139145
  misc_feature 1..34: note = hypo
  source 1..34: mol_type = genomic DNA
tacagaccaggaaaacgggcggagaggctgagtg

SEQ ID NO: 16037 - DNA, 55 bp, Homo sapiens
  misc_feature 1..55: note = chr16:29153203-29153258
  misc_feature 1..55: note = hypo
  source 1..55: mol_type = genomic DNA
catggcacaagggagcggtggaataatcctctgtggcacgcgggggggggtgtgg

SEQ ID NO: 16038 - DNA, 81 bp, Homo sapiens
  misc_feature 1..81: note = chr16:29831042-29831123
  misc_feature 1..81: note = hypo
  source 1..81: mol_type = genomic DNA
agtagtctcttccctcggcagcggaaatactgattcccactgctcctgcctctagggtgcagtgtccgtacctgctggagc

SEQ ID NO: 16039 - DNA, 337 bp, Homo sapiens; identical to SEQ ID NO: 5172
  misc_feature 1..337: note = chr16:30017290-30017627
  misc_feature 1..337: note = hypo
  source 1..337: mol_type = genomic DNA

SEQ ID NO: 16040 - DNA, 30 bp, Homo sapiens
  misc_feature 1..30: note = chr16:30116285-30116315
  misc_feature 1..30: note = hypo
  source 1..30: mol_type = genomic DNA
ggctgcttcaaaatccgactcttcattaag

SEQ ID NO: 16041 - DNA, 294 bp, Homo sapiens; identical to SEQ ID NO: 5173
  misc_feature 1..294: note = chr16:30124567-30124861
  misc_feature 1..294: note = hypo
  source 1..294: mol_type = genomic DNA

SEQ ID NO: 16042 - DNA, 20 bp, Homo sapiens
  misc_feature 1..20: note = chr16:30826363-30826383
  misc_feature 1..20: note = hypo
  source 1..20: mol_type = genomic DNA
gctcccgtccaggacaggga

SEQ ID NO: 16043 - DNA, 22 bp, Homo sapiens
  misc_feature 1..22: note = chr16:30907048-30907070
  misc_feature 1..22: note = hypo
  source 1..22: mol_type = genomic DNA
gcgcacatgcacacacgcgcac

SEQ ID NO: 16044 - DNA, 141 bp, Homo sapiens
  misc_feature 1..141: note = chr16:30907130-30907271
  misc_feature 1..141: note = hypo
  source 1..141: mol_type = genomic DNA
gtccgcatgcacgcacacacgcagacacacgcaagcgcacacacacacgggcctcctcgtcttcattcacaaaccccattagcttctgttgtctatgggcttcctcgacagaccgcgagcccctcgcgggggccagaaacc

SEQ ID NO: 16045 - DNA, 120 bp, Homo sapiens
  misc_feature 1..120: note = chr16:31138607-31138727
  misc_feature 1..120: note = hypo
  source 1..120: mol_type = genomic DNA
caagctctggctctgcgagtactgcctcaagtacatgaaatatgagaagagctaccgcttccacttggtgaggctgggccggccgggccgagctgggcaggggcccggtgagaggcagag

SEQ ID NO: 16046 - DNA, 197 bp, Homo sapiens; identical to SEQ ID NO: 1609
  misc_feature 1..197: note = chr16:31446899-31447096
  misc_feature 1..197: note = hypo
  source 1..197: mol_type = genomic DNA

SEQ ID NO: 16047 - DNA, 33 bp, Homo sapiens
  misc_feature 1..33: note = chr16:31500544-31500577
  misc_feature 1..33: note = hypo
  source 1..33: mol_type = genomic DNA
cccagctttcctctgcggcgtgcactacctcta

SEQ ID NO: 16048 - DNA, 105 bp, Homo sapiens
  misc_feature 1..105: note = chr16:33893476-33893581
  misc_feature 1..105: note = hypo
  source 1..105: mol_type = genomic DNA
attcgatgattcaattggatgtcattcgatgattccataagattccctttgatgatgattctattccgtcctttcaatgatgataccaatcgattccattcgatg

SEQ ID NO: 16049 - DNA, 49 bp, Homo sapiens
  misc_feature 1..49: note = chr16:46721677-46721726
  misc_feature 1..49: note = hypo
  source 1..49: mol_type = genomic DNA
tcggatgcaaaagtgcgacaccaagaagactaagcgagctgcctaaatt

SEQ ID NO: 16050 - DNA, 91 bp, Homo sapiens
  misc_feature 1..91: note = chr16:48642042-48642133
  misc_feature 1..91: note = hypo
  source 1..91: mol_type = genomic DNA
ctttctgacattctccgagcgttttattactattaatggtttttttccgattctcaagaacacggttttcaccgtgtgacacaggacagtc

SEQ ID NO: 16051 - DNA, 34 bp, Homo sapiens
  misc_feature 1..34: note = chr16:53448517-53448551
  misc_feature 1..34: note = hypo
  source 1..34: mol_type = genomic DNA
accacaaagattagccgggcgtggtgggccgcac

SEQ ID NO: 16052 - DNA, 32 bp, Homo sapiens
  misc_feature 1..32: note = chr16:53563622-53563654
  misc_feature 1..32: note = hypo
  source 1..32: mol_type = genomic DNA
caagtgtcgagcagacgcggatgtgaatatga

SEQ ID NO: 16053 - DNA, 30 bp, Homo sapiens
  misc_feature 1..30: note = chr16:55203930-55203960
  misc_feature 1..30: note = hypo
  source 1..30: mol_type = genomic DNA
tgggatccagggacccggagtcttgcatct

SEQ ID NO: 16054 - DNA, 30 bp, Homo sapiens
  misc_feature 1..30: note = chr16:57222226-57222256
  misc_feature 1..30: note = hypo
  source 1..30: mol_type = genomic DNA
tggttttccaaatatcgggcaatcatttcc

SEQ ID NO: 16055 - DNA, 30 bp, Homo sapiens
  misc_feature 1..30: note = chr16:57759922-57759952
  misc_feature 1..30: note = hypo
  source 1..30: mol_type = genomic DNA
aaatctcctctcacacgctcatcctttgct

SEQ ID NO: 16056 - DNA, 38 bp, Homo sapiens
  misc_feature 1..38: note = chr16:59046529-59046567
  misc_feature 1..38: note = hypo
  source 1..38: mol_type = genomic DNA
ggaaccccatgtattcggttaatttttttttttttttt

SEQ ID NO: 16057 - DNA, 93 bp, Homo sapiens
  misc_feature 1..93: note = chr16:67313865-67313958
  misc_feature 1..93: note = hypo
  source 1..93: mol_type = genomic DNA
ctcgactgtcttcagcgcggttcacactgagacccagccctctcccgctggccccgagcaggcccacctttaggagggcgtgatggaaaggcc

SEQ ID NO: 16058 - DNA, 39 bp, Homo sapiens
  misc_feature 1..39: note = chr16:67578633-67578672
  misc_feature 1..39: note = hypo
  source 1..39: mol_type = genomic DNA
gcatgggccctggagcggctgctgcgggaagcccgagta

SEQ ID NO: 16059 - DNA, 27 bp, Homo sapiens
  misc_feature 1..27: note = chr16:68770701-68770728
  misc_feature 1..27: note = hypo
  source 1..27: mol_type = genomic DNA
aaaaaattagcctggcgtggtggtgtg

SEQ ID NO: 16060 - DNA, 147 bp, Homo sapiens
  misc_feature 1..147: note = chr16:68770848-68770995
  misc_feature 1..147: note = hypo
  source 1..147: mol_type = genomic DNA
cccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccata

SEQ ID NO: 16061 - DNA, 18 bp, Homo sapiens
  misc_feature 1..18: note = chr16:68876852-68876870
  misc_feature 1..18: note = hypo
  source 1..18: mol_type = genomic DNA
tttgagatggagtctcgc

SEQ ID NO: 16062 - DNA, 30 bp, Homo sapiens
  misc_feature 1..30: note = chr16:70595670-70595700
  misc_feature 1..30: note = hypo
  source 1..30: mol_type = genomic DNA
tccaccaacaccctacggtgagtgagtctc

SEQ ID NO: 16063 - DNA, 29 bp, Homo sapiens
  misc_feature 1..29: note = chr16:71919039-71919068
  misc_feature 1..29: note = hypo
  source 1..29: mol_type = genomic DNA
taagccactgtgcccggcctggttggacg

SEQ ID NO: 16064 - DNA, 84 bp, Homo sapiens
  misc_feature 1..84: note = chr16:72461607-72461691
  misc_feature 1..84: note = hypo
  source 1..84: mol_type = genomic DNA
ttaatgaggaataatcgtttggctaatgagctttgaaacattaagagaaaagaggttttttccgttaatcgctctggtgcgact

SEQ ID NO: 16065 - DNA, 51 bp, Homo sapiens
  misc_feature 1..51: note = chr16:72957744-72957795
  misc_feature 1..51: note = hypo
  source 1..51: mol_type = genomic DNA
tactttgaattgcctcgtcctaccacgttcaagacgcggctactgggcagg

SEQ ID NO: 16066 - DNA, 19 bp, Homo sapiens
  misc_feature 1..19: note = chr16:75019669-75019688
  misc_feature 1..19: note = hypo
  source 1..19: mol_type = genomic DNA
aaaccgaagatacctcttc

SEQ ID NO: 16067 - DNA, 209 bp, Homo sapiens
  misc_feature 1..209: note = chr16:75148827-75149036
  misc_feature 1..209: note = hypo
  source 1..209: mol_type = genomic DNA
gattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagcca

SEQ ID NO: 16068 - DNA, 37 bp, Homo sapiens
  misc_feature 1..37: note = chr16:75469082-75469119
  misc_feature 1..37: note = hypo
  source 1..37: mol_type = genomic DNA
ttacaggcgtgagccaccgcgccgggcaccttcaagg

SEQ ID NO: 16069 - DNA, 30 bp, Homo sapiens
  misc_feature 1..30: note = chr16:80654771-80654801
  misc_feature 1..30: note = hypo
  source 1..30: mol_type = genomic DNA
gcagcagtttgctgtcgtctgtggctgcgt

SEQ ID NO: 16070 - DNA, 30 bp, Homo sapiens
  misc_feature 1..30: note = chr16:81533258-81533288
  misc_feature 1..30: note = hypo
  source 1..30: mol_type = genomic DNA
catgtggcctctgcccggggagcagaggtg

SEQ ID NO: 16071 - DNA, 180 bp, Homo sapiens
  misc_feature 1..180: note = chr16:81632932-81633112
  misc_feature 1..180: note = hypo
  source 1..180: mol_type = genomic DNA
cttctaggatcatatcgttacctgccactttgcgtttgctgtatgactttccgtttgtgagattaaaaagaacatgaaatattttgacgggccttccccaaatgagcatccatgggtttctgccttggaggccaagctgatctataggtgtctgaggacctgctgcgtggggtagcaaca

SEQ ID NO: 16072 - DNA, 30 bp, Homo sapiens
  misc_feature 1..30: note = chr16:83968795-83968825
  misc_feature 1..30: note = hypo
  source 1..30: mol_type = genomic DNA
agaaaaatgtagctgcgtgagcgggaggga

SEQ ID NO: 16073 - DNA, 41 bp, Homo sapiens
  misc_feature 1..41: note = chr16:84075186-84075227
  misc_feature 1..41: note = hypo
  source 1..41: mol_type = genomic DNA
cgattataggcacgagccaccgtgcccggcccagctttagt

SEQ ID NO: 16074 - DNA, 30 bp, Homo sapiens
  misc_feature 1..30: note = chr16:84153364-84153394
  misc_feature 1..30: note = hypo
  source 1..30: mol_type = genomic DNA
actggcaaccaaagtcgaacatgatggaag

SEQ ID NO: 16075 - DNA, 58 bp, Homo sapiens
  misc_feature 1..58: note = chr16:85007798-85007856
  misc_feature 1..58: note = hypo
  source 1..58: mol_type = genomic DNA
ttgtttttatttcaacgtgcactaaaaaaaggactaagtaaaacgatgggagtcgaat

SEQ ID NO: 16076 - DNA, 173 bp, Homo sapiens
  misc_feature 1..173: note = chr16:85028164-85028337
  misc_feature 1..173: note = hypo
  source 1..173: mol_type = genomic DNA
gagccagctcagctccgccttcctggttcaggtcctggtaagacctccacggagtgcaggatgctgctgtggctccatgcctgacctgggggtgcggatggcaggcacagctgtgtaaggagagcgcccacagacaccaaacactggccatggcaggacgttcctataagcac

SEQ ID NO: 16077 - DNA, 55 bp, Homo sapiens
  misc_feature 1..55: note = chr16:85033827-85033882
  misc_feature 1..55: note = hypo
  source 1..55: mol_type = genomic DNA
cagcacaggtatgtacggccggtgtgatagtgcaagggtgcggcacaaggcaagt

SEQ ID NO: 16078 - DNA, 16 bp, Homo sapiens
  misc_feature 1..16: note = chr16:85043890-85043906
  misc_feature 1..16: note = hypo
  source 1..16: mol_type = genomic DNA
gcgctgggattacagg

SEQ ID NO: 16079 - DNA, 30 bp, Homo sapiens
  misc_feature 1..30: note = chr16:85075540-85075570
  misc_feature 1..30: note = hypo
  source 1..30: mol_type = genomic DNA
tttgcccctatgctgcgcactcctgtccct

SEQ ID NO: 16080 - DNA, 101 bp, Homo sapiens
  misc_feature 1..101: note = chr16:85083589-85083690
  misc_feature 1..101: note = hypo
  source 1..101: mol_type = genomic DNA
tgtcccggagtcagccgctgtgtccttttgtgaaagaagtacagcccgtcacccagggagggcgcgccttatggcgggttctaacacgcagttgcaatgga

SEQ ID NO: 16081 - DNA, 197 bp, Homo sapiens
  misc_feature 1..197: note = chr16:85336384-85336581
  misc_feature 1..197: note = hypo
  source 1..197: mol_type = genomic DNA
tggccttggccttgtcgaggtgcggtgtgctgggcagggtgggtgaggtcagcggctgtcacaagtaaccctgcgtcttcagtggcgtgatgcagccgaagcgcattctccttcaatcgggtccaacggggtgctcagtgggtcttccacaaggtgactcggggtccggtttcccggagcctcggcctccccactgc

SEQ ID NO: 16082 - DNA, 68 bp, Homo sapiens
  misc_feature 1..68: note = chr16:85455150-85455218
  misc_feature 1..68: note = hypo
  source 1..68: mol_type = genomic DNA
caaacagctgcacagcgattttctgaccaggcggggaggagaaggcaggttttcggggctgctggcag

SEQ ID NO: 16083 - DNA, 49 bp, Homo sapiens
  misc_feature 1..49: note = chr16:85485769-85485818
  misc_feature 1..49: note = hypo
  source 1..49: mol_type = genomic DNA
caccctggcctgcatcggggccccgcaattaagccgattatgttttgag

SEQ ID NO: 16084 - DNA, 32 bp, Homo sapiens
  misc_feature 1..32: note = chr16:85671134-85671166
  misc_feature 1..32: note = hypo
  source 1..32: mol_type = genomic DNA
gagtccccccttgatcgcggcagtggctgtgt

SEQ ID NO: 16085 - DNA, 34 bp, Homo sapiens
  misc_feature 1..34: note = chr16:85673852-85673886
  misc_feature 1..34: note = hypo
  source 1..34: mol_type = genomic DNA
tcgctcccttaacaccggccgggggctcatggta

SEQ ID NO: 16086 - DNA, 110 bp, Homo sapiens
  misc_feature 1..110: note = chr16:85674157-85674267
  misc_feature 1..110: note = hypo
  source 1..110: mol_type = genomic DNA
ggtgccacctgaaaccgagatcccagctgagtgagtggggactacgtgtgcggggaccacggagcagggaccacagacccatcctcatgagctgccgtgggaatgcttcc

SEQ ID NO: 16087 - DNA, 304 bp, Homo sapiens
  misc_feature 1..304: note = chr16:85684237-85684541
  misc_feature 1..304: note = hypo
  source 1..304: mol_type = genomic DNA
ccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatga

SEQ ID NO: 16088 - DNA, 30 bp, Homo sapiens
  misc_feature 1..30: note = chr16:85721581-85721611
  misc_feature 1..30: note = hypo
  source 1..30: mol_type = genomic DNA
ctgaaaacgcaaagccgggcgggcgcgggg

SEQ ID NO: 16089 - DNA, 30 bp, Homo sapiens
  misc_feature 1..30: note = chr16:85731482-85731512
  misc_feature 1..30: note = hypo
  source 1..30: mol_type = genomic DNA
aagggaggttgagaccgggaacttgagaag

SEQ ID NO: 16090 - DNA, 147 bp, Homo sapiens
  misc_feature 1..147: note = chr16:87296936-87297083
  misc_feature 1..147: note = hypo
  source 1..147: mol_type = genomic DNA
gtgacctattctttagtaactgttcccttgaggaagaatctgacaccctggtgcattctcacgcactatccccaccagcctgccagggcattccctgagcactgggcacaggggaagctggacaaccagtcccggggcttggcaaaa

SEQ ID NO: 16091 - DNA, 22 bp, Homo sapiens
  misc_feature 1..22: note = chr16:87421399-87421421
  misc_feature 1..22: note = hypo
  source 1..22: mol_type = genomic DNA
gcctgggcgacagagagaaaaa

SEQ ID NO: 16092 - DNA, 102 bp, Homo sapiens
  misc_feature 1..102: note = chr16:87594957-87595059
  misc_feature 1..102: note = hypo
  source 1..102: mol_type = genomic DNA
cctaaggattggaaacgaccatcggcaggggacgggttaaaccgattaaggtgactgacaccgcgcagtgatgcgcagccagtgtaacggccctgtggagga

SEQ ID NO: 16093 - DNA, 90 bp, Homo sapiens
  misc_feature 1..90: note = chr16:87723156-87723246
  misc_feature 1..90: note = hypo
  source 1..90: mol_type = genomic DNA
tgaggttccctctggcgccctggcccggggaccgcggcctcgctgtggaatgtgctgggtaacgccgtctggcgtcgtcttgtgtcccca

SEQ ID NO: 16094 - DNA, 465 bp, Homo sapiens; identical to SEQ ID NO: 1611
  misc_feature 1..465: note = chr16:87723648-87724113
  misc_feature 1..465: note = hypo
  source 1..465: mol_type = genomic DNA

SEQ ID NO: 16095 - DNA, 154 bp, Homo sapiens
  misc_feature 1..154: note = chr16:88498606-88498760
  misc_feature 1..154: note = hypo
  source 1..154: mol_type = genomic DNA
aggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctca

SEQ ID NO: 16096 - DNA, 30 bp, Homo sapiens
  misc_feature 1..30: note = chr16:88503235-88503265
  misc_feature 1..30: note = hypo
  source 1..30: mol_type = genomic DNA
tgcttccagcgcttccgcagcctgggcgag

SEQ ID NO: 16097 - DNA, 178 bp, Homo sapiens
  misc_feature 1..178: note = chr16:88504017-88504195
  misc_feature 1..178: note = hypo
  source 1..178: mol_type = genomic DNA
gctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaag

SEQ ID NO: 16098 - DNA, 93 bp, Homo sapiens
  misc_feature 1..93: note = chr16:88506448-88506541
  misc_feature 1..93: note = hypo
  source 1..93: mol_type = genomic DNA
cccgcgggccctcctcgttccctcccagcctccatggccgccctctagagcctccctgctgtacggagctctgggctccgcctatttgcaatg

SEQ ID NO: 16099 - DNA, 56 bp, Homo sapiens
  misc_feature 1..56: note = chr16:88508016-88508072
  misc_feature 1..56: note = hypo
  source 1..56: mol_type = genomic DNA
tccacttgttgctggcggaactcacaccgtaagggcgtctgcgaaggggcccagcg

SEQ ID NO: 16100 - DNA, 30 bp, Homo sapiens
  misc_feature 1..30: note = chr16:88551519-88551549
  misc_feature 1..30: note = hypo
  source 1..30: mol_type = genomic DNA
gactgggcccctgggcggggcactggcagg

SEQ ID NO: 16101 - DNA, 46 bp, Homo sapiens
  misc_feature 1..46: note = chr16:88603730-88603776
  misc_feature 1..46: note = hypo
  source 1..46: mol_type = genomic DNA
caccccagagggccccgccacggcccggactcgaagcttagggcag

SEQ ID NO: 16102 - DNA, 39 bp, Homo sapiens
  misc_feature 1..39: note = chr16:88623960-88623999
  misc_feature 1..39: note = hypo
  source 1..39: mol_type = genomic DNA
tgcagcctcaaggcacgggagccacggatgcctgaggcc

SEQ ID NO: 16103 - DNA, 45 bp, Homo sapiens
  misc_feature 1..45: note = chr16:88624831-88624876
  misc_feature 1..45: note = hypo
  source 1..45: mol_type = genomic DNA
tccgggggtgtgagtcgcgcatccccccgtcggggggtgagtcgc

SEQ ID NO: 16104 - DNA, 30 bp, Homo sapiens
  misc_feature 1..30: note = chr16:88683871-88683901
  misc_feature 1..30: note = hypo
  source 1..30: mol_type = genomic DNA
tctttatagctaggccgatgggtgtgctca

SEQ ID NO: 16105 - DNA, 48 bp, Homo sapiens
  misc_feature 1..48: note = chr16:88757586-88757634
  misc_feature 1..48: note = hypo
  source 1..48: mol_type = genomic DNA
gcgtgtgtccatgggcgtatgcgtgtgggaagtcgcagtagctgctct

SEQ ID NO: 16106 - DNA, 41 bp, Homo sapiens
  misc_feature 1..41: note = chr16:88832763-88832804
  misc_feature 1..41: note = hypo
  source 1..41: mol_type = genomic DNA
agccagcgcgccctgcgaacttcagacgtgacagccccaca

SEQ ID NO: 16107 - DNA, 200 bp, Homo sapiens
  misc_feature 1..200: note = chr16:88883254-88883454
  misc_feature 1..200: note = hypo
  source 1..200: mol_type = genomic DNA
gaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgaggg

SEQ ID NO: 16108 - DNA, 30 bp, Homo sapiens
  misc_feature 1..30: note = chr16:88931261-88931291
  misc_feature 1..30: note = hypo
  source 1..30: mol_type = genomic DNA
ttgatgacccggccccggaagaggctctgg

SEQ ID NO: 16109 - DNA, 30 bp, Homo sapiens
  misc_feature 1..30: note = chr16:88943136-88943166
  misc_feature 1..30: note = hypo
  source 1..30: mol_type = genomic DNA
gtcaggaggtctccgcgcggaatcattagg

SEQ ID NO: 16110 - DNA, 312 bp, Homo sapiens; identical to SEQ ID NO: 1612
  misc_feature 1..312: note = chr16:88943712-88944024
  misc_feature 1..312: note = hypo
  source 1..312: mol_type = genomic DNA

SEQ ID NO: 16111 - DNA, 477 bp, Homo sapiens
  misc_feature 1..477: note = chr16:88945602-88946079
  misc_feature 1..477: note = hypo
  source 1..477: mol_type = genomic DNA
tcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctca

SEQ ID NO: 16112 - DNA, 138 bp, Homo sapiens
  misc_feature 1..138: note = chr16:88948551-88948689
  misc_feature 1..138: note = hypo
  source 1..138: mol_type = genomic DNA
ggtgaaggacccagccgctgcgcagggacggcgcaggccacacaggagggcactgagctcaggggcgcccacacagccctgctgtctccagcagccccaggccccatggggcagagccatggccgtgtttatgcatag

SEQ ID NO: 16113 - DNA, 186 bp, Homo sapiens
  misc_feature 1..186: note = chr16:88952219-88952405
  misc_feature 1..186: note = hypo
  source 1..186: mol_type = genomic DNA
tagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgactt

SEQ ID NO: 16114 - DNA, 30 bp, Homo sapiens
  misc_feature 1..30: note = chr16:88952665-88952695
  misc_feature 1..30: note = hypo
  source 1..30: mol_type = genomic DNA
aaaggtcaaggtgctcgacctctctgggcc

SEQ ID NO: 16115 - DNA, 160 bp, Homo sapiens; identical to SEQ ID NO: 5178
  misc_feature 1..160: note = chr16:88955208-88955368
  misc_feature 1..160: note = hypo
  source 1..160: mol_type = genomic DNA

SEQ ID NO: 16116 - DNA, 109 bp, Homo sapiens
  misc_feature 1..109: note = chr16:88956230-88956339
  misc_feature 1..109: note = hypo
  source 1..109: mol_type = genomic DNA
ctggacgatgccccgcgattcctcctcctccagggacacttcaaatccctggacgacgccccgcgattcctcctccttcagggacgacgccccgcgattcctcctcctc

SEQ ID NO: 16117 - DNA, 541 bp, Homo sapiens; identical to SEQ ID NO: 5179
  misc_feature 1..541: note = chr16:88957405-88957946
  misc_feature 1..541: note = hypo
  source 1..541: mol_type = genomic DNA

SEQ ID NO: 16118 - DNA, 91 bp, Homo sapiens
  misc_feature 1..91: note = chr16:88958358-88958449
  misc_feature 1..91: note = hypo
  source 1..91: mol_type = genomic DNA
ctcgatcgtcaatgtcgagttctgcaggggagaaaacccacctcacatcagcaccgctcggcatgtgagccagcgccgacccacccatgcc

SEQ ID NO: 16119 - DNA, 549 bp, Homo sapiens; identical to SEQ ID NO: 5180
  misc_feature 1..549: note = chr16:88963214-88963763
  misc_feature 1..549: note = hypo
  source 1..549: mol_type = genomic DNA

SEQ ID NO: 16120 - DNA, 201 bp, Homo sapiens
  misc_feature 1..201: note = chr16:88966387-88966588
  misc_feature 1..201: note = hypo
  source 1..201: mol_type = genomic DNA
agggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagta

SEQ ID NO: 16121 - DNA, 30 bp, Homo sapiens
  misc_feature 1..30: note = chr16:88976653-88976683
  misc_feature 1..30: note = hypo
  source 1..30: mol_type = genomic DNA
aggctgcctccttcccggtgatgctgcagc

SEQ ID NO: 16122 - DNA, 48 bp, Homo sapiens
  misc_feature 1..48: note = chr16:88978024-88978072
  misc_feature 1..48: note = hypo
  source 1..48: mol_type = genomic DNA
tggggatggaattcccgcagaatcacggagggacgaagtacatgagct

SEQ ID NO: 16123 - DNA, 57 bp, Homo sapiens
  misc_feature 1..57: note = chr16:88994398-88994455
  misc_feature 1..57: note = hypo
  source 1..57: mol_type = genomic DNA
tctgtccacaggcagcggctcccggcacccaccgctgctgaccgagcccctggcacc

SEQ ID NO: 16124 - DNA, 32 bp, Homo sapiens
  misc_feature 1..32: note = chr16:89000172-89000204
  misc_feature 1..32: note = hypo
  source 1..32: mol_type = genomic DNA
acagtgccacacgtctgcgtccccacagccat

SEQ ID NO: 16125 - DNA, 49 bp, Homo sapiens
  misc_feature 1..49: note = chr16:89001075-89001124
  misc_feature 1..49: note = hypo
  source 1..49: mol_type = genomic DNA
gaggcagagatgccacgaaagaggcacgaagggccgtgccctgccctct

SEQ ID NO: 16126 - DNA, 38 bp, Homo sapiens
  misc_feature 1..38: note = chr16:89025782-89025820
  misc_feature 1..38: note = hypo
  source 1..38: mol_type = genomic DNA
gaggtggagggaacacgcatgcacgcccagggctggag

SEQ ID NO: 16127 - DNA, 30 bp, Homo sapiens
  misc_feature 1..30: note = chr16:89026022-89026052
  misc_feature 1..30: note = hypo
  source 1..30: mol_type = genomic DNA
ggagagggaaggtcccggggaaaccctcct

SEQ ID NO: 16128 - DNA, 256 bp, Homo sapiens
  misc_feature 1..256: note = chr16:89055673-89055929
  misc_feature 1..256: note = hypo
  source 1..256: mol_type = genomic DNA
ccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggag

SEQ ID NO: 16129 - DNA, 271 bp, Homo sapiens; identical to SEQ ID NO: 5181
  misc_feature 1..271: note = chr16:89072503-89072774
  misc_feature 1..271: note = hypo
  source 1..271: mol_type = genomic DNA

SEQ ID NO: 16130 - DNA, 109 bp, Homo sapiens
  misc_feature 1..109: note = chr16:89107675-89107784
  misc_feature 1..109: note = hypo
  source 1..109: mol_type = genomic DNA
agttctccagagtgccggccctccactcgagttcccctgccccggggaatgccctttccctacacctgcaatcccctgagggacgggaggaggccggtagtccatgagc

SEQ ID NO: 16131 - DNA, 30 bp, Homo sapiens
  misc_feature 1..30: note = chr16:89109506-89109536
  misc_feature 1..30: note = hypo
  source 1..30: mol_type = genomic DNA
attctatgattgatccgtcatgcctgccgt

SEQ ID NO: 16132 - DNA, 93 bp, Homo sapiens; identical to SEQ ID NO: 5182
  misc_feature 1..93: note = chr16:89120243-89120336
  misc_feature 1..93: note = hypo
  source 1..93: mol_type = genomic DNA

SEQ ID NO: 16133 - DNA, 33 bp, Homo sapiens
  misc_feature 1..33: note = chr16:89120708-89120741
  misc_feature 1..33: note = hypo
  source 1..33: mol_type = genomic DNA
tgctccccagaacctcgtcgtcttcccggtgcc

SEQ ID NO: 16134 - DNA, 44 bp, Homo sapiens
  misc_feature 1..44: note = chr16:89138016-89138060
  misc_feature 1..44: note = hypo
  source 1..44: mol_type = genomic DNA
gaggaaagacagacacggcgttggctgcgcgggggcctgcatcc

SEQ ID NO: 16135 - DNA, 115 bp, Homo sapiens
  misc_feature 1..115: note = chr16:89172217-89172332
  misc_feature 1..115: note = hypo
  source 1..115: mol_type = genomic DNA
gcaggttggttccatcgtcccggagggcaggttggttccatcctcccaagtaaagagtgtgttaccctcagggcgagaggcaggtgggtgtgggtgctggcgcaggccagctgtc

SEQ ID NO: 16136 - DNA, 30 bp, Homo sapiens
  misc_feature 1..30: note = chr16:89189873-89189903
  misc_feature 1..30: note = hypo
  source 1..30: mol_type = genomic DNA
acggtcccggatccacgtggctcaagtgag

SEQ ID NO: 16137 - DNA, 71 bp, Homo sapiens; identical to SEQ ID NO: 1613
  misc_feature 1..71: note = chr16:89220327-89220398
  misc_feature 1..71: note = hypo
  source 1..71: mol_type = genomic DNA

SEQ ID NO: 16138 - DNA, 385 bp, Homo sapiens; identical to SEQ ID NO: 5184
  misc_feature 1..385: note = chr16:89220641-89221026
  misc_feature 1..385: note = hypo
  source 1..385: mol_type = genomic DNA

SEQ ID NO: 16139 - DNA, 30 bp, Homo sapiens
  misc_feature 1..30: note = chr16:89225881-89225911
  misc_feature 1..30: note = hypo
  source 1..30: mol_type = genomic DNA
ggcggagggcgctgccgcaggtccccacat

SEQ ID NO: 16140 - DNA, 34 bp, Homo sapiens
  misc_feature 1..34: note = chr16:89226363-89226397
  misc_feature 1..34: note = hypo
  source 1..34: mol_type = genomic DNA
gcgccatgcagaggccgctcggtcctcaggagct

SEQ ID NO: 16141 - DNA, 126 bp, Homo sapiens
  misc_feature 1..126: note = chr16:89245316-89245442
  misc_feature 1..126: note = hypo
  source 1..126: mol_type = genomic DNA
ttcttggggtcattccgtgtcaggaccccacgctctccccagccctggctggcccaggggctttccgtgtgcaccgctaccctggcacctggggcgaggctgtgtccccgccgggtgaatctcagg

SEQ ID NO: 16142 - DNA, 35 bp, Homo sapiens
  misc_feature 1..35: note = chr16:89245710-89245745
  misc_feature 1..35: note = hypo
  source 1..35: mol_type = genomic DNA
ctgagggaaacactgcgccccgtggcctcctcacc

SEQ ID NO: 16143 - DNA, 139 bp, Homo sapiens
  misc_feature 1..139: note = chr16:89254633-89254772
  misc_feature 1..139: note = hypo
  source 1..139: mol_type = genomic DNA
gggcagttcaccatccgcacggaccccaagaccaacgagggtgttctgtccattgtgaaggtgagcggcccccggctggcacacagatgccggcagacgcagatgccgacacacacagatgcccacacacagatgccgg

SEQ ID NO: 16144 - DNA, 55 bp, Homo sapiens; identical to SEQ ID NO: 5185
  misc_feature 1..55: note = chr16:89558648-89558703
  misc_feature 1..55: note = hypo
  source 1..55: mol_type = genomic DNA

SEQ ID NO: 16145 - DNA, 24 bp, Homo sapiens
  misc_feature 1..24: note = chr16:89575654-89575678
  misc_feature 1..24: note = hypo
  source 1..24: mol_type = genomic DNA
aggttgttgttttttcggttattt

SEQ ID NO: 16146 - DNA, 30 bp, Homo sapiens
  misc_feature 1..30: note = chr16:89576068-89576098
  misc_feature 1..30: note = hypo
  source 1..30: mol_type = genomic DNA
tgacagcaggagccccgtgtctgggcagcc

SEQ ID NO: 16147 - DNA, 79 bp, Homo sapiens
  misc_feature 1..79: note = chr16:89655054-89655133
  misc_feature 1..79: note = hypo
  source 1..79: mol_type = genomic DNA
acagctcctggctcccggcccactgcaggtggccattgacttcaccgcctccaatggagacccgcggaacagctgctcc

SEQ ID NO: 16148 - DNA, 30 bp, Homo sapiens
  misc_feature 1..30: note = chr16:89668379-89668409
  misc_feature 1..30: note = hypo
  source 1..30: mol_type = genomic DNA
aggagatgtggctcccgggaaactgacgat

SEQ ID NO: 16149 - DNA, 40 bp, Homo sapiens
  misc_feature 1..40: note = chr16:89702746-89702786
  misc_feature 1..40: note = hypo
  source 1..40: mol_type = genomic DNA
gtccaccgcatgtgccggatgtacccggagaccttcctgt

SEQ ID NO: 16150 - DNA, 30 bp, Homo sapiens
  misc_feature 1..30: note = chr16:89704648-89704678
  misc_feature 1..30: note = hypo
  source 1..30: mol_type = genomic DNA
cccctttagggttcccggagctccgggaag

SEQ ID NO: 16151 - DNA, 233 bp, Homo sapiens; identical to SEQ ID NO: 5186
  misc_feature 1..233: note = chr16:89883952-89884185
  misc_feature 1..233: note = hypo
  source 1..233: mol_type = genomic DNA

SEQ ID NO: 16152 - DNA, 165 bp, Homo sapiens
  misc_feature 1..165: note = chr16:89900625-89900790
  misc_feature 1..165: note = hypo
  source 1..165: mol_type = genomic DNA
gtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggat

SEQ ID NO: 16153 - DNA, 40 bp, Homo sapiens
  misc_feature 1..40: note = chr16:90066907-90066947
  misc_feature 1..40: note = hypo
  source 1..40: mol_type = genomic DNA
gagctgctgggcccccggcccttctcggagaagtctacct

SEQ ID NO: 16154 - DNA, 133 bp, Homo sapiens
  misc_feature 1..133: note = chr16:90069191-90069324
  misc_feature 1..133: note = hypo
  source 1..133: mol_type = genomic DNA
ctgtctgtgctgtagcggtctgtgcaccctgcagggacacgagccttcagcccctgtatttctcagcctgcctgcctccctccctctgccagaagggaaggtggaatggggtggaatgcgtgtacctgccagt

SEQ ID NO: 16155 - DNA, 32 bp, Homo sapiens; identical to SEQ ID NO: 5187
  misc_feature 1..32: note = chr17:1136665-1136697
  misc_feature 1..32: note = hypo
  source 1..32: mol_type = genomic DNA

SEQ ID NO: 16156 - DNA, 18 bp, Homo sapiens
  misc_feature 1..18: note = chr17:1471448-1471466
  misc_feature 1..18: note = hypo
  source 1..18: mol_type = genomic DNA
acccggccactctttcat

SEQ ID NO: 16157 - DNA, 84 bp, Homo sapiens
  misc_feature 1..84: note = chr17:1546366-1546450
  misc_feature 1..84: note = hypo
  source 1..84: mol_type = genomic DNA
ctcccggcgccccgccgcggccacctgtctccgctccgccccgcccgctcacaggtctccgcgcagcctcgctcacctgtgtcc

SEQ ID NO: 16158 - DNA, 120 bp, Homo sapiens; identical to SEQ ID NO: 1614
  misc_feature 1..120: note = chr17:2207818-2207938
  misc_feature 1..120: note = hypo
  source 1..120: mol_type = genomic DNA

SEQ ID NO: 16159 - DNA, 36 bp, Homo sapiens; identical to SEQ ID NO: 5189
  misc_feature 1..36: note = chr17:2220961-2220997
  misc_feature 1..36: note = hypo
  source 1..36: mol_type = genomic DNA

SEQ ID NO: 16160 - DNA, 30 bp, Homo sapiens
  misc_feature 1..30: note = chr17:2298979-2299009
  misc_feature 1..30: note = hypo
  source 1..30: mol_type = genomic DNA
gggggctgacagtcacgggggctgacagtc

SEQ ID NO: 16161 - DNA, 30 bp, Homo sapiens; identical to SEQ ID NO: 1615
  misc_feature 1..30: note = chr17:3658849-3658879
  misc_feature 1..30: note = hypo
  source 1..30: mol_type = genomic DNA

SEQ ID NO: 16162 - DNA, 170 bp, Homo sapiens
  misc_feature 1..170: note = chr17:3741605-3741775
  misc_feature 1..170: note = hypo
  source 1..170: mol_type = genomic DNA
ctcgggaccagaggtcgacaggtgtgataaagctatgacgccctcgcggtagagttgtgagagagactcacaggtatgcttgcgcccggctgtgcaggcacatgaaggtcaagccacacctggccttcacaggacttctcctcaaacagaaaccccgcccatgagggaag

SEQ ID NO: 16163 - DNA, 39 bp, Homo sapiens
  misc_feature 1..39: note = chr17:4236673-4236712
  misc_feature 1..39: note = hypo
  source 1..39: mol_type = genomic DNA
gtaaaatgtaaaagacgggccgggcacggtggctctgtc

SEQ ID NO: 16164 - DNA, 30 bp, Homo sapiens
  misc_feature 1..30: note = chr17:4976853-4976883
  misc_feature 1..30: note = hypo
  source 1..30: mol_type = genomic DNA
agacggtgggccaggcgtggtagctcacgg

SEQ ID NO: 16165 - DNA, 69 bp, Homo sapiens
  misc_feature 1..69: note = chr17:7466711-7466780
  misc_feature 1..69: note = hypo
  source 1..69: mol_type = genomic DNA
acctcccagcggccccgcccttcccgccccactcatcgaaaaacctgctcacagcgccgccgccgagcc

SEQ ID NO: 16166 - DNA, 88 bp, Homo sapiens
  misc_feature 1..88: note = chr17:8104512-8104600
  misc_feature 1..88: note = hypo
  source 1..88: mol_type = genomic DNA
gcagagttgcaactccggagtttcccggatagctgcaggcttacccgcaggtaacagtagaagtaggagtcagcgttaaggctgtggg

SEQ ID NO: 16167 - DNA, 33 bp, Homo sapiens
  misc_feature 1..33: note = chr17:8384676-8384709
  misc_feature 1..33: note = hypo
  source 1..33: mol_type = genomic DNA
catctctctcctgctcggcgtgtcggcgggctc

SEQ ID NO: 16168 - DNA, 30 bp, Homo sapiens
  misc_feature 1..30: note = chr17:10212959-10212989
  misc_feature 1..30: note = hypo
  source 1..30: mol_type = genomic DNA
gcgtcgttccggctgcggatttcagcatcc

SEQ ID NO: 16169 - DNA, 30 bp, Homo sapiens
  misc_feature 1..30: note = chr17:11572707-11572737
  misc_feature 1..30: note = hypo
  source 1..30: mol_type = genomic DNA
gatttggcaaacatgcggcgcacactcatg

SEQ ID NO: 16170 - DNA, 30 bp, Homo sapiens
  misc_feature 1..30: note = chr17:11637568-11637598
  misc_feature 1..30: note = hypo
  source 1..30: mol_type = genomic DNA
tacgcacaataaaatcggggactgtgccgc

SEQ ID NO: 16171 - DNA, 30 bp, Homo sapiens
  misc_feature 1..30: note = chr17:16282207-16282237
  misc_feature 1..30: note = hypo
  source 1..30: mol_type = genomic DNA
cttgcacaacaagcacgtcaatgggagcag

SEQ ID NO: 16172 - DNA, 187 bp, Homo sapiens
  misc_feature 1..187: note = chr17:17579341-17579528
  misc_feature 1..187: note = hypo
  source 1..187: mol_type = genomic DNA
tcatcgcagaggaggcggggcggcagcgtgggcaggagctcaggccaggagaatccctactctaagtatgactgtgtgatcttgggcaagtgacttcattccctaagtgtgtttcctcatctgaacaaggaggctattgaaatgcaggtgagacctagtgagacagcggctgcgggaatcacctggc

SEQ ID NO: 16173 - DNA, 96 bp, Homo sapiens
  misc_feature 1..96: note = chr17:17891258-17891354
  misc_feature 1..96: note = hypo
  source 1..96: mol_type = genomic DNA
caacattgagaccatcgaggggctggacacactggtgaacctggaggacctgagcttgttcaacaaccggatctccaagatcgactccctggacgc

SEQ ID NO: 16174 - DNA, 268 bp, Homo sapiens; identical to SEQ ID NO: 5191
  misc_feature 1..268: note = chr17:18163086-18163354
  misc_feature 1..268: note = hypo
  source 1..268: mol_type = genomic DNA

SEQ ID NO: 16175 - DNA, 20 bp, Homo sapiens
  misc_feature 1..20: note = chr17:19769860-19769880
  misc_feature 1..20: note = hypo
  source 1..20: mol_type = genomic DNA
tcatccgataagcaacaaag

SEQ ID NO: 16176 - DNA, 37 bp, Homo sapiens
  misc_feature 1..37: note = chr17:20771887-20771924
  misc_feature 1..37: note = hypo
  source 1..37: mol_type = genomic DNA
ctaggaatcaggagtcggtggccgtatgctggaggct

SEQ ID NO: 16177 - DNA, 23 bp, Homo sapiens
  misc_feature 1..23: note = chr17:20817586-20817609
  misc_feature 1..23: note = hypo
  source 1..23: mol_type = genomic DNA
aatgtgactcttggccgggcgcg

SEQ ID NO: 16178 - DNA, 30 bp, Homo sapiens
  misc_feature 1..30: note = chr17:21104001-21104031
  misc_feature 1..30: note = hypo
  source 1..30: mol_type = genomic DNA
atgtacctgaagctccgaatgtgcctgaca

SEQ ID NO: 16179 - DNA, 53 bp, Homo sapiens
  misc_feature 1..53: note = chr17:21147486-21147539
  misc_feature 1..53: note = hypo
  source 1..53: mol_type = genomic DNA
cgatccgcttgcccacgtactcatagagcaggacggcccggtcatgacatcct

SEQ ID NO: 16180 - DNA, 142 bp, Homo sapiens; identical to SEQ ID NO: 1616
  misc_feature 1..142: note = chr17:25620573-25620715
  misc_feature 1..142: note = hypo
  source 1..142: mol_type = genomic DNA

SEQ ID NO: 16181 - DNA, 40 bp, Homo sapiens
  misc_feature 1..40: note = chr17:26263183-26263223
  misc_feature 1..40: note = hypo
  source 1..40: mol_type = genomic DNA
aacaagaagaatggccgggcgcggtgactcacgcctgtaa

SEQ ID NO: 16182 - DNA, 33 bp, Homo sapiens; identical to SEQ ID NO: 1617
  misc_feature 1..33: note = chr17:26927180-26927213
  misc_feature 1..33: note = hypo
  source 1..33: mol_type = genomic DNA

SEQ ID NO: 16183 - DNA, 24 bp, Homo sapiens
  misc_feature 1..24: note = chr17:27056401-27056425
  misc_feature 1..24: note = hypo
  source 1..24: mol_type = genomic DNA
ctccctctgtcaccccggctggag

SEQ ID NO: 16184 - DNA, 24 bp, Homo sapiens
  misc_feature 1..24: note = chr17:27056845-27056869
  misc_feature 1..24: note = hypo
  source 1..24: mol_type = genomic DNA
gagccaccgcgacaggccagaagt

SEQ ID NO: 16185 - DNA, 30 bp, Homo sapiens
  misc_feature 1..30: note = chr17:27074858-27074888
  misc_feature 1..30: note = hypo
  source 1..30: mol_type = genomic DNA
agatctacccagacccggagctggaagtac

SEQ ID NO: 16186 - DNA, 20 bp, Homo sapiens
  misc_feature 1..20: note = chr17:27170162-27170182
  misc_feature 1..20: note = hypo
  source 1..20: mol_type = genomic DNA
tttttttttctgagtcgaag

SEQ ID NO: 16187 - DNA, 30 bp, Homo sapiens
  misc_feature 1..30: note = chr17:27411663-27411693
  misc_feature 1..30: note = hypo
  source 1..30: mol_type = genomic DNA
acaaccaggctccagcggccctctatcact

SEQ ID NO: 16188 - DNA, 86 bp, Homo sapiens; identical to SEQ ID NO: 5195
  misc_feature 1..86: note = chr17:27716046-27716132
  misc_feature 1..86: note = hypo
  source 1..86: mol_type = genomic DNA

SEQ ID NO: 16189 - DNA, 85 bp, Homo sapiens; identical to SEQ ID NO: 5196
  misc_feature 1..85: note = chr17:27716192-27716277
  misc_feature 1..85: note = hypo
  source 1..85: mol_type = genomic DNA

SEQ ID NO: 16190 - DNA, 55 bp, Homo sapiens
  misc_feature 1..55: note = chr17:30243877-30243932
  misc_feature 1..55: note = hypo
  source 1..55: mol_type = genomic DNA
tggggcacaggccttcgcccgccgcatgcaccctgggctgcgcagccccagccag

SEQ ID NO: 16191 - DNA, 37 bp, Homo sapiens; identical to SEQ ID NO: 5197
  misc_feature 1..37: note = chr17:30250325-30250362
  misc_feature 1..37: note = hypo
  source 1..37: mol_type = genomic DNA

SEQ ID NO: 16192 - DNA, 30 bp, Homo sapiens
  misc_feature 1..30: note = chr17:31214057-31214087
  misc_feature 1..30: note = hypo
  source 1..30: mol_type = genomic DNA
cccatttccccattccgtgtgaagagtgcc

SEQ ID NO: 16193 - DNA, 31 bp, Homo sapiens; identical to SEQ ID NO: 5198
  misc_feature 1..31: note = chr17:33877286-33877317
  misc_feature 1..31: note = hypo
  source 1..31: mol_type = genomic DNA

SEQ ID NO: 16194 - DNA, 30 bp, Homo sapiens
  misc_feature 1..30: note = chr17:33917238-33917268
  misc_feature 1..30: note = hypo
  source 1..30: mol_type = genomic DNA
aacttctaatgaagacgtcagtttttgcca

SEQ ID NO: 16195 - DNA, 23 bp, Homo sapiens
  misc_feature 1..23: note = chr17:37011132-37011155
  misc_feature 1..23: note = hypo
  source 1..23: mol_type = genomic DNA
aatataaatagtggccgggcctt

SEQ ID NO: 16196 - DNA, 24 bp, Homo sapiens
  misc_feature 1..24: note = chr17:37192168-37192192
  misc_feature 1..24: note = hypo
  source 1..24: mol_type = genomic DNA
gacgttagccgccacccccgggca

SEQ ID NO: 16197 - DNA, 30 bp, Homo sapiens
  misc_feature 1..30: note = chr17:37369159-37369189
  misc_feature 1..30: note = hypo
  source 1..30: mol_type = genomic DNA
cagagcatttacccccgcaccgcagcctgt

SEQ ID NO: 16198 - DNA, 146 bp, Homo sapiens; identical to SEQ ID NO: 1618
  misc_feature 1..146: note = chr17:39682499-39682645
  misc_feature 1..146: note = hypo
  source 1..146: mol_type = genomic DNA

SEQ ID NO: 16199 - DNA, 23 bp, Homo sapiens
  misc_feature 1..23: note = chr17:40477866-40477889
  misc_feature 1..23: note = hypo
  source 1..23: mol_type = genomic DNA
accgcgcccggccaatcaatttc

SEQ ID NO: 16200 - DNA, 103 bp, Homo sapiens
  misc_feature 1..103: note = chr17:40975574-40975677
  misc_feature 1..103: note = hypo
  source 1..103: mol_type = genomic DNA
aagctctcagaagtccacaatgtcagaatgctttatgtttccaaggagaaaacagggagccagatgaagtgactttcctaggttcacacgatgagtttgtggc

SEQ ID NO: 16201 - DNA, 108 bp, Homo sapiens
  misc_feature 1..108: note = chr17:41464822-41464930
  misc_feature 1..108: note = hypo
  source 1..108: mol_type = genomic DNA
catctacattcaagacgcggtgagagccccagcctcgctccttgcctcattcactttgtcttgtccacaccaatattgacgccattacacactcgggctgatttctta

SEQ ID NO: 16202 - DNA, 39 bp, Homo sapiens
  misc_feature 1..39: note = chr17:42330587-42330626
  misc_feature 1..39: note = hypo
  source 1..39: mol_type = genomic DNA
cgttggcatgggtgacggaacgcacggtggtggcactga

SEQ ID NO: 16203 - DNA, 102 bp, Homo sapiens; identical to SEQ ID NO: 1619
  misc_feature 1..102: note = chr17:42331669-42331771
  misc_feature 1..102: note = hypo
  source 1..102: mol_type = genomic DNA

SEQ ID NO: 16204 - DNA, 41 bp, Homo sapiens
  misc_feature 1..41: note = chr17:42395128-42395169
  misc_feature 1..41: note = hypo
  source 1..41: mol_type = genomic DNA
catgagggcagggaccgtgtcttgtccgttctctgtatccc

SEQ ID NO: 16205 - DNA, 24 bp, Homo sapiens
  misc_feature 1..24: note = chr17:46177212-46177236
  misc_feature 1..24: note = hypo
  source 1..24: mol_type = genomic DNA
taaaatatggccaggcgcagtggc

SEQ ID NO: 16206 - DNA, 86 bp, Homo sapiens
  misc_feature 1..86: note = chr17:47227368-47227454
  misc_feature 1..86: note = hypo
  source 1..86: mol_type = genomic DNA
ttgtatttcctcttccgttaattacctgtttatgttctttaccatttaaaaattttggaggtcggggggggtcagccccccacctg

SEQ ID NO: 16207 - DNA, 50 bp, Homo sapiens
  misc_feature 1..50: note = chr17:47657544-47657594
  misc_feature 1..50: note = hypo
  source 1..50: mol_type = genomic DNA
tctcagcagcgggcacgggtggggcggggccgggccgcagagcatgtgct

SEQ ID NO: 16208 - DNA, 32 bp, Homo sapiens
  misc_feature 1..32: note = chr17:47851118-47851150
  misc_feature 1..32: note = hypo
  source 1..32: mol_type = genomic DNA
tttttttttttctggcgactgagtttcattct

SEQ ID NO: 16209 - DNA, 31 bp, Homo sapiens
  misc_feature 1..31: note = chr17:47851390-47851421
  misc_feature 1..31: note = hypo
  source 1..31: mol_type = genomic DNA
caggcgtgagccactgcgcctagccttaagg

SEQ ID NO: 16210 - DNA, 30 bp, Homo sapiens
  misc_feature 1..30: note = chr17:48612278-48612308
  misc_feature 1..30: note = hypo
  source 1..30: mol_type = genomic DNA
gtgggggacagttcacgggtgaagtggagg

SEQ ID NO: 16211 - DNA, 60 bp, Homo sapiens
  misc_feature 1..60: note = chr17:48653004-48653064
  misc_feature 1..60: note = hypo
  source 1..60: mol_type = genomic DNA
gcggttcctgtccaacgccagcaccctggctagcttctctgagcccggcagctgctatga

SEQ ID NO: 16212 - DNA, 54 bp, Homo sapiens
  misc_feature 1..54: note = chr17:48653279-48653333
  misc_feature 1..54: note = hypo
  source 1..54: mol_type = genomic DNA
acctgggcaatgggacgctcagggccccccgggccagcccggagatccaggaca

SEQ ID NO: 16213 - DNA, 41 bp, Homo sapiens
  misc_feature 1..41: note = chr17:48687181-48687222
  misc_feature 1..41: note = hypo
  source 1..41: mol_type = genomic DNA
aggggccctgcccagcgcacctggtccggccagtgaccaat

SEQ ID NO: 16214 - DNA, 120 bp, Homo sapiens; identical to SEQ ID NO: 1620
  misc_feature 1..120: note = chr17:49229470-49229590
  misc_feature 1..120: note = hypo
  source 1..120: mol_type = genomic DNA

SEQ ID NO: 16215 - DNA, 39 bp, Homo sapiens
  misc_feature 1..39: note = chr17:53479136-53479175
  misc_feature 1..39: note = hypo
  source 1..39: mol_type = genomic DNA
gaaaatgttttctgccggccgggcacggtggctcatgcc

SEQ ID NO: 16216 - DNA, 30 bp, Homo sapiens
  misc_feature 1..30: note = chr17:54473510-54473540
  misc_feature 1..30: note = hypo
  source 1..30: mol_type = genomic DNA
tttaagaaggggccacgggccaggcacggt

SEQ ID NO: 16217 - DNA, 34 bp, Homo sapiens; identical to SEQ ID NO: 5202
  misc_feature 1..34: note = chr17:55037248-55037282
  misc_feature 1..34: note = hypo
  source 1..34: mol_type = genomic DNA

SEQ ID NO: 16218 - DNA, 44 bp, Homo sapiens
  misc_feature 1..44: note = chr17:55184791-55184835
  misc_feature 1..44: note = hypo
  source 1..44: mol_type = genomic DNA
ttcccaaggaactagcgccaagttgggctcgctgattaacatta

SEQ ID NO: 16219 - DNA, 102 bp, Homo sapiens
  misc_feature 1..102: note = chr17:55364127-55364229
  misc_feature 1..102: note = hypo
  source 1..102: mol_type = genomic DNA
ccacaccccctcccccgcttattattatttatttatttttctggtgaacaaacagaattaggaaaggtgtgttcttccaggagagagcgggcagtgtgggag

SEQ ID NO: 16220 - DNA, 37 bp, Homo sapiens; identical to SEQ ID NO: 1621
  misc_feature 1..37: note = chr17:57297023-57297060
  misc_feature 1..37: note = hypo
  source 1..37: mol_type = genomic DNA

SEQ ID NO: 16221 - DNA, 228 bp, Homo sapiens
  misc_feature 1..228: note = chr17:60856637-60856865
  misc_feature 1..228: note = hypo
  source 1..228: mol_type = genomic DNA
cagaaagaagaggcccgacccacaaggaatctgagaatgggcaagcagaaattagagaaaattaaaagcatgattcatggaacacatatgccacatcctaagccgtggctgctttcatgacactgtaaagggtgtcagtgggttgacattgacagattaatgggaggatgtctccccaagagccgtttgaaagtggagaagctgaaggtttcacggacacgataggat

SEQ ID NO: 16222 - DNA, 37 bp, Homo sapiens
  misc_feature 1..37: note = chr17:61677502-61677539
  misc_feature 1..37: note = hypo
  source 1..37: mol_type = genomic DNA
tacaggcgtgagccaccgcgcccggctgtcctgcttc

SEQ ID NO: 16223 - DNA, 89 bp, Homo sapiens
  misc_feature 1..89: note = chr17:61817866-61817955
  misc_feature 1..89: note = hypo
  source 1..89: mol_type = genomic DNA
catctcaaaaaaattaaaataaaaataaagagagaaaataataaacccagcaaacatttatggcaaacttcctacgtgtcaggcactgt

SEQ ID NO: 16224 - DNA, 30 bp, Homo sapiens
  misc_feature 1..30: note = chr17:66643303-66643333
  misc_feature 1..30: note = hypo
  source 1..30: mol_type = genomic DNA
ggggaggggtctgtccgttgcagacccctg

SEQ ID NO: 16225 - DNA, 16 bp, Homo sapiens
  misc_feature 1..16: note = chr17:67410381-67410397
  misc_feature 1..16: note = hypo
  source 1..16: mol_type = genomic DNA
gcgagactccctctcg

SEQ ID NO: 16226 - DNA, 44 bp, Homo sapiens
  misc_feature 1..44: note = chr17:68268160-68268204
  misc_feature 1..44: note = hypo
  source 1..44: mol_type = genomic DNA
ttaaaaaaatattgtcggccgggcgcagtggctcatgcctgtaa

SEQ ID NO: 16227 - DNA, 38 bp, Homo sapiens
  misc_feature 1..38: note = chr17:70657503-70657541
  misc_feature 1..38: note = hypo
  source 1..38: mol_type = genomic DNA
ctgagaattggcaagcgaagggacggcaacctgcagcc

SEQ ID NO: 16228 - DNA, 30 bp, Homo sapiens
  misc_feature 1..30: note = chr17:70712704-70712734
  misc_feature 1..30: note = hypo
  source 1..30: mol_type = genomic DNA
aaggaaaaaaaaaatcggaaactttaaccc

SEQ ID NO: 16229 - DNA, 30 bp, Homo sapiens
  misc_feature 1..30: note = chr17:71391476-71391506
  misc_feature 1..30: note = hypo
  source 1..30: mol_type = genomic DNA
tgatcttatagcccacggactcagggttcc

SEQ ID NO: 16230 - DNA, 30 bp, Homo sapiens
  misc_feature 1..30: note = chr17:71879558-71879588
  misc_feature 1..30: note = hypo
  source 1..30: mol_type = genomic DNA
ctccaaaatccgaaacgctccaaaatccga

SEQ ID NO: 16231 - DNA, 47 bp, Homo sapiens
  misc_feature 1..47: note = chr17:72356264-72356311
  misc_feature 1..47: note = hypo
  source 1..47: mol_type = genomic DNA
cccgcagaaccacatcgctggcgttgccctgccgcagcagctcctgc

SEQ ID NO: 16232 - DNA, 30 bp, Homo sapiens
  misc_feature 1..30: note = chr17:72370768-72370798
  misc_feature 1..30: note = hypo
  source 1..30: mol_type = genomic DNA
gaggaccccctcacccgcccacacctccat

SEQ ID NO: 16233 - DNA, 19 bp, Homo sapiens
  misc_feature 1..19: note = chr17:73031621-73031640
  misc_feature 1..19: note = hypo
  source 1..19: mol_type = genomic DNA
actccagtctctggccggg

SEQ ID NO: 16234 - DNA, 26 bp, Homo sapiens
  misc_feature 1..26: note = chr17:73083437-73083463
  misc_feature 1..26: note = hypo
  source 1..26: mol_type = genomic DNA
agcgagactcccggccaactgagtac

SEQ ID NO: 16235 - DNA, 41 bp, Homo sapiens
  misc_feature 1..41: note = chr17:73089693-73089734
  misc_feature 1..41: note = hypo
  source 1..41: mol_type = genomic DNA
cattggcagtgaggccgtggcagcgtcggcagcagaggatg

SEQ ID NO: 16236 - DNA, 17 bp, Homo sapiens
  misc_feature 1..17: note = chr17:73135904-73135921
  misc_feature 1..17: note = hypo
  source 1..17: mol_type = genomic DNA
tccgtctcaaaaataaa

SEQ ID NO: 16237 - DNA, 151 bp, Homo sapiens; identical to SEQ ID NO: 5206
  misc_feature 1..151: note = chr17:73586267-73586418
  misc_feature 1..151: note = hypo
  source 1..151: mol_type = genomic DNA

SEQ ID NO: 16238 - DNA, 30 bp, Homo sapiens
  misc_feature 1..30: note = chr17:73606380-73606410
  misc_feature 1..30: note = hypo
  source 1..30: mol_type = genomic DNA
gctgcctgagctggccgagctggccaaatc

SEQ ID NO: 16239 - DNA, 142 bp, Homo sapiens
  misc_feature 1..142: note = chr17:73615938-73616080
  misc_feature 1..142: note = hypo
  source 1..142: mol_type = genomic DNA
catgcccgatccctgcgcagctttgcggaggtgctgggtgtggagtgccggggcggctccaccctggagctgtcactgaagagcgagcagctggtgctgcacacagcccgggcaagggccatcgaggcgctggttgagctat

SEQ ID NO: 16240 - DNA, 54 bp, Homo sapiens; identical to SEQ ID NO: 5207
  misc_feature 1..54: note = chr17:73636283-73636337
  misc_feature 1..54: note = hypo
  source 1..54: mol_type = genomic DNA

SEQ ID NO: 16241 - DNA, 37 bp, Homo sapiens
  misc_feature 1..37: note = chr17:73638388-73638425
  misc_feature 1..37: note = hypo
  source 1..37: mol_type = genomic DNA
catcatcttggcctgcgtgacccgtgctctggccacc

SEQ ID NO: 16242 - DNA, 165 bp, Homo sapiens
  misc_feature 1..165: note = chr17:74128189-74128354
  misc_feature 1..165: note = hypo
  source 1..165: mol_type = genomic DNA
ctactttcctgggagcgcgggtcctggggctcagacctctctgtcctcagaacagggtggtgcggcccaagggcaggtgaggggctggtgggagtcagttcagggctgtactggaaggctatcaggggccagtagggagaccctcatccccgacagccccttccg

SEQ ID NO: 16243 - DNA, 30 bp, Homo sapiens
  misc_feature 1..30: note = chr17:74908784-74908814
  misc_feature 1..30: note = hypo
  source 1..30: mol_type = genomic DNA
gctgcaagatgcttccggggtgagggaggt

SEQ ID NO: 16244 - DNA, 44 bp, Homo sapiens
  misc_feature 1..44: note = chr17:75049830-75049874
  misc_feature 1..44: note = hypo
  source 1..44: mol_type = genomic DNA
tggtgtggacttggccgcgggactgagcgcggggcctgctcagg

SEQ ID NO: 16245 - DNA, 30 bp, Homo sapiens
  misc_feature 1..30: note = chr17:75523118-75523148
  misc_feature 1..30: note = hypo
  source 1..30: mol_type = genomic DNA
cccctcctccctctccgctgctgcaatgcc

SEQ ID NO: 16246 - DNA, 34 bp, Homo sapiens
  misc_feature 1..34: note = chr17:75733974-75734008
  misc_feature 1..34: note = hypo
  source 1..34: mol_type = genomic DNA
ataaaagacgcggcccgtacgcagagctgaagtg

SEQ ID NO: 16247 - DNA, 30 bp, Homo sapiens
  misc_feature 1..30: note = chr17:76021291-76021321
  misc_feature 1..30: note = hypo
  source 1..30: mol_type = genomic DNA
aaatcccctgtgctccgcatagtcatcccc

SEQ ID NO: 16248 - DNA, 292 bp, Homo sapiens; identical to SEQ ID NO: 5208
  misc_feature 1..292: note = chr17:76137898-76138190
  misc_feature 1..292: note = hypo
  source 1..292: mol_type = genomic DNA

SEQ ID NO: 16249 - DNA, 31 bp, Homo sapiens; identical to SEQ ID NO: 1623
  misc_feature 1..31: note = chr17:76211256-76211287
  misc_feature 1..31: note = hypo
  source 1..31: mol_type = genomic DNA

SEQ ID NO: 16250 - DNA, 91 bp, Homo sapiens; identical to SEQ ID NO: 1624
  misc_feature 1..91: note = chr17:76211527-76211618
  misc_feature 1..91: note = hypo
  source 1..91: mol_type = genomic DNA

SEQ ID NO: 16251 - DNA, 30 bp, Homo sapiens
  misc_feature 1..30: note = chr17:76419409-76419439
  misc_feature 1..30: note = hypo
  source 1..30: mol_type = genomic DNA
tctagactctgggggcgggggcttgggtgt

SEQ ID NO: 16252 - DNA, 82 bp, Homo sapiens
  misc_feature 1..82: note = chr17:77002830-77002912
  misc_feature 1..82: note = hypo
  source 1..82: mol_type = genomic DNA
agtgtgtgaaaataacgggatgggatcatcgccccatggacctggatcagggctgccttccacaccgcggtggcacctgcac

SEQ ID NO: 16253 - DNA, 30 bp, Homo sapiens
  misc_feature 1..30: note = chr17:77105030-77105060
  misc_feature 1..30: note = hypo
  source 1..30: mol_type = genomic DNA
ccctgcgttgaacagcgaggatgcagcaca

SEQ ID NO: 16254 - DNA, 30 bp, Homo sapiens
  misc_feature 1..30: note = chr17:77127147-77127177
  misc_feature 1..30: note = hypo
  source 1..30: mol_type = genomic DNA
atgtgctgcgtgtcccgtgtgtgctgtgtg

SEQ ID NO: 16255 - DNA, 63 bp, Homo sapiens
  misc_feature 1..63: note = chr17:77135878-77135941
  misc_feature 1..63: note = hypo
  source 1..63: mol_type = genomic DNA
gcatctctgcactgacgatgccggaggggcagaaccaccgtgtgtgcccggggaggacgtctt

SEQ ID NO: 16256 - DNA, 115 bp, Homo sapiens
  misc_feature 1..115: note = chr17:77807753-77807868
  misc_feature 1..115: note = hypo
  source 1..115: mol_type = genomic DNA
ccggctacaccgtcacgtactccttgaaagtaacggtgaggcagttcgcggtgacgtcggtgataattatattcccaaagaagggcttgaactcgctcagcgactctgcaggttc

SEQ ID NO: 16257 - DNA, 78 bp, Homo sapiens
  misc_feature 1..78: note = chr17:77926480-77926558
  misc_feature 1..78: note = hypo
  source 1..78: mol_type = genomic DNA
tgtggcccaggtccacgcggaacacgccgcaaatctgctccagggcgcacacccgctgcggctcgtcccagcgtgggg

SEQ ID NO: 16258 - DNA, 30 bp, Homo sapiens
  misc_feature 1..30: note = chr17:77948916-77948946
  misc_feature 1..30: note = hypo
  source 1..30: mol_type = genomic DNA
aacaatccgccaggccgcgtcactcctcac

SEQ ID NO: 16259 - DNA, 92 bp, Homo sapiens
  misc_feature 1..92: note = chr17:78122161-78122253
  misc_feature 1..92: note = hypo
  source 1..92: mol_type = genomic DNA
cacaggtgtccacgcgcagccactaaccgctttcttatctgacactttaagtgcttcttcgtacccagctcctctaacgccttttgaagcag

SEQ ID NO: 16260 - DNA, 30 bp, Homo sapiens
  misc_feature 1..30: note = chr17:78447089-78447119
  misc_feature 1..30: note = hypo
  source 1..30: mol_type = genomic DNA
cgtgcccacacctggcgtggcgctggactt

SEQ ID NO: 16261 - DNA, 144 bp, Homo sapiens
  misc_feature 1..144: note = chr17:78667900-78668044
  misc_feature 1..144: note = hypo
  source 1..144: mol_type = genomic DNA
tagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacaca

SEQ ID NO: 16262 - DNA, 35 bp, Homo sapiens
  misc_feature 1..35: note = chr17:79096981-79097016
  misc_feature 1..35: note = hypo
  source 1..35: mol_type = genomic DNA
tggggccctcaccagcggtccgacagggtcagctg

SEQ ID NO: 16263 - DNA, 39 bp, Homo sapiens
  misc_feature 1..39: note = chr17:79099769-79099808
  misc_feature 1..39: note = hypo
  source 1..39: mol_type = genomic DNA
gggctgacggggccacgtgtccttcgccacttcttccag

SEQ ID NO: 16264 - DNA, 48 bp, Homo sapiens
  misc_feature 1..48: note = chr17:79100184-79100232
  misc_feature 1..48: note = hypo
  source 1..48: mol_type = genomic DNA
tggcctagggcttcccggccgctggcccgcgcccgccctcacctgtgc

SEQ ID NO: 16265 - DNA, 30 bp, Homo sapiens
  misc_feature 1..30: note = chr17:79107633-79107663
  misc_feature 1..30: note = hypo
  source 1..30: mol_type = genomic DNA
tctagcatcacacatcgtcccctccagaag

SEQ ID NO: 16266 - DNA, 30 bp, Homo sapiens
  misc_feature 1..30: note = chr17:79211720-79211750
  misc_feature 1..30: note = hypo
  source 1..30: mol_type = genomic DNA
tcgctccccgagaaccgactgatgtcgtgt

SEQ ID NO: 16267 - DNA, 48 bp, Homo sapiens
  misc_feature 1..48: note = chr17:79609256-79609304
  misc_feature 1..48: note = hypo
  source 1..48: mol_type = genomic DNA
actcaactgtgactccggcatctgggtagggctcgcacctcccccatt

SEQ ID NO: 16268 - DNA, 309 bp, Homo sapiens; identical to SEQ ID NO: 1625
  misc_feature 1..309: note = chr17:79769384-79769693
  misc_feature 1..309: note = hypo
  source 1..309: mol_type = genomic DNA

SEQ ID NO: 16269 - DNA, 30 bp, Homo sapiens
  misc_feature 1..30: note = chr17:79774960-79774990
  misc_feature 1..30: note = hypo
  source 1..30: mol_type = genomic DNA
atcaagaataattcacgttagaaataaaaa

SEQ ID NO: 16270 - DNA, 30 bp, Homo sapiens
  misc_feature 1..30: note = chr17:79847763-79847793
  misc_feature 1..30: note = hypo
  source 1..30: mol_type = genomic DNA
agtgtggggatactccggccgcaggcacac

SEQ ID NO: 16271 - DNA, 30 bp, Homo sapiens
  misc_feature 1..30: note = chr17:79870492-79870522
  misc_feature 1..30: note = hypo
  source 1..30: mol_type = genomic DNA
gccaaaaagggaaagcggcatcaggcgggc

SEQ ID NO: 16272 - DNA, 173 bp, Homo sapiens
  misc_feature 1..173: note = chr17:79874854-79875027
  misc_feature 1..173: note = hypo
  source 1..173: mol_type = genomic DNA
tcccaactccaagagcgcagagtgtgtgtctgagtttgctctagcgacccagcacagccagctttacagtatggttatttgttcacatgcctgatccttgtcacctaaaagcttcctgagaacagaaatcacctgggttcagatctgctaggccgacgcgtgcccaacacccc

SEQ ID NO: 16273 - DNA, 112 bp, Homo sapiens
  misc_feature 1..112: note = chr17:79887664-79887776
  misc_feature 1..112: note = hypo
  source 1..112: mol_type = genomic DNA
caggagctcacttcccgtcacagctggatgcctcctcccgcaggcacctcccgggcatcctcccgccccaggctgcaccttctgtgggactggcccccgcaggcacctcccg

SEQ ID NO: 16274 - DNA, 17 bp, Homo sapiens
  misc_feature 1..17: note = chr17:79913149-79913166
  misc_feature 1..17: note = hypo
  source 1..17: mol_type = genomic DNA
cccggcctacaagacct

SEQ ID NO: 16275 - DNA, 30 bp, Homo sapiens
  misc_feature 1..30: note = chr17:80251974-80252004
  misc_feature 1..30: note = hypo
  source 1..30: mol_type = genomic DNA
gacaggataagcacacgagtagatctaagt

SEQ ID NO: 16276 - DNA, 30 bp, Homo sapiens
  misc_feature 1..30: note = chr17:80254287-80254317
  misc_feature 1..30: note = hypo
  source 1..30: mol_type = genomic DNA
ccattcattcgttgacggacacttaggcga

SEQ ID NO: 16277 - DNA, 180 bp, Homo sapiens
  misc_feature 1..180: note = chr17:80479344-80479524
  misc_feature 1..180: note = hypo
  source 1..180: mol_type = genomic DNA
gcctacaaattggaatttttaacgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttc

SEQ ID NO: 16278 - DNA, 30 bp, Homo sapiens
  misc_feature 1..30: note = chr17:80654983-80655013
  misc_feature 1..30: note = hypo
  source 1..30: mol_type = genomic DNA
cctctgggtgctggtcgtgagcccaagccc

SEQ ID NO: 16279 - DNA, 67 bp, Homo sapiens; identical to SEQ ID NO: 1626
  misc_feature 1..67: note = chr17:80797692-80797759
  misc_feature 1..67: note = hypo
  source 1..67: mol_type = genomic DNA

SEQ ID NO: 16280 - DNA, 723 bp, Homo sapiens; identical to SEQ ID NO: 1627
  misc_feature 1..723: note = chr17:80797997-80798720
  misc_feature 1..723: note = hypo
  source 1..723: mol_type = genomic DNA

SEQ ID NO: 16281 - DNA, 255 bp, Homo sapiens
  misc_feature 1..255: note = chr17:80832541-80832796
  misc_feature 1..255: note = hypo
  source 1..255: mol_type = genomic DNA
ctccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaa

SEQ ID NO: 16282 - DNA, 30 bp, Homo sapiens
  misc_feature 1..30: note = chr17:80972340-80972370
  misc_feature 1..30: note = hypo
  source 1..30: mol_type = genomic DNA
gctgaacggcagcctcgtgttgcagcctca

SEQ ID NO: 16283 - DNA, 210 bp, Homo sapiens
  misc_feature 1..210: note = chr17:81008664-81008874
  misc_feature 1..210: note = hypo
  source 1..210: mol_type = genomic DNA
gcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgag

SEQ ID NO: 16284 - DNA, 156 bp, Homo sapiens
  misc_feature 1..156: note = chr17:81015300-81015456
  misc_feature 1..156: note = hypo
  source 1..156: mol_type = genomic DNA
ctcacctccaggggacggccccgcaagccggagctgccctcctgcacactcagcactcaaggtggatttggaggtgacctaagcccacagctctccaagtcttggggaaatctacagtggatggcaggtgcctgcggacgccgagtgggtgcggcc

SEQ ID NO: 16285 - DNA, 58 bp, Homo sapiens
  misc_feature 1..58: note = chr17:81048783-81048841
  misc_feature 1..58: note = hypo
  source 1..58: mol_type = genomic DNA
gggtgggccacaccccggggcccccataggagagcgcaccgggcggcttccagcttgg

SEQ ID NO: 16286 - DNA, 87 bp, Homo sapiens
  misc_feature 1..87: note = chr17:81050193-81050280
  misc_feature 1..87: note = hypo
  source 1..87: mol_type = genomic DNA
cctccttttgggtgccgctgccgtcgcgacccagggaagtgggcagcagagctgtggggagtgtctgcccttcgaggaagctgggaa

SEQ ID NO: 16287 - DNA, 30 bp, Homo sapiens
  misc_feature 1..30: note = chr17:81050936-81050966
  misc_feature 1..30: note = hypo
  source 1..30: mol_type = genomic DNA
cgaggtgctcctagccgtctgcaccagcga

SEQ ID NO: 16288 - DNA, 30 bp, Homo sapiens
  misc_feature 1..30: note = chr17:81062138-81062168
  misc_feature 1..30: note = hypo
  source 1..30: mol_type = genomic DNA
ctgaaggttgagtcccgcagcctagagact

SEQ ID NO: 16289 - DNA, 30 bp, Homo sapiens
  misc_feature 1..30: note = chr17:81076347-81076377
  misc_feature 1..30: note = hypo
  source 1..30: mol_type = genomic DNA
ggcagatcctggagccgggaagggatttgg

SEQ ID NO: 16290 - DNA, 19 bp, Homo sapiens
  misc_feature 1..19: note = chr17:81081890-81081909
  misc_feature 1..19: note = hypo
  source 1..19: mol_type = genomic DNA
gggcgacgctcagggcggc

SEQ ID NO: 16291 - DNA, 30 bp, Homo sapiens
  misc_feature 1..30: note = chr18:597381-597411
  misc_feature 1..30: note = hypo
  source 1..30: mol_type = genomic DNA
aggaggaggtagaggcggggagacacacca

SEQ ID NO: 16292 - DNA, 41 bp, Homo sapiens
  misc_feature 1..41: note = chr18:2755837-2755878
  misc_feature 1..41: note = hypo
  source 1..41: mol_type = genomic DNA
tacaggtgtgaatcaccgccctcggccgtgtattttctttt

SEQ ID NO: 16293 - DNA, 44 bp, Homo sapiens
  misc_feature 1..44: note = chr18:5133188-5133232
  misc_feature 1..44: note = hypo
  source 1..44: mol_type = genomic DNA
caccaccaccgaccacgatggctgcgccccgggccgcgaggaag

SEQ ID NO: 16294 - DNA, 40 bp, Homo sapiens
  misc_feature 1..40: note = chr18:8845133-8845173
  misc_feature 1..40: note = hypo
  source 1..40: mol_type = genomic DNA
tccgcaggctaatgccgctctgccacgtgcagtgagagga

SEQ ID NO: 16295 - DNA, 16 bp, Homo sapiens
  misc_feature 1..16: note = chr18:9364512-9364528
  misc_feature 1..16: note = hypo
  source 1..16: mol_type = genomic DNA
aggtgtggtggctcac

SEQ ID NO: 16296 - DNA, 290 bp, Homo sapiens; identical to SEQ ID NO: 5214
  misc_feature 1..290: note = chr18:10589096-10589386
  misc_feature 1..290: note = hypo
  source 1..290: mol_type = genomic DNA

SEQ ID NO: 16297 - DNA, 17 bp, Homo sapiens
  misc_feature 1..17: note = chr18:11014809-11014826
  misc_feature 1..17: note = hypo
  source 1..17: mol_type = genomic DNA
tccggggccccctcatt

SEQ ID NO: 16298 - DNA, 30 bp, Homo sapiens
  misc_feature 1..30: note = chr18:11979044-11979074
  misc_feature 1..30: note = hypo
  source 1..30: mol_type = genomic DNA
aatagcaaacacatacgttccaagcacaag

SEQ ID NO: 16299 - DNA, 22 bp, Homo sapiens
  misc_feature 1..22: note = chr18:12376107-12376129
  misc_feature 1..22: note = hypo
  source 1..22: mol_type = genomic DNA
tgagccccggcactagcctatc

SEQ ID NO: 16300 - DNA, 30 bp, Homo sapiens
  misc_feature 1..30: note = chr18:12701811-12701841
  misc_feature 1..30: note = hypo
  source 1..30: mol_type = genomic DNA
acccacatgtttcagcggtaaagaaaccct

SEQ ID NO: 16301 - DNA, 26 bp, Homo sapiens
  misc_feature 1..26: note = chr18:12949149-12949175
  misc_feature 1..26: note = hypo
  source 1..26: mol_type = genomic DNA
gccaccgcgcccggcctacaagcaga

SEQ ID NO: 16302 - DNA, 39 bp, Homo sapiens
  misc_feature 1..39: note = chr18:13461328-13461367
  misc_feature 1..39: note = hypo
  source 1..39: mol_type = genomic DNA
aaaggtcaagaagagcgaggaagacgtggggatggggac

SEQ ID NO: 16303 - DNA, 153 bp, Homo sapiens
  misc_feature 1..153: note = chr18:13826383-13826536
  misc_feature 1..153: note = hypo
  source 1..153: mol_type = genomic DNA
acatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatc

SEQ ID NO: 16304 - DNA, 59 bp, Homo sapiens
  misc_feature 1..59: note = chr18:13940522-13940581
  misc_feature 1..59: note = hypo
  source 1..59: mol_type = genomic DNA
cctgctgtgggtacccggccgctgagtgtacatgatttcatcgtcgtttgccttaattc

SEQ ID NO: 16305 - DNA, 30 bp, Homo sapiens
  misc_feature 1..30: note = chr18:20911344-20911374
  misc_feature 1..30: note = hypo
  source 1..30: mol_type = genomic DNA
gtgaaacctgccccccgccaccacctgtag

SEQ ID NO: 16306 - DNA, 181 bp, Homo sapiens
  misc_feature 1..181: note = chr18:53968903-53969084
  misc_feature 1..181: note = hypo
  source 1..181: mol_type = genomic DNA
cctacttcattagttcgttgtggggatgaaataagacaatatatgtaaatcactctaaacagcgattggtatgtagcaactactcagcatgcattagctattatgaggtagcgtgcttagcacagtacctgggacaaaataagagctcaatgaacaatagtatgatcgtgctgatgctgac

SEQ ID NO: 16307 - DNA, 72 bp, Homo sapiens; identical to SEQ ID NO: 5215
  misc_feature 1..72: note = chr18:55850845-55850917
  misc_feature 1..72: note = hypo
  source 1..72: mol_type = genomic DNA

SEQ ID NO: 16308 - DNA, 20 bp, Homo sapiens
  misc_feature 1..20: note = chr18:56483918-56483938
  misc_feature 1..20: note = hypo
  source 1..20: mol_type = genomic DNA
aagtttgaaattccccggcc

SEQ ID NO: 16309 - DNA, 39 bp, Homo sapiens
  misc_feature 1..39: note = chr18:68051369-68051408
  misc_feature 1..39: note = hypo
  source 1..39: mol_type = genomic DNA
aagaaaaaaaagaaaagaacaaagcgcctacctcctgca

SEQ ID NO: 16310 - DNA, 30 bp, Homo sapiens
  misc_feature 1..30: note = chr18:72896219-72896249
  misc_feature 1..30: note = hypo
  source 1..30: mol_type = genomic DNA
aggggaggttgaggacgtccctgcactccc

SEQ ID NO: 16311 - DNA, 143 bp, Homo sapiens
  misc_feature 1..143: note = chr18:75229713-75229856
  misc_feature 1..143: note = hypo
  source 1..143: mol_type = genomic DNA
caaatgatcatacaccgtctgcggcggcttttctgtgtccacaaagagaccctcccacaggcacatgcatgatgctgcttcccagtgagaaacttcggagagaagacaggaggagacgtggaatgtttcggggctagaaatgt

SEQ ID NO: 16312 - DNA, 99 bp, Homo sapiens
  misc_feature 1..99: note = chr18:75230687-75230786
  misc_feature 1..99: note = hypo
  source 1..99: mol_type = genomic DNA
aactgaagtctagctcgtgcttctgaaatgacgcataaataattcaagcttgagagggaagaactggccacactttggaggcgccgagctggggaacct

SEQ ID NO: 16313 - DNA, 378 bp, Homo sapiens
  misc_feature 1..378: note = chr18:75998610-75998988
  misc_feature 1..378: note = hypo
  source 1..378: mol_type = genomic DNA
tgtgtgtgctgttcacgtggtgtgtgtgtgtgtcgtgtgtcgtgtggcgtgtgccgtgcgtgtgcgcaccgtgggcgggaggcgagaggaagcgcagtgggagccgcgggcaggcggtcgcagaggggcctggggaggcgaagcagcccgggtgggggcgttcgctggaaacggggcccctctgaagggcgtgggcagccggtgcctgcagagcgtggagagctgcggccgcctcacctgacacaattgggcagcgatttctcaggtccaaagagcggaccccgtgggcactttcctgacggaggactcggctcctgggagctccggcaacatcagcgacagtggagcccggtctcaaaagaccgacccggcggcctg

SEQ ID NO: 16314 - DNA, 30 bp, Homo sapiens
  misc_feature 1..30: note = chr18:76073322-76073352
  misc_feature 1..30: note = hypo
  source 1..30: mol_type = genomic DNA
ccgcaaaaccatggacgtcacaagaccacg

SEQ ID NO: 16315 - DNA, 30 bp, Homo sapiens
  misc_feature 1..30: note = chr18:76123862-76123892
  misc_feature 1..30: note = hypo
  source 1..30: mol_type = genomic DNA
ggacggcctgttgttcgcgtgctgagtgca

SEQ ID NO: 16316 - DNA, 63 bp, Homo sapiens
  misc_feature 1..63: note = chr18:76239475-76239538
  misc_feature 1..63: note = hypo
  source 1..63: mol_type = genomic DNA
gggttaaccagagtccggagtcagagaaataatttggtgtttcagggtcgcctgctgcagggc

SEQ ID NO: 16317 - DNA, 30 bp, Homo sapiens
  misc_feature 1..30: note = chr18:76412736-76412766
  misc_feature 1..30: note = hypo
  source 1..30: mol_type = genomic DNA
gactttcctgggttgcgcactgaaagtccc

SEQ ID NO: 16318 - DNA, 30 bp, Homo sapiens
  misc_feature 1..30: note = chr18:76477600-76477630
  misc_feature 1..30: note = hypo
  source 1..30: mol_type = genomic DNA
cgggtctgcacctcccgagcctatgactga

SEQ ID NO: 16319 - DNA, 30 bp, Homo sapiens
  misc_feature 1..30: note = chr18:76501479-76501509
  misc_feature 1..30: note = hypo
  source 1..30: mol_type = genomic DNA
ctcagtctatggatccgctggacgacccat

SEQ ID NO: 16320 - DNA, 30 bp, Homo sapiens
  misc_feature 1..30: note = chr18:76541560-76541590
  misc_feature 1..30: note = hypo
  source 1..30: mol_type = genomic DNA
tgggtgaggcggagccgctcctgaaggatc

SEQ ID NO: 16321 - DNA, 30 bp, Homo sapiens
  misc_feature 1..30: note = chr18:76686197-76686227
  misc_feature 1..30: note = hypo
  source 1..30: mol_type = genomic DNA
acagacatggaggagcggcttaccaggtct

SEQ ID NO: 16322 - DNA, 42 bp, Homo sapiens
  misc_feature 1..42: note = chr18:77167812-77167854
  misc_feature 1..42: note = hypo
  source 1..42: mol_type = genomic DNA
gagggcatttctttacgatggggaaggcgggactggggcctg

SEQ ID NO: 16323 - DNA, 109 bp, Homo sapiens
  misc_feature 1..109: note = chr18:77181317-77181426
  misc_feature 1..109: note = hypo
  source 1..109: mol_type = genomic DNA
acagacctggaatcacgaggaaatgcccgtcctcctcccacgggcagacaggtcgagtgtgtttccagagaccgggccgtccgtggggcagtagcgcctggatgacgtc

SEQ ID NO: 16324 - DNA, 30 bp, Homo sapiens
  misc_feature 1..30: note = chr18:77194948-77194978
  misc_feature 1..30: note = hypo
  source 1..30: mol_type = genomic DNA
gagcgcacagtggcccgtttgacatttaaa

SEQ ID NO: 16325 - DNA, 30 bp, Homo sapiens
  misc_feature 1..30: note = chr18:77201979-77202009
  misc_feature 1..30: note = hypo
  source 1..30: mol_type = genomic DNA
cccctgcaccctccacgtcagtgccctggc

SEQ ID NO: 16326 - DNA, 64 bp, Homo sapiens
  misc_feature 1..64: note = chr18:77246511-77246575
  misc_feature 1..64: note = hypo
  source 1..64: mol_type = genomic DNA
gtcacctcggactcccgcagccggccggagaggcccccgccgtccaggacgtgcccaggccagt

SEQ ID NO: 16327 - DNA, 39 bp, Homo sapiens
  misc_feature 1..39: note = chr18:77272049-77272088
  misc_feature 1..39: note = hypo
  source 1..39: mol_type = genomic DNA
atggctccttgtctccggcccaagcgacccctggcatgg

SEQ ID NO: 16328 - DNA, 200 bp, Homo sapiens
  misc_feature 1..200: note = chr18:77285870-77286070
  misc_feature 1..200: note = hypo
  source 1..200: mol_type = genomic DNA
gcaaggctgaaccagcgcagtgggaaaggagttaactggtctcgaattctggggcatccctgtctcgtgccacagatgccaagcacagcagggcacggagctcctgggggccgctgcactcagcagcacagtgggcgggaggccgctgagcaaccagcagcctagggcatttgggtggggacgtgcgacccccacacaga

SEQ ID NO: 16329 - DNA, 30 bp, Homo sapiens
  misc_feature 1..30: note = chr18:77288262-77288292
  misc_feature 1..30: note = hypo
  source 1..30: mol_type = genomic DNA
tttttaatctggcttcgaacatagcacaag

SEQ ID NO: 16330 - DNA, 32 bp, Homo sapiens
  misc_feature 1..32: note = chr18:77313917-77313949
  misc_feature 1..32: note = hypo
  source 1..32: mol_type = genomic DNA
tggctgattgtggcacgcgtgccttccgagcc

SEQ ID NO: 16331 - DNA, 30 bp, Homo sapiens; identical to SEQ ID NO: 1628
  misc_feature 1..30: note = chr18:77329727-77329757
  misc_feature 1..30: note = hypo
  source 1..30: mol_type = genomic DNA

SEQ ID NO: 16332 - DNA, 30 bp, Homo sapiens
  misc_feature 1..30: note = chr18:77329972-77330002
  misc_feature 1..30: note = hypo
  source 1..30: mol_type = genomic DNA
cagtacagccaaacacgccctcaccttcac

SEQ ID NO: 16333 - DNA, 131 bp, Homo sapiens
  misc_feature 1..131: note = chr18:77364414-77364545
  misc_feature 1..131: note = hypo
  source 1..131: mol_type = genomic DNA
tccagtgtccccaggcgttccgggcttgtggctgcgtcattctgccctctgccccctgggcacgcagctgactcccctgtatgggcccatctctccgaattcacatgaccgtccttcggtaaagacaccag

SEQ ID NO: 16334 - DNA, 30 bp, Homo sapiens
  misc_feature 1..30: note = chr18:77410108-77410138
  misc_feature 1..30: note = hypo
  source 1..30: mol_type = genomic DNA
ggcacgttctatcctcggccctgtcagccc

SEQ ID NO: 16335 - DNA, 30 bp, Homo sapiens
  misc_feature 1..30: note = chr18:77542905-77542935
  misc_feature 1..30: note = hypo
  source 1..30: mol_type = genomic DNA
tcccctttcaaaacacgtacagcgaatgac

SEQ ID NO: 16336 - DNA, 106 bp, Homo sapiens
  misc_feature 1..106: note = chr18:77543230-77543336
  misc_feature 1..106: note = hypo
  source 1..106: mol_type = genomic DNA
catccccgtgagctccgcctggccctgctgctcccgcccggaaagctcagacccataacccagcccacttggcagcagcgtgccgcctgatcggcaaggtttactc

SEQ ID NO: 16337 - DNA, 171 bp, Homo sapiens
  misc_feature 1..171: note = chr18:77550196-77550367
  misc_feature 1..171: note = hypo
  source 1..171: mol_type = genomic DNA
gacacaagagcgtggcggggccttccgaggatgcggtgcaagggcgctgttagcacccacgcgaggcggcagcgcatggaggaagcctcccatcgtaagcgcgtttctgcctgaaatgcacgtgtccttataggcagcggtcttgccactcatggacggagaggcagcata

SEQ ID NO: 16338 - DNA, 30 bp, Homo sapiens
  misc_feature 1..30: note = chr18:77636150-77636180
  misc_feature 1..30: note = hypo
  source 1..30: mol_type = genomic DNA
ccaggacccatctcccgcctggtgccgctg

SEQ ID NO: 16339 - DNA, 183 bp, Homo sapiens
  misc_feature 1..183: note = chr18:77636591-77636774
  misc_feature 1..183: note = hypo
  source 1..183: mol_type = genomic DNA
cagtggtgccctctgcgagcagcttgctcacctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccggg

SEQ ID NO: 16340 - DNA, 30 bp, Homo sapiens
  misc_feature 1..30: note = chr18:77644664-77644694
  misc_feature 1..30: note = hypo
  source 1..30: mol_type = genomic DNA
ggtttccaaagagaccggacacgcccaagg

SEQ ID NO: 16341 - DNA, 30 bp, Homo sapiens
  misc_feature 1..30: note = chr19:292163-292193
  misc_feature 1..30: note = hypo
  source 1..30: mol_type = genomic DNA
caccgttcctatcagcgcacttgctgtccc

SEQ ID NO: 16342 - DNA, 30 bp, Homo sapiens
  misc_feature 1..30: note = chr19:349135-349165
  misc_feature 1..30: note = hypo
  source 1..30: mol_type = genomic DNA
aaaacttagtctattcgtgctgctgtaata

SEQ ID NO: 16343 - DNA, 405 bp, Homo sapiens; identical to SEQ ID NO: 5217
  misc_feature 1..405: note = chr19:403367-403772
  misc_feature 1..405: note = hypo
  source 1..405: mol_type = genomic DNA

SEQ ID NO: 16344 - DNA, 145 bp, Homo sapiens
  misc_feature 1..145: note = chr19:407470-407615
  misc_feature 1..145: note = hypo
  source 1..145: mol_type = genomic DNA
cccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcacc

SEQ ID NO: 16345 - DNA, 30 bp, Homo sapiens
  misc_feature 1..30: note = chr19:468757-468787
  misc_feature 1..30: note = hypo
  source 1..30: mol_type = genomic DNA
tgtggcagtgagccacgggtgagggaggaa

SEQ ID NO: 16346 - DNA, 92 bp, Homo sapiens
  misc_feature 1..92: note = chr19:470863-470955
  misc_feature 1..92: note = hypo
  source 1..92: mol_type = genomic DNA
ggagctgcttcactgcgcccgttctagacaggagcaggcaccatggggcaaggccaccagcctgtggcacagcgagccggtgcaccccatgc

SEQ ID NO: 16347 - DNA, 229 bp, Homo sapiens
  misc_feature 1..229: note = chr19:485165-485394
  misc_feature 1..229: note = hypo
  source 1..229: mol_type = genomic DNA
atggagggtcattgccgtgctctaccacgtaacacacgtacacacacacacacaggtgcacgtttacaccacgtgggtgcgcacgatgaggcacacacaggcaggcgcgcacacacacgcgtgctcacataggaacacgaagaggcaggagccgggcgtgcccgagccccgtggcgccctgggcatcccaaacaccgcctgcccagaacaggtgcgcagtgagtgcctg

SEQ ID NO: 16348 - DNA, 181 bp, Homo sapiens
  misc_feature 1..181: note = chr19:491311-491492
  misc_feature 1..181: note = hypo
  source 1..181: mol_type = genomic DNA
cctttatggtgtttgcgacgtcgtgtaaacaccagctctctagtctcaaacccggcgagggcggttcatagacaatttcagtctctcgacgcgacgccgtgtggcttgtgcccttctagccacctagaccctcgggagaggcctgtgcggctcctggctgggcccccgtcttcaaagcagc

SEQ ID NO: 16349 - DNA, 23 bp, Homo sapiens
  misc_feature 1..23: note = chr19:530233-530256
  misc_feature 1..23: note = hypo
  source 1..23: mol_type = genomic DNA
accgtgcccggcctgtatgttga

SEQ ID NO: 16350 - DNA, 30 bp, Homo sapiens
  misc_feature 1..30: note = chr19:548574-548604
  misc_feature 1..30: note = hypo
  source 1..30: mol_type = genomic DNA
caccctggacagccccggtctcaccttcca

SEQ ID NO: 16351 - DNA, 319 bp, Homo sapiens
  misc_feature 1..319: note = chr19:549361-549680
  misc_feature 1..319: note = hypo
  source 1..319: mol_type = genomic DNA
aggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccaga

SEQ ID NO: 16352 - DNA, 111 bp, Homo sapiens
  misc_feature 1..111: note = chr19:550388-550499
  misc_feature 1..111: note = hypo
  source 1..111: mol_type = genomic DNA
tctccctgtaaactgcgattcaggggcctttggtacctgcacagagctgggcaaccaccaccgtgacatgtcaccccagcaccccgaaaacaggcccgtccccagtcaccc

SEQ ID NO: 16353 - DNA, 199 bp, Homo sapiens
  misc_feature 1..199: note = chr19:593150-593349
  misc_feature 1..199: note = hypo
  source 1..199: mol_type = genomic DNA
agtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcgg

SEQ ID NO: 16354 - DNA, 30 bp, Homo sapiens
  misc_feature 1..30: note = chr19:599200-599230
  misc_feature 1..30: note = hypo
  source 1..30: mol_type = genomic DNA
tttggaccgtttcctcgggatcatttcccc

SEQ ID NO: 16355 - DNA, 197 bp, Homo sapiens
  misc_feature 1..197: note = chr19:752136-752333
  misc_feature 1..197: note = hypo
  source 1..197: mol_type = genomic DNA
cccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttg

SEQ ID NO: 16356 - DNA, 632 bp, Homo sapiens; identical to SEQ ID NO: 1629
  misc_feature 1..632: note = chr19:883582-884214
  misc_feature 1..632: note = hypo
  source 1..632: mol_type = genomic DNA

SEQ ID NO: 16357 - DNA, 90 bp, Homo sapiens
  misc_feature 1..90: note = chr19:891529-891619
  misc_feature 1..90: note = hypo
  source 1..90: mol_type = genomic DNA
cccgaaggaagagcccgcagacaggcaagcggtggggcggctccctgtagccgaggcggggctgagtgacagggaacacctgtggccgag

SEQ ID NO: 16358 - DNA, 163 bp, Homo sapiens
  misc_feature 1..163: note = chr19:900851-901014
  misc_feature 1..163: note = hypo
  source 1..163: mol_type = genomic DNA
ccagggcccctcctccgcgccttgctcctgccctcatcctccaggtagcgaagaacccgctcctgctcctccccggagcggttcatgaaatcgttccagacctggaagagaggcagggaggcaggcttgccatgaaacactggggctgcgctgacatccccgg

SEQ ID NO: 16359 - DNA, 157 bp, Homo sapiens
  misc_feature 1..157: note = chr19:955719-955876
  misc_feature 1..157: note = hypo
  source 1..157: mol_type = genomic DNA
aggcagggtagaccccgtaataccgggtcagaatctcagaggagaggaccttccgctcgccctggaagggcccaaggtgtgctggcctctacgtgcggttcttagccggggggctgcgtaacgaaggacctcaaaccgcgggcgtaaaacaaacgaa

SEQ ID NO: 16360 - DNA, 237 bp, Homo sapiens
  misc_feature 1..237: note = chr19:1003205-1003442
  misc_feature 1..237: note = hypo
  source 1..237: mol_type = genomic DNA
gcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcg

SEQ ID NO: 16361 - DNA, 55 bp, Homo sapiens
  misc_feature 1..55: note = chr19:1003679-1003734
  misc_feature 1..55: note = hypo
  source 1..55: mol_type = genomic DNA
gcagccggccgggcccgagtccccggggcgcttcttggcacggtgagtggggacc

SEQ ID NO: 16362 - DNA, 460 bp, Homo sapiens; identical to SEQ ID NO: 1630
  misc_feature 1..460: note = chr19:1004981-1005441
  misc_feature 1..460: note = hypo
  source 1..460: mol_type = genomic DNA

SEQ ID NO: 16363 - DNA, 32 bp, Homo sapiens
  misc_feature 1..32: note = chr19:1030092-1030124
  misc_feature 1..32: note = hypo
  source 1..32: mol_type = genomic DNA
cctcagtgctgtctccgcggtcactagtggct

SEQ ID NO: 16364 - DNA, 69 bp, Homo sapiens
  misc_feature 1..69: note = chr19:1112645-1112714
  misc_feature 1..69: note = hypo
  source 1..69: mol_type = genomic DNA
gcagcgagaggcctgcggggcgcggacaccacccgccacacggccactcgcgcccgcacctggcacaca

SEQ ID NO: 16365 - DNA, 17 bp, Homo sapiens
  misc_feature 1..17: note = chr19:1128414-1128431
  misc_feature 1..17: note = hypo
  source 1..17: mol_type = genomic DNA
ggattcttacactgtcg

SEQ ID NO: 16366 - DNA, 30 bp, Homo sapiens
  misc_feature 1..30: note = chr19:1156568-1156598
  misc_feature 1..30: note = hypo
  source 1..30: mol_type = genomic DNA
ctcacaacagccacccgaggaagcagccca

SEQ ID NO: 16367 - DNA, 298 bp, Homo sapiens; identical to SEQ ID NO: 5220
  misc_feature 1..298: note = chr19:1171099-1171397
  misc_feature 1..298: note = hypo
  source 1..298: mol_type = genomic DNA

SEQ ID NO: 16368 - DNA, 53 bp, Homo sapiens
  misc_feature 1..53: note = chr19:1227555-1227608
  misc_feature 1..53: note = hypo
  source 1..53: mol_type = genomic DNA
caggctgacctcttccgtcttccttccaccctgcagcccgtgtccaggagccc

SEQ ID NO: 16369 - DNA, 30 bp, Homo sapiens
  misc_feature 1..30: note = chr19:1236238-1236268
  misc_feature 1..30: note = hypo
  source 1..30: mol_type = genomic DNA
gagaggtagcagagccggaggcagcctcca

SEQ ID NO: 16370 - DNA, 35 bp, Homo sapiens
  misc_feature 1..35: note = chr19:1236474-1236509
  misc_feature 1..35: note = hypo
  source 1..35: mol_type = genomic DNA
ccaaggcggtgcagccggctcgagaaggactccag

SEQ ID NO: 16371 - DNA, 53 bp, Homo sapiens
  misc_feature 1..53: note = chr19:1274693-1274746
  misc_feature 1..53: note = hypo
  source 1..53: mol_type = genomic DNA
ctggagcacgggctgcggtgcgccggcagcttacggggcggccagtccttgcc

SEQ ID NO: 16372 - DNA, 30 bp, Homo sapiens
  misc_feature 1..30: note = chr19:1308187-1308217
  misc_feature 1..30: note = hypo
  source 1..30: mol_type = genomic DNA
tggaacgtctcagaccggacccctcccttt

SEQ ID NO: 16373 - DNA, 30 bp, Homo sapiens
  misc_feature 1..30: note = chr19:1325942-1325972
  misc_feature 1..30: note = hypo
  source 1..30: mol_type = genomic DNA
acagtggctcaaacccgctgggcacagtgg

SEQ ID NO: 16374 - DNA, 43 bp, Homo sapiens
  misc_feature 1..43: note = chr19:1482018-1482061
  misc_feature 1..43: note = hypo
  source 1..43: mol_type = genomic DNA
ggaggtgcagtccctcggggagccgccgcggcaggtgtagcag

SEQ ID NO: 16375 - DNA, 106 bp, Homo sapiens
  misc_feature 1..106: note = chr19:1482370-1482476
  misc_feature 1..106: note = hypo
  source 1..106: mol_type = genomic DNA
gtcccgctgcacacacgcgctgctggtcacctgggggcctgtaggccgcgctgtcatgtcctcggccgtcccatagagcagcagcgtgtagcggtacaacgtccct

SEQ ID NO: 16376 - DNA, 68 bp, Homo sapiens
  misc_feature 1..68: note = chr19:1496626-1496694
  misc_feature 1..68: note = hypo
  source 1..68: mol_type = genomic DNA
cccggtggctgtggccgggccctccactcccctggaagctgaccgtacgtaaccgctgtggggagata

SEQ ID NO: 16377 - DNA, 186 bp, Homo sapiens
  misc_feature 1..186: note = chr19:1525774-1525960
  misc_feature 1..186: note = hypo
  source 1..186: mol_type = genomic DNA
ccatctgcacctcgccgctgccccccgtaccatcctgtgtgccctctgctgtccattcgccagcgcttcttacgcctacgtagggccaattgtgtccatcctttactcacctgggcacacccaggctctcttgatccacctgggcccagcttacgctgtgctcatcaggcccgtctcagactcacc

SEQ ID NO: 16378 - DNA, 30 bp, Homo sapiens
  misc_feature 1..30: note = chr19:1527258-1527288
  misc_feature 1..30: note = hypo
  source 1..30: mol_type = genomic DNA
tacagcgtgtgtgggcgcagggcaggtgtg

SEQ ID NO: 16379 - DNA, 30 bp, Homo sapiens
  misc_feature 1..30: note = chr19:1533726-1533756
  misc_feature 1..30: note = hypo
  source 1..30: mol_type = genomic DNA
ctacatgcccaactgcgggaggctggaagc

SEQ ID NO: 16380 - DNA, 48 bp, Homo sapiens
  misc_feature 1..48: note = chr19:1799852-1799900
  misc_feature 1..48: note = hypo
  source 1..48: mol_type = genomic DNA
gggcatggggccagacgtggctctggttctcaggcaccctgagcccct

SEQ ID NO: 16381 - DNA, 261 bp, Homo sapiens; identical to SEQ ID NO: 1631
  misc_feature 1..261: note = chr19:1808152-1808413
  misc_feature 1..261: note = hypo
  source 1..261: mol_type = genomic DNA

SEQ ID NO: 16382 - DNA, 377 bp, Homo sapiens
  misc_feature 1..377: note = chr19:1809512-1809889
  misc_feature 1..377: note = hypo
  source 1..377: mol_type = genomic DNA
aaaaccaaaaaaagaaaactatcgagcaaatacaagcagaggcaggactcaggaggagcaaaaaatagattccccgagggtaccacggcagctcctctggagcagggaggcgcgggaggggccgcccaccttgtatttcttcctttgccagcacaggatcaccttctccttgaactgcccgttgtaggcacggttgttggcctggaccttccaggtgaatgctgcagcgagagagccgggcgtcgctggagctcgaggcccaggacaaacacccctaatgaccgcccggaggagggctcatggggcccgtgggacccaggcactggggaggcccgagatgtcagagcccgtaaacagacagtcgggcagcaggcacc

SEQ ID NO: 16383 - DNA, 37 bp, Homo sapiens
  misc_feature 1..37: note = chr19:1912092-1912129
  misc_feature 1..37: note = hypo
  source 1..37: mol_type = genomic DNA
ggatggagcccgccccgggcctcgtggagcagcccaa

SEQ ID NO: 16384 - DNA, 79 bp, Homo sapiens
  misc_feature 1..79: note = chr19:1970005-1970084
  misc_feature 1..79: note = hypo
  source 1..79: mol_type = genomic DNA
gccgccccgagtcaccggagcctctggtggggccgcccggggtcactggagcctctggcggggccgccccatgtcactg

SEQ ID NO: 16385 - DNA, 35 bp, Homo sapiens
  misc_feature 1..35: note = chr19:1970474-1970509
  misc_feature 1..35: note = hypo
  source 1..35: mol_type = genomic DNA
cacaccaacctctcccgggtcggggtctgattgcc

SEQ ID NO: 16386 - DNA, 306 bp, Homo sapiens
  misc_feature 1..306: note = chr19:1978313-1978619
  misc_feature 1..306: note = hypo
  source 1..306: mol_type = genomic DNA
ctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtcta

SEQ ID NO: 16387 - DNA, 141 bp, Homo sapiens
  misc_feature 1..141: note = chr19:1993071-1993212
  misc_feature 1..141: note = hypo
  source 1..141: mol_type = genomic DNA
ccacgcaatgggcctcgagcgctggcaccgcgtacttcttggcggtgtatagcgtggtcatcaccgtctccgggccaatctgcacctcgtccgagtagagaaacctgcagaagcaacgcgggtggccgtgaggtgggaccg

SEQ ID NO: 16388 - DNA, 55 bp, Homo sapiens
  misc_feature 1..55: note = chr19:2274600-2274655
  misc_feature 1..55: note = hypo
  source 1..55: mol_type = genomic DNA
gctcctgagagtgggcggagaacgcagggtaaggagctagcgatggcccagagtg

SEQ ID NO: 16389 - DNA, 124 bp, Homo sapiens
  misc_feature 1..124: note = chr19:2359026-2359150
  misc_feature 1..124: note = hypo
  source 1..124: mol_type = genomic DNA
caaacccacttgaggcgtgtcctgcaaaacacctgacctgccttccccaggagcgggcagggtgtcagaaataggaatgtctgggaaactgcgacagcccagagagatccgaggaggcgtgacg

SEQ ID NO: 16390 - DNA, 124 bp, Homo sapiens
  misc_feature 1..124: note = chr19:2363060-2363184
  misc_feature 1..124: note = hypo
  source 1..124: mol_type = genomic DNA
tgcagagcctcacgccgcctgcttgtcctgccacgcggaatgggagtccgtgtgtgccccgctgcccacagcgtgtgaacgtgagttggggaccatgtggcccactgcgcgctgggtcccgtcc

SEQ ID NO: 16391 - DNA, 29 bp, Homo sapiens
  misc_feature 1..29: note = chr19:2471700-2471729
  misc_feature 1..29: note = hypo
  source 1..29: mol_type = genomic DNA
aaatacggtgactcacgcctgtaattcca

SEQ ID NO: 16392 - DNA, 40 bp, Homo sapiens
  misc_feature 1..40: note = chr19:2513207-2513247
  misc_feature 1..40: note = hypo
  source 1..40: mol_type = genomic DNA
gggatccccgcctcacgggcctgcacggaggacctgggcg

SEQ ID NO: 16393 - DNA, 39 bp, Homo sapiens
  misc_feature 1..39: note = chr19:2513455-2513494
  misc_feature 1..39: note = hypo
  source 1..39: mol_type = genomic DNA
ggctgcacctgctcccgtccgtgccgcagaggaggacgc

SEQ ID NO: 16394 - DNA, 22 bp, Homo sapiens
  misc_feature 1..22: note = chr19:2524913-2524935
  misc_feature 1..22: note = hypo
  source 1..22: mol_type = genomic DNA
gtgcgcacgggagtgcatgtgg

SEQ ID NO: 16395 - DNA, 109 bp, Homo sapiens; identical to SEQ ID NO: 5222
  misc_feature 1..109: note = chr19:2683891-2684000
  misc_feature 1..109: note = hypo
  source 1..109: mol_type = genomic DNA

SEQ ID NO: 16396 - DNA, 45 bp, Homo sapiens
  misc_feature 1..45: note = chr19:2899991-2900036
  misc_feature 1..45: note = hypo
  source 1..45: mol_type = genomic DNA
aatcaggacactggccgtgcgcggtggctcacgcctgtaatccca

SEQ ID NO: 16397 - DNA, 91 bp, Homo sapiens; identical to SEQ ID NO: 5223
  misc_feature 1..91: note = chr19:3219543-3219634
  misc_feature 1..91: note = hypo
  source 1..91: mol_type = genomic DNA

SEQ ID NO: 16398 - DNA, 57 bp, Homo sapiens; identical to SEQ ID NO: 5224
  misc_feature 1..57: note = chr19:3296613-3296670
  misc_feature 1..57: note = hypo
  source 1..57: mol_type = genomic DNA

SEQ ID NO: 16399 - DNA, 30 bp, Homo sapiens
  misc_feature 1..30: note = chr19:3562380-3562410
  misc_feature 1..30: note = hypo
  source 1..30: mol_type = genomic DNA
tttatgtgctggctgcggaatgccacctga

SEQ ID NO: 16400 - DNA, 75 bp, Homo sapiens
  misc_feature 1..75: note = chr19:3578148-3578223
  misc_feature 1..75: note = hypo
  source 1..75: mol_type = genomic DNA
aggcccggatgtgcccgccctggggttccccaggtccgcgagggctgctgggtgggactccgcagcttactagag

SEQ ID NO: 16401 - DNA, 194 bp, Homo sapiens; identical to SEQ ID NO: 5225
  misc_feature 1..194: note = chr19:3778200-3778394
  misc_feature 1..194: note = hypo
  source 1..194: mol_type = genomic DNA

SEQ ID NO: 16402 - DNA, 107 bp, Homo sapiens
  misc_feature 1..107: note = chr19:3779159-3779266
  misc_feature 1..107: note = hypo
  source 1..107: mol_type = genomic DNA
ggtactccatgccctcggccacgtgcctgggggtagtagggggcagtgggggctcaggtgccaggatgcccacattcagggctcagaaagctcggggtgcctggggc

SEQ ID NO: 16403 - DNA, 89 bp, Homo sapiens
  misc_feature 1..89: note = chr19:3821044-3821133
  misc_feature 1..89: note = hypo
  source 1..89: mol_type = genomic DNA
aggcacctctgcagccgtgtggtccagcgagttggccggcagtgtccctgcgtctacggaggccctggagcccacgtgtcaggtccgca

SEQ ID NO: 16404 - DNA, 161 bp, Homo sapiens
  misc_feature 1..161: note = chr19:3855416-3855577
  misc_feature 1..161: note = hypo
  source 1..161: mol_type = genomic DNA
cagtcccgggcgatccggcggcagattcattgagtcattggataaatacttcctgggtgctagtggggaccagctgctgtcatgggcgctgtcacagcagcggggaataaccagaccaaagtcccgtcctccaggagggtgctgcgcgatagtccagggag

SEQ ID NO: 16405 - DNA, 30 bp, Homo sapiens
  misc_feature 1..30: note = chr19:4131483-4131513
  misc_feature 1..30: note = hypo
  source 1..30: mol_type = genomic DNA
aagaaaagaaaaaggcgggctgggcgcggt

SEQ ID NO: 16406 - DNA, 30 bp, Homo sapiens
  misc_feature 1..30: note = chr19:4512122-4512152
  misc_feature 1..30: note = hypo
  source 1..30: mol_type = genomic DNA
ggacggtccctttggcgacattcactgccc

SEQ ID NO: 16407 - DNA, 350 bp, Homo sapiens; identical to SEQ ID NO: 5226
  misc_feature 1..350: note = chr19:4548034-4548384
  misc_feature 1..350: note = hypo
  source 1..350: mol_type = genomic DNA

SEQ ID NO: 16408 - DNA, 38 bp, Homo sapiens
  misc_feature 1..38: note = chr19:4555023-4555061
  misc_feature 1..38: note = hypo
  source 1..38: mol_type = genomic DNA
gggtgggcctgtccccgaggctgcggtagatgacagca

SEQ ID NO: 16409 - DNA, 216 bp, Homo sapiens; identical to SEQ ID NO: 1632
  misc_feature 1..216: note = chr19:4555896-4556112
  misc_feature 1..216: note = hypo
  source 1..216: mol_type = genomic DNA

SEQ ID NO: 16410 - DNA, 202 bp, Homo sapiens
  misc_feature 1..202: note = chr19:4557098-4557300
  misc_feature 1..202: note = hypo
  source 1..202: mol_type = genomic DNA
atccacccagctccccggcgcagtgccgcgtccccctggccctacccctccactcccacctgcaccccttcctcaccctctggtaccgcagctccgtggacgtggggggctccagctctacgcggtagaggttgtccctgggggaggggcatagttagtgagaactgggggctccgccaccctctcccgttccatccttccc

SEQ ID NO: 16411 - DNA, 85 bp, Homo sapiens; identical to SEQ ID NO: 5228
  misc_feature 1..85: note = chr19:4670740-4670825
  misc_feature 1..85: note = hypo
  source 1..85: mol_type = genomic DNA

SEQ ID NO: 16412 - DNA, 38 bp, Homo sapiens
  misc_feature 1..38: note = chr19:4789994-4790032
  misc_feature 1..38: note = hypo
  source 1..38: mol_type = genomic DNA
gagataacaattctgaatgaagacgctgttgaacatct

SEQ ID NO: 16413 - DNA, 90 bp, Homo sapiens
  misc_feature 1..90: note = chr19:4792950-4793040
  misc_feature 1..90: note = hypo
  source 1..90: mol_type = genomic DNA
cgctgatcaccgacccggatgagatgcgcatgcaggccctgttgatccgggagcgcatcctcggtccctcgcacccggacacttcctatt

SEQ ID NO: 16414 - DNA, 30 bp, Homo sapiens
  misc_feature 1..30: note = chr19:4800545-4800575
  misc_feature 1..30: note = hypo
  source 1..30: mol_type = genomic DNA
tgtcagtcactgctgcgtcctcagcaccca

SEQ ID NO: 16415 - DNA, 30 bp, Homo sapiens
  misc_feature 1..30: note = chr19:5676881-5676911
  misc_feature 1..30: note = hypo
  source 1..30: mol_type = genomic DNA
cccctctaacagtgacggtaacaggtgtga

SEQ ID NO: 16416 - DNA, 30 bp, Homo sapiens
  misc_feature 1..30: note = chr19:5759751-5759781
  misc_feature 1..30: note = hypo
  source 1..30: mol_type = genomic DNA
ggtccatccgcacatcgcaatatgactcag

SEQ ID NO: 16417 - DNA, 30 bp, Homo sapiens
  misc_feature 1..30: note = chr19:5789897-5789927
  misc_feature 1..30: note = hypo
  source 1..30: mol_type = genomic DNA
ccctacaatgtatcccgaggagaatgaaga

SEQ ID NO: 16418 - DNA, 37 bp, Homo sapiens
  misc_feature 1..37: note = chr19:5790176-5790213
  misc_feature 1..37: note = hypo
  source 1..37: mol_type = genomic DNA
cctcctccgtctgcccgtccgccgtctgtccatcctc

SEQ ID NO: 16419 - DNA, 19 bp, Homo sapiens
  misc_feature 1..19: note = chr19:5826127-5826146
  misc_feature 1..19: note = hypo
  source 1..19: mol_type = genomic DNA
agagcgagactccgtctca

SEQ ID NO: 16420 - DNA, 102 bp, Homo sapiens; identical to SEQ ID NO: 5229
  misc_feature 1..102: note = chr19:5914992-5915094
  misc_feature 1..102: note = hypo
  source 1..102: mol_type = genomic DNA

SEQ ID NO: 16421 - DNA, 30 bp, Homo sapiens
  misc_feature 1..30: note = chr19:5915421-5915451
  misc_feature 1..30: note = hypo
  source 1..30: mol_type = genomic DNA
agccacaccacagagcggggaggggcaggt

SEQ ID NO: 16422 - DNA, 30 bp, Homo sapiens
  misc_feature 1..30: note = chr19:5915925-5915955
  misc_feature 1..30: note = hypo
  source 1..30: mol_type = genomic DNA
gctgggagctctgggcgggggcagaccggc

SEQ ID NO: 16423 - DNA, 188 bp, Homo sapiens
  misc_feature 1..188: note = chr19:6358262-6358450
  misc_feature 1..188: note = hypo
  source 1..188: mol_type = genomic DNA
atgccggctttccaccgtgaggccctgcctgccagcgctggctgccatgtgggctttctgctttgcggacctgcaaggtattctcctaactctgtcaccttcaactccctccctctgtcttactcctgattctacaaaactgggagtgtctgtgtccccttctatctccccatcggactgcagtcccc

SEQ ID NO: 16424 - DNA, 35 bp, Homo sapiens
  misc_feature 1..35: note = chr19:7727784-7727819
  misc_feature 1..35: note = hypo
  source 1..35: mol_type = genomic DNA
tgacaagggccaactcgtcccgggcaagggcagca

SEQ ID NO: 16425 - DNA, 30 bp, Homo sapiens
  misc_feature 1..30: note = chr19:8009581-8009611
  misc_feature 1..30: note = hypo
  source 1..30: mol_type = genomic DNA
gaggcagcttggccccggagagcatgcatt

SEQ ID NO: 16426 - DNA, 99 bp, Homo sapiens
  misc_feature 1..99: note = chr19:8475426-8475525
  misc_feature 1..99: note = hypo
  source 1..99: mol_type = genomic DNA
aaagaaaatcaccatttggttgctattatggtaataactgactcaggcaagggtcatcaattgatattaagctcttggaaacggcgtgtgttgaggaac

SEQ ID NO: 16427 - DNA, 49 bp, Homo sapiens
  misc_feature 1..49: note = chr19:8576903-8576952
  misc_feature 1..49: note = hypo
  source 1..49: mol_type = genomic DNA
ctgtgcaatgccacccgcccttcgagcgtgggaacggagcctgggcact

SEQ ID NO: 16428 - DNA, 24 bp, Homo sapiens
  misc_feature 1..24: note = chr19:9937362-9937386
  misc_feature 1..24: note = hypo
  source 1..24: mol_type = genomic DNA
aaaatcccacggccggggaaatca

SEQ ID NO: 16429 - DNA, 41 bp, Homo sapiens; identical to SEQ ID NO: 1633
  misc_feature 1..41: note = chr19:10231201-10231242
  misc_feature 1..41: note = hypo
  source 1..41: mol_type = genomic DNA

SEQ ID NO: 16430 - DNA, 30 bp, Homo sapiens
  misc_feature 1..30: note = chr19:10231504-10231534
  misc_feature 1..30: note = hypo
  source 1..30: mol_type = genomic DNA
aaagaaaccaaagttcggggaaaacaatcc

SEQ ID NO: 16431 - DNA, 68 bp, Homo sapiens
  misc_feature 1..68: note = chr19:10370372-10370440
  misc_feature 1..68: note = hypo
  source 1..68: mol_type = genomic DNA
ctctggcaggactcacgttacagacccctctaccccttcagcctgccctacagcgacttcccccgacc

SEQ ID NO: 16432 - DNA, 151 bp, Homo sapiens
  misc_feature 1..151: note = chr19:10562153-10562304
  misc_feature 1..151: note = hypo
  source 1..151: mol_type = genomic DNA
gctacgcatttgcagcgctggggtgttgggaatagattctgaagagtggcacgccagtgtgtacttgtgtaggtgtataggtttgcacgggtaattatgcagggttataggtgtgtggggctgtgccagaggggtgcgcatgtctgcaggg

SEQ ID NO: 16433 - DNA, 30 bp, Homo sapiens
  misc_feature 1..30: note = chr19:10570365-10570395
  misc_feature 1..30: note = hypo
  source 1..30: mol_type = genomic DNA
ccataacagcctgcacgcagctgacgtgct

SEQ ID NO: 16434 - DNA, 18 bp, Homo sapiens
  misc_feature 1..18: note = chr19:10711942-10711960
  misc_feature 1..18: note = hypo
  source 1..18: mol_type = genomic DNA
acccggcctgttttcacc

SEQ ID NO: 16435 - DNA, 204 bp, Homo sapiens
  misc_feature 1..204: note = chr19:10875903-10876107
  misc_feature 1..204: note = hypo
  source 1..204: mol_type = genomic DNA
gattacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggg

SEQ ID NO: 16436 - DNA, 30 bp, Homo sapiens
  misc_feature 1..30: note = chr19:10954418-10954448
  misc_feature 1..30: note = hypo
  source 1..30: mol_type = genomic DNA
gcatggtgggagacacgggacactgcaggt

SEQ ID NO: 16437 - DNA, 30 bp, Homo sapiens
  misc_feature 1..30: note = chr19:11002992-11003022
  misc_feature 1..30: note = hypo
  source 1..30: mol_type = genomic DNA
tgctggggaagtgcccgttcagggccatgg

SEQ ID NO: 16438 - DNA, 30 bp, Homo sapiens
  misc_feature 1..30: note = chr19:11005335-11005365
  misc_feature 1..30: note = hypo
  source 1..30: mol_type = genomic DNA
gtggcctttctcccccgagctgctgctgct

SEQ ID NO: 16439 - DNA, 25 bp, Homo sapiens
  misc_feature 1..25: note = chr19:11008369-11008394
  misc_feature 1..25: note = hypo
  source 1..25: mol_type = genomic DNA
atgctagctctgggccgggcacggt

SEQ ID NO: 16440 - DNA, 30 bp, Homo sapiens
  misc_feature 1..30: note = chr19:11252737-11252767
  misc_feature 1..30: note = hypo
  source 1..30: mol_type = genomic DNA
cagaaacaccagttacgagcagggggctgg

SEQ ID NO: 16441 - DNA, 23 bp, Homo sapiens
  misc_feature 1..23: note = chr19:12220425-12220448
  misc_feature 1..23: note = hypo
  source 1..23: mol_type = genomic DNA
cacacaaacgtttttatgtttga

SEQ ID NO: 16442 - DNA, 30 bp, Homo sapiens
  misc_feature 1..30: note = chr19:12222728-12222758
  misc_feature 1..30: note = hypo
  source 1..30: mol_type = genomic DNA
agtttctgtgcctttcgataccatcaaagg

SEQ ID NO: 16443 - DNA, 152 bp, Homo sapiens
  misc_feature 1..152: note = chr19:12863419-12863571
  misc_feature 1..152: note = hypo
  source 1..152: mol_type = genomic DNA
acacagcccgagtggcgaacgcccgcttcggtggcttctcccagctgctgctactgtggcgtgggagcatctacaaactcctgtggcgagagctgctctgcttccttgggttctacatggcgctgagtgctgcctaccggtgaggctgccct

SEQ ID NO: 16444 - DNA, 30 bp, Homo sapiens
  misc_feature 1..30: note = chr19:13335742-13335772
  misc_feature 1..30: note = hypo
  source 1..30: mol_type = genomic DNA
tttctcttggtggcccgcagggagggcaca

SEQ ID NO: 16445 - DNA, 30 bp, Homo sapiens
  misc_feature 1..30: note = chr19:13781908-13781938
  misc_feature 1..30: note = hypo
  source 1..30: mol_type = genomic DNA
caaccaaatttggcccgtgggccataattt

SEQ ID NO: 16446 - DNA, 20 bp, Homo sapiens
  misc_feature 1..20: note = chr19:13988706-13988726
  misc_feature 1..20: note = hypo
  source 1..20: mol_type = genomic DNA
agttgattttatttacgtat

SEQ ID NO: 16447 - DNA, 50 bp, Homo sapiens
  misc_feature 1..50: note = chr19:14181305-14181355
  misc_feature 1..50: note = hypo
  source 1..50: mol_type = genomic DNA
gtggcaggtgcctcccgccaggagaacggcgccagcgtgatcctccatga

SEQ ID NO: 16448 - DNA, 40 bp, Homo sapiens
  misc_feature 1..40: note = chr19:14327052-14327092
  misc_feature 1..40: note = hypo
  source 1..40: mol_type = genomic DNA
attatacaggtcagccgggcgcagtgactcatgcctgtaa

SEQ ID NO: 16449 - DNA, 36 bp, Homo sapiens
  misc_feature 1..36: note = chr19:14630627-14630663
  misc_feature 1..36: note = hypo
  source 1..36: mol_type = genomic DNA
caattgtaggcaacacgatcgcgtttggctctgaaa

SEQ ID NO: 16450 - DNA, 30 bp, Homo sapiens
  misc_feature 1..30: note = chr19:15237724-15237754
  misc_feature 1..30: note = hypo
  source 1..30: mol_type = genomic DNA
gaatttgagaccaaccggggccaaaaagtg

SEQ ID NO: 16451 - DNA, 30 bp, Homo sapiens
  misc_feature 1..30: note = chr19:15292289-15292319
  misc_feature 1..30: note = hypo
  source 1..30: mol_type = genomic DNA
aggactcccccaagtcgttgctgtccccac

SEQ ID NO: 16452 - DNA, 136 bp, Homo sapiens
  misc_feature 1..136: note = chr19:16275694-16275830
  misc_feature 1..136: note = hypo
  source 1..136: mol_type = genomic DNA
acgcacaaatgtagtcgtcgttgttaaaatctgcagagcaggatggatggggagtgacagcaggtggcaggagggctaggccggctgtgggcacatactgtgcccatgttacaagaaggggaaactaaggtcgggc

SEQ ID NO: 16453 - DNA, 30 bp, Homo sapiens
  misc_feature 1..30: note = chr19:16638285-16638315
  misc_feature 1..30: note = hypo
  source 1..30: mol_type = genomic DNA
gccaaccaggccccacgggcaagggggaaa

SEQ ID NO: 16454 - DNA, 30 bp, Homo sapiens
  misc_feature 1..30: note = chr19:16638706-16638736
  misc_feature 1..30: note = hypo
  source 1..30: mol_type = genomic DNA
tcacttgacctgtcccggagccacaggaag

SEQ ID NO: 16455 - DNA, 50 bp, Homo sapiens
  misc_feature 1..50: note = chr19:16939668-16939718
  misc_feature 1..50: note = hypo
  source 1..50: mol_type = genomic DNA
agcaaaaattcaccacgcaaggccctatattagggcgctgggggctcata

SEQ ID NO: 16456 - DNA, 30 bp, Homo sapiens
  misc_feature 1..30: note = chr19:17365715-17365745
  misc_feature 1..30: note = hypo
  source 1..30: mol_type = genomic DNA
aaagagggaagtgaccggtgttcctggcag

SEQ ID NO: 16457 - DNA, 25 bp, Homo sapiens
  misc_feature 1..25: note = chr19:17379245-17379270
  misc_feature 1..25: note = hypo
  source 1..25: mol_type = genomic DNA
tttttttttttgagacggagtttcg

SEQ ID NO: 16458 - DNA, 30 bp, Homo sapiens
  misc_feature 1..30: note = chr19:17404772-17404802
  misc_feature 1..30: note = hypo
  source 1..30: mol_type = genomic DNA
aattatataggtcaccggtctcatacaaat

SEQ ID NO: 16459 - DNA, 164 bp, Homo sapiens
  misc_feature 1..164: note = chr19:17405108-17405272
  misc_feature 1..164: note = hypo
  source 1..164: mol_type = genomic DNA
ctggtcttcctccaccggcacaaacttatcgtgcatgccgtggacaagcaggacgggcacggtgagctcggcgtggtagacctcgtcgccctcgggccagtactggccgctcatcatggcccggagtacgaaggatgacacgttgaaagcgttgccctccttta

SEQ ID NO: 16460 - DNA, 75 bp, Homo sapiens
  misc_feature 1..75: note = chr19:17759263-17759338
  misc_feature 1..75: note = hypo
  source 1..75: mol_type = genomic DNA
ggtcctggcacttctcgtggcacttgacaccgcactcggtgcagcgcatgccctgcctcgcgatgccccacagca

SEQ ID NO: 16461 - DNA, 30 bp, Homo sapiens
  misc_feature 1..30: note = chr19:17836551-17836581
  misc_feature 1..30: note = hypo
  source 1..30: mol_type = genomic DNA
ggatgagggtgtcctcgcccagttttccca

SEQ ID NO: 16462 - DNA, 96 bp, Homo sapiens
  misc_feature 1..96: note = chr19:18041146-18041242
  misc_feature 1..96: note = hypo
  source 1..96: mol_type = genomic DNA
agccaccgcgcccggcctttaataatctttttacctagaaggcgggggaacctgctgggaattggcgaaaactagcagtcacgccctttggccagg

SEQ ID NO: 16463 - DNA, 144 bp, Homo sapiens
  misc_feature 1..144: note = chr19:18054338-18054482
  misc_feature 1..144: note = hypo
  source 1..144: mol_type = genomic DNA
cggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaac

SEQ ID NO: 16464 - DNA, 30 bp, Homo sapiens
  misc_feature 1..30: note = chr19:18054810-18054840
  misc_feature 1..30: note = hypo
  source 1..30: mol_type = genomic DNA
gtgggtggggagaggcgggcgaagaatggg

SEQ ID NO: 16465 - DNA, 176 bp, Homo sapiens
  misc_feature 1..176: note = chr19:18092619-18092795
  misc_feature 1..176: note = hypo
  source 1..176: mol_type = genomic DNA
gtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcag

SEQ ID NO: 16466 - DNA, 41 bp, Homo sapiens
  misc_feature 1..41: note = chr19:18103700-18103741
  misc_feature 1..41: note = hypo
  source 1..41: mol_type = genomic DNA
acctccccagagcaacggcagcccctcggccatctgggaac

SEQ ID NO: 16467 - DNA, 88 bp, Homo sapiens
  misc_feature 1..88: note = chr19:18104430-18104518
  misc_feature 1..88: note = hypo
  source 1..88: mol_type = genomic DNA
gggctcagctcctgccggaggagggcacaaggacccgctgtgggctgagtgcagtggcgggcggatcgcttgagctcaggagtttgag

SEQ ID NO: 16468 - DNA, 47 bp, Homo sapiens
  misc_feature 1..47: note = chr19:18207919-18207966
  misc_feature 1..47: note = hypo
  source 1..47: mol_type = genomic DNA
ggtgagatcctcactcgcctcaccctagaacccgttctgctgtgtgt

SEQ ID NO: 16469 - DNA, 18 bp, Homo sapiens
  misc_feature 1..18: note = chr19:18298268-18298286
  misc_feature 1..18: note = hypo
  source 1..18: mol_type = genomic DNA
acaggcataagccaccga

SEQ ID NO: 16470 - DNA, 200 bp, Homo sapiens
  misc_feature 1..200: note = chr19:18330991-18331191
  misc_feature 1..200: note = hypo
  source 1..200: mol_type = genomic DNA
gtactcctaaaatgtcgtccaggcagtgactcaacaaagctcacccaggaaggtccgggagatgtactcggacacctggttcccggagcggctggtttcggacaggtgggtcaactcccggttcaggatccgcttgaactggggcggagagaaggtgaagaccgtgatgatggggcaccgtgggccgaggcaggtgagct

SEQ ID NO: 16471 - DNA, 30 bp, Homo sapiens
  misc_feature 1..30: note = chr19:18383321-18383351
  misc_feature 1..30: note = hypo
  source 1..30: mol_type = genomic DNA
tctggatccagggctcgggcaggcttcacc

SEQ ID NO: 16472 - DNA, 42 bp, Homo sapiens
  misc_feature 1..42: note = chr19:18788397-18788439
  misc_feature 1..42: note = hypo
  source 1..42: mol_type = genomic DNA
ataagcatgtggagccgccaggaggagggtatttttttttta

SEQ ID NO: 16473 - DNA, 30 bp, Homo sapiens
  misc_feature 1..30: note = chr19:18883509-18883539
  misc_feature 1..30: note = hypo
  source 1..30: mol_type = genomic DNA
cactgcctgtagccccgtgttctggaggca

SEQ ID NO: 16474 - DNA, 65 bp, Homo sapiens
  misc_feature 1..65: note = chr19:18883973-18884038
  misc_feature 1..65: note = hypo
  source 1..65: mol_type = genomic DNA
atagggacatcagtacggggctctcaggggcagatggttctaggtggagccgagacctgccttcc

SEQ ID NO: 16475 - DNA, 83 bp, Homo sapiens
  misc_feature 1..83: note = chr19:18988902-18988985
  misc_feature 1..83: note = hypo
  source 1..83: mol_type = genomic DNA
cttccctgaaaccatcgttcccacgtcaccgatggcccccaccggccaaatcagagggcctggctggtcggcaccttccaggg

SEQ ID NO: 16476 - DNA, 557 bp, Homo sapiens; identical to SEQ ID NO: 1634
  misc_feature 1..557: note = chr19:18989724-18990281
  misc_feature 1..557: note = hypo
  source 1..557: mol_type = genomic DNA

SEQ ID NO: 16477 - DNA, 230 bp, Homo sapiens
  misc_feature 1..230: note = chr19:18994850-18995080
  misc_feature 1..230: note = hypo
  source 1..230: mol_type = genomic DNA
gtgtgggctgtgcctcggccccctgccacccgatcctgtccttaccggaaggcgtaggaggagacgatgaggatgagagtgaccacgtggtggagcagcatgaccaccgagtccttgcgccaggtgtccatgtatagcgtagcgtagatggagtggccatagaagcttccctggagcaggtaggcggctgcaatgtcccgtggcactgccatgcccggcgtccagtctgg

SEQ ID NO: 16478 - DNA, 138 bp, Homo sapiens
  misc_feature 1..138: note = chr19:19218614-19218752
  misc_feature 1..138: note = hypo
  source 1..138: mol_type = genomic DNA
ggcttcgggaggagccgagagcctctgtggctcctccctgtgcctgggaggcctgagtcccacctgctgggctgctctgtcctggcaggtacagcaacatctttcatgtcttcatccgcatctcgagagaagaggggc

SEQ ID NO: 16479 - DNA, 30 bp, Homo sapiens
  misc_feature 1..30: note = chr19:19335195-19335225
  misc_feature 1..30: note = hypo
  source 1..30: mol_type = genomic DNA
cccacaggaactctacgatgtgtattgctt

SEQ ID NO: 16480 - DNA, 30 bp, Homo sapiens
  misc_feature 1..30: note = chr19:22017749-22017779
  misc_feature 1..30: note = hypo
  source 1..30: mol_type = genomic DNA
aaaaaaaaaatagcccggctcggtggctat

SEQ ID NO: 16481 - DNA, 46 bp, Homo sapiens
  misc_feature 1..46: note = chr19:30555362-30555408
  misc_feature 1..46: note = hypo
  source 1..46: mol_type = genomic DNA
ggcacctgcccagggcggcccactgtgctcccggcagccctcctga

SEQ ID NO: 16482 - DNA, 47 bp, Homo sapiens
  misc_feature 1..47: note = chr19:30637506-30637553
  misc_feature 1..47: note = hypo
  source 1..47: mol_type = genomic DNA
cagcgagactcgatgcgaaggcaaggcaagcacgtgacatccagtac

SEQ ID NO: 16483 - DNA, 30 bp, Homo sapiens
  misc_feature 1..30: note = chr19:31587530-31587560
  misc_feature 1..30: note = hypo
  source 1..30: mol_type = genomic DNA
ctcacctgagcctggcgctgccctccattt

SEQ ID NO: 16484 - DNA, 38 bp, Homo sapiens
  misc_feature 1..38: note = chr19:32364365-32364403
  misc_feature 1..38: note = hypo
  source 1..38: mol_type = genomic DNA
gcagccctatggccccgggcatgcgcttctcttcttcc

SEQ ID NO: 16485 - DNA, 30 bp, Homo sapiens
  misc_feature 1..30: note = chr19:32672333-32672363
  misc_feature 1..30: note = hypo
  source 1..30: mol_type = genomic DNA
agcggctggtgagtgcgcttgcacacaaaa

SEQ ID NO: 16486 - DNA, 30 bp, Homo sapiens
  misc_feature 1..30: note = chr19:32835111-32835141
  misc_feature 1..30: note = hypo
  source 1..30: mol_type = genomic DNA
tctcttaccttttatcgaaaaaaaaattac

SEQ ID NO: 16487 - DNA, 30 bp, Homo sapiens
  misc_feature 1..30: note = chr19:33415273-33415303
  misc_feature 1..30: note = hypo
  source 1..30: mol_type = genomic DNA
ccattagccacaacacgaggtctgtcgctg

SEQ ID NO: 16488 - DNA, 25 bp, Homo sapiens
  misc_feature 1..25: note = chr19:33557305-33557330
  misc_feature 1..25: note = hypo
  source 1..25: mol_type = genomic DNA
cgcacccggccgtggagcacggttc

SEQ ID NO: 16489 - DNA, 30 bp, Homo sapiens
  misc_feature 1..30: note = chr19:34263853-34263883
  misc_feature 1..30: note = hypo
  source 1..30: mol_type = genomic DNA
cgcccaccagtacttcgcccaactctcggc

SEQ ID NO: 16490 - DNA, 30 bp, Homo sapiens
  misc_feature 1..30: note = chr19:35615979-35616009
  misc_feature 1..30: note = hypo
  source 1..30: mol_type = genomic DNA
gatgaacgtggcccacggtcagcagctcac

SEQ ID NO: 16491 - DNA, 162 bp, Homo sapiens
  misc_feature 1..162: note = chr19:35616256-35616418
  misc_feature 1..162: note = hypo
  source 1..162: mol_type = genomic DNA
ttgtcaggctcaaggcggaggacctggctgaaggcgaagtcgctgcctaggatggccagctggtccctggcgatgagcagtggctggaagacgtgggcaccgcgcgagggaagttgctgcagcagacgaaacatggagccgtcccagcgcatgacctgtggg

SEQ ID NO: 16492 - DNA, 85 bp, Homo sapiens
  misc_feature 1..85: note = chr19:35781374-35781459
  misc_feature 1..85: note = hypo
  source 1..85: mol_type = genomic DNA
gacagggcacctgcccgccagtcacaggtcctgtcacccagccccttcctctcatgggctccagccgcctcgctcccacaggtct

SEQ ID NO: 16493 - DNA, 37 bp, Homo sapiens
  misc_feature 1..37: note = chr19:35797909-35797946
  misc_feature 1..37: note = hypo
  source 1..37: mol_type = genomic DNA
aaaagatactaagcacgtgcaccggcagggtgtcggc

SEQ ID NO: 16494 - DNA, 344 bp, Homo sapiens
  misc_feature 1..344: note = chr19:36221572-36221916
  misc_feature 1..344: note = hypo
  source 1..344: mol_type = genomic DNA
cccaagcatcctaaccgtcttatcccacatgccaggtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcaggtgtggctttggctctgtcttcttcctgaataccgctctccctaaacaaacctacagatctctgttccccgctcccttttggaaagtccaggaggcttgcttttgcttcagttgctgtaatgtaacggcagctcgcttactgccatgc

SEQ ID NO: 16495 - DNA, 50 bp, Homo sapiens
  misc_feature 1..50: note = chr19:36222432-36222482
  misc_feature 1..50: note = hypo
  source 1..50: mol_type = genomic DNA
gtaatggagagcctccgggccggggcgggcgggagcgtctgatgtggctt

SEQ ID NO: 16496 - DNA, 30 bp, Homo sapiens
  misc_feature 1..30: note = chr19:36250123-36250153
  misc_feature 1..30: note = hypo
  source 1..30: mol_type = genomic DNA
atcctgaatgtgcaacggtgcttcatggaa

SEQ ID NO: 16497 - DNA, 169 bp, Homo sapiens
  misc_feature 1..169: note = chr19:36604561-36604730
  misc_feature 1..169: note = hypo
  source 1..169: mol_type = genomic DNA
gatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaat

SEQ ID NO: 16498 - DNA, 100 bp, Homo sapiens
  misc_feature 1..100: note = chr19:37702069-37702169
  misc_feature 1..100: note = hypo
  source 1..100: mol_type = genomic DNA
ggttataggcgtgagccaccgcctccggctgttatatttacaatacctaagttaccccttggttacggcacactgcagaaaacaacgatttactaggaga

SEQ ID NO: 16499 - DNA, 36 bp, Homo sapiens
  misc_feature 1..36: note = chr19:38481038-38481074
  misc_feature 1..36: note = hypo
  source 1..36: mol_type = genomic DNA
agccagtgagacaggcggggtcgtggggtgaatacc

SEQ ID NO: 16500 - DNA, 20 bp, Homo sapiens
  misc_feature 1..20: note = chr19:38828365-38828385
  misc_feature 1..20: note = hypo
  source 1..20: mol_type = genomic DNA
tttatttttttgagacggag

SEQ ID NO: 16501 - DNA, 138 bp, Homo sapiens
  misc_feature 1..138: note = chr19:38905584-38905722
  misc_feature 1..138: note = hypo
  source 1..138: mol_type = genomic DNA
ttgggtaggtgcaggcggccgtcaggcaacctgtcgggctgtgcctcatgcagggacaccaggtccttgaggtgcacgcccagtacaggcagccggaaacccgcgcagccagcccaggtgcggcggtagcgggcgtag

SEQ ID NO: 16502 - DNA, 30 bp, Homo sapiens
  misc_feature 1..30: note = chr19:38974232-38974262
  misc_feature 1..30: note = hypo
  source 1..30: mol_type = genomic DNA
tcctcaacacaaccccgggattccagacta

SEQ ID NO: 16503 - DNA, 47 bp, Homo sapiens
  misc_feature 1..47: note = chr19:38998362-38998409
  misc_feature 1..47: note = hypo
  source 1..47: mol_type = genomic DNA
acatggaactggactcgtcttccattgaaaagcggtttgcctttggc

SEQ ID NO: 16504 - DNA, 30 bp, Homo sapiens
  misc_feature 1..30: note = chr19:39330221-39330251
  misc_feature 1..30: note = hypo
  source 1..30: mol_type = genomic DNA
acttcacctgtgttacgaactactctaagt

SEQ ID NO: 16505 - DNA, 26 bp, Homo sapiens
  misc_feature 1..26: note = chr19:39392993-39393019
  misc_feature 1..26: note = hypo
  source 1..26: mol_type = genomic DNA
gccaccgcgcccggcctcattttatt

SEQ ID NO: 16506 - DNA, 39 bp, Homo sapiens
  misc_feature 1..39: note = chr19:39646149-39646188
  misc_feature 1..39: note = hypo
  source 1..39: mol_type = genomic DNA
aaccaagcagccctccggaggcctcgaggggaacagaca

SEQ ID NO: 16507 - DNA, 189 bp, Homo sapiens
  misc_feature 1..189: note = chr19:40218707-40218896
  misc_feature 1..189: note = hypo
  source 1..189: mol_type = genomic DNA
actagttctgccacccgggatccacattgacatatgtgggaagatgcacagctgcttcatcagaggcgctactgtgtgaggaggaaccttcccatgcacagaaggccacatgcatgttcacagctcaacacccagtcacatcgcagcacacacacccacagtcacacagagccacgccaatcactgagt

SEQ ID NO: 16508 - DNA, 31 bp, Homo sapiens
  misc_feature 1..31: note = chr19:40951175-40951206
  misc_feature 1..31: note = hypo
  source 1..31: mol_type = genomic DNA
aatattattttttgccgggcgcagtggcgca

SEQ ID NO: 16509 - DNA, 49 bp, Homo sapiens
  misc_feature 1..49: note = chr19:41062945-41062994
  misc_feature 1..49: note = hypo
  source 1..49: mol_type = genomic DNA
ctcagagtttgccagcgagacaggtatggcagggcgggaacggctggca

SEQ ID NO: 16510 - DNA, 120 bp, Homo sapiens; identical to SEQ ID NO: 1635
  misc_feature 1..120: note = chr19:41881475-41881595
  misc_feature 1..120: note = hypo
  source 1..120: mol_type = genomic DNA

SEQ ID NO: 16511 - DNA, 31 bp, Homo sapiens
  misc_feature 1..31: note = chr19:42202366-42202397
  misc_feature 1..31: note = hypo
  source 1..31: mol_type = genomic DNA
aagaataaaatcagccgggcgcggtggctca

SEQ ID NO: 16512 - DNA, 127 bp, Homo sapiens
  misc_feature 1..127: note = chr19:42349306-42349433
  misc_feature 1..127: note = hypo
  source 1..127: mol_type = genomic DNA
tcgcgggccccttggcgcgttcccggttccccactcgctccctggggcacgggaaggggggagggggacatgcatgaaattaattgttggtagtggccacaggagcaggaagcgctggacacagtga

SEQ ID NO: 16513 - DNA, 30 bp, Homo sapiens
  misc_feature 1..30: note = chr19:42373877-42373907
  misc_feature 1..30: note = hypo
  source 1..30: mol_type = genomic DNA
ccaaagcccatacttcgtcaggtagactta

SEQ ID NO: 16514 - DNA, 44 bp, Homo sapiens
  misc_feature 1..44: note = chr19:42408203-42408247
  misc_feature 1..44: note = hypo
  source 1..44: mol_type = genomic DNA
gaagaaattggtccacgagggcccactgacgtggcgggtgacta

SEQ ID NO: 16515 - DNA, 30 bp, Homo sapiens
  misc_feature 1..30: note = chr19:42408664-42408694
  misc_feature 1..30: note = hypo
  source 1..30: mol_type = genomic DNA
tggaggtgggcagggcggggccaggcctag

SEQ ID NO: 16516 - DNA, 19 bp, Homo sapiens
  misc_feature 1..19: note = chr19:42579050-42579069
  misc_feature 1..19: note = hypo
  source 1..19: mol_type = genomic DNA
tttcagatggagtctcgct

SEQ ID NO: 16517 - DNA, 33 bp, Homo sapiens
  misc_feature 1..33: note = chr19:45381918-45381951
  misc_feature 1..33: note = hypo
  source 1..33: mol_type = genomic DNA
cccccgacctgaccacgccggcctagggttcca

SEQ ID NO: 16518 - DNA, 30 bp, Homo sapiens
  misc_feature 1..30: note = chr19:45626698-45626728
  misc_feature 1..30: note = hypo
  source 1..30: mol_type = genomic DNA
ccctgtcttgaagttcgagaaggctgcatt

SEQ ID NO: 16519 - DNA, 30 bp, Homo sapiens
  misc_feature 1..30: note = chr19:45709152-45709182
  misc_feature 1..30: note = hypo
  source 1..30: mol_type = genomic DNA
ctcaacatcctcagtcgttagagaaacgca

SEQ ID NO: 16520 - DNA, 131 bp, Homo sapiens
  misc_feature 1..131: note = chr19:45810015-45810146
  misc_feature 1..131: note = hypo
  source 1..131: mol_type = genomic DNA
gggcggggatcatgtcgtcaatggactggcctttctccaacttcttctccatttccaccatgagcttcacaccatccaccaccagctgcacctgttctacttcggacgagcccagccgatcagcgttggac

SEQ ID NO: 16521 - DNA, 21 bp, Homo sapiens
  misc_feature 1..21: note = chr19:45835239-45835260
  misc_feature 1..21: note = hypo
  source 1..21: mol_type = genomic DNA
acagagcgagactacgtctca

SEQ ID NO: 16522 - DNA, 158 bp, Homo sapiens
  misc_feature 1..158: note = chr19:45997445-45997603
  misc_feature 1..158: note = hypo
  source 1..158: mol_type = genomic DNA
gaattctaattggtccgtgctatcgaggcactgtccccttactggctctcgctccagtggcccccactgcttttcttcctcttccagcaatggctcttcgggcccagagttcgaatctcgcgatcgggatggggacggagtaccggcctggggtgtcc

SEQ ID NO: 16523 - DNA, 44 bp, Homo sapiens; identical to SEQ ID NO: 5233
  misc_feature 1..44: note = chr19:46234843-46234887
  misc_feature 1..44: note = hypo
  source 1..44: mol_type = genomic DNA

SEQ ID NO: 16524 - DNA, 48 bp, Homo sapiens
  misc_feature 1..48: note = chr19:46321351-46321399
  misc_feature 1..48: note = hypo
  source 1..48: mol_type = genomic DNA
ggccagcacctctgacgtgtacacgttccgctccgcaaagcacaggtt

SEQ ID NO: 16525 - DNA, 52 bp, Homo sapiens
  misc_feature 1..52: note = chr19:46327091-46327143
  misc_feature 1..52: note = hypo
  source 1..52: mol_type = genomic DNA
cagcaggagcagctccggggagttcatgcccattcctcggatctagaggcag

SEQ ID NO: 16526 - DNA, 80 bp, Homo sapiens
  misc_feature 1..80: note = chr19:46404534-46404614
  misc_feature 1..80: note = hypo
  source 1..80: mol_type = genomic DNA
gcacgtcggtcctcccggcggtcttccgacaacacgtagcgctgagggcaggcgcttgggggcggcggctgtgaagaggg

SEQ ID NO: 16527 - DNA, 30 bp, Homo sapiens
  misc_feature 1..30: note = chr19:47200506-47200536
  misc_feature 1..30: note = hypo
  source 1..30: mol_type = genomic DNA
aagagtcacgtgaaccgccagactttcctg

SEQ ID NO: 16528 - DNA, 44 bp, Homo sapiens
  misc_feature 1..44: note = chr19:47429440-47429484
  misc_feature 1..44: note = hypo
  source 1..44: mol_type = genomic DNA
ctataaaactggagtcggagtgagggaatcgctttcatttctcc

SEQ ID NO: 16529 - DNA, 42 bp, Homo sapiens
  misc_feature 1..42: note = chr19:48003498-48003540
  misc_feature 1..42: note = hypo
  source 1..42: mol_type = genomic DNA
tctcagaatcctccccgccccccacaccgctcccttctgcat

SEQ ID NO: 16530 - DNA, 52 bp, Homo sapiens
  misc_feature 1..52: note = chr19:48151322-48151374
  misc_feature 1..52: note = hypo
  source 1..52: mol_type = genomic DNA
cgtctgccttctctccgtctccctgttttcctgttaccgtctccccgtccct

SEQ ID NO: 16531 - DNA, 22 bp, Homo sapiens
  misc_feature 1..22: note = chr19:48614830-48614852
  misc_feature 1..22: note = hypo
  source 1..22: mol_type = genomic DNA
aagcccagcactaagcgtcatc

SEQ ID NO: 16532 - DNA, 218 bp, Homo sapiens
  misc_feature 1..218: note = chr19:49119132-49119350
  misc_feature 1..218: note = hypo
  source 1..218: mol_type = genomic DNA
cttggtgtggctgtgcggggttcctggggccttgccgaaatgccggtacacctctcggcccttgcgaggacctagggaaggggaaggagaaccgggtgagacagggatctggcgcccagcttctggcctcccagatccaggagggtgaaggctgccagtagccacacagctcagtccaaacccgtcgaccacgtatcactcaccggagagcaggacag

SEQ ID NO: 16533 - DNA, 26 bp, Homo sapiens
  misc_feature 1..26: note = chr19:49402376-49402402
  misc_feature 1..26: note = hypo
  source 1..26: mol_type = genomic DNA
gaggtagacaccgtctcaaaaaaaaa

SEQ ID NO: 16534 - DNA, 31 bp, Homo sapiens
  misc_feature 1..31: note = chr19:50049718-50049749
  misc_feature 1..31: note = hypo
  source 1..31: mol_type = genomic DNA
tgagtagagttgggccgtgtgcggtgactca

SEQ ID NO: 16535 - DNA, 30 bp, Homo sapiens
  misc_feature 1..30: note = chr19:50053089-50053119
  misc_feature 1..30: note = hypo
  source 1..30: mol_type = genomic DNA
atccacactgtagcccgtgtcaggacgtca

SEQ ID NO: 16536 - DNA, 75 bp, Homo sapiens
  misc_feature 1..75: note = chr19:50166634-50166709
  misc_feature 1..75: note = hypo
  source 1..75: mol_type = genomic DNA
tgagggtccttgctccggtcctctgctaaacgcaacccttctttgcggttgagggcagagcggaaattcctcttc

SEQ ID NO: 16537 - DNA, 30 bp, Homo sapiens
  misc_feature 1..30: note = chr19:50216075-50216105
  misc_feature 1..30: note = hypo
  source 1..30: mol_type = genomic DNA
ctatgtttcctcaggcggtggattcgggcc

SEQ ID NO: 16538 - DNA, 136 bp, Homo sapiens
  misc_feature 1..136: note = chr19:50216693-50216829
  misc_feature 1..136: note = hypo
  source 1..136: mol_type = genomic DNA
gcagcacattgaggacgcactgctggatgtggcctccctgttccaggcgggacagcattttaagcgccggttcagagggtcagggaaggagaactccaggcacaggtgtggatttctctcccgccagactggggcc

SEQ ID NO: 16539 - DNA, 16 bp, Homo sapiens
  misc_feature 1..16: note = chr19:50320037-50320053
  misc_feature 1..16: note = hypo
  source 1..16: mol_type = genomic DNA
ccggccctggtcaggt

SEQ ID NO: 16540 - DNA, 30 bp, Homo sapiens
  misc_feature 1..30: note = chr19:50353152-50353182
  misc_feature 1..30: note = hypo
  source 1..30: mol_type = genomic DNA
aacactgatgactcccgaatttctctctcc

SEQ ID NO: 16541 - DNA, 30 bp, Homo sapiens
  misc_feature 1..30: note = chr19:50353514-50353544
  misc_feature 1..30: note = hypo
  source 1..30: mol_type = genomic DNA
ctctccccagtggaccgtggggcctgtgag

SEQ ID NO: 16542 - DNA, 90 bp, Homo sapiens
  misc_feature 1..90: note = chr19:50364908-50364998
  misc_feature 1..90: note = hypo
  source 1..90: mol_type = genomic DNA
agcagcggcaggggacgcccgcggctcgggcacactggacgtacctgtgggggaaggagctggatgtgcaggccccgcccaccccgccgc

SEQ ID NO: 16543 - DNA, 47 bp, Homo sapiens
  misc_feature 1..47: note = chr19:50938644-50938691
  misc_feature 1..47: note = hypo
  source 1..47: mol_type = genomic DNA
tgctcccagccctcccggggctccctggcacccgcaggcagagccca

SEQ ID NO: 16544 - DNA, 35 bp, Homo sapiens
  misc_feature 1..35: note = chr19:51046474-51046509
  misc_feature 1..35: note = hypo
  source 1..35: mol_type = genomic DNA
tcatgcaggtggcagcgcggcgggggacagatgac

SEQ ID NO: 16545 - DNA, 23 bp, Homo sapiens
  misc_feature 1..23: note = chr19:52512149-52512172
  misc_feature 1..23: note = hypo
  source 1..23: mol_type = genomic DNA
ggttgggaaagaggccgggcgcg

SEQ ID NO: 16546 - DNA, 38 bp, Homo sapiens
  misc_feature 1..38: note = chr19:53028928-53028966
  misc_feature 1..38: note = hypo
  source 1..38: mol_type = genomic DNA
ttatttatttagagacggaatctcttctgtcgcccagg

SEQ ID NO: 16547 - DNA, 30 bp, Homo sapiens
  misc_feature 1..30: note = chr19:54033359-54033389
  misc_feature 1..30: note = hypo
  source 1..30: mol_type = genomic DNA
aagtgggagcaggcacgtcacatggcaaaa

SEQ ID NO: 16548 - DNA, 16 bp, Homo sapiens
  misc_feature 1..16: note = chr19:55727832-55727848
  misc_feature 1..16: note = hypo
  source 1..16: mol_type = genomic DNA
gcgattagatcattga

SEQ ID NO: 16549 - DNA, 151 bp, Homo sapiens
  misc_feature 1..151: note = chr19:58457421-58457572
  misc_feature 1..151: note = hypo
  source 1..151: mol_type = genomic DNA
tcttctcttgggagccgtggccactgccaaactacactgtcttttacataccttgccttcatgaccacttactctatcatcatcctcccagtcttggcccactaacagctttacaaccaaaacctggagcttgccccgcctaactgtgacc

SEQ ID NO: 16550 - DNA, 30 bp, Homo sapiens
  misc_feature 1..30: note = chr19:58891154-58891184
  misc_feature 1..30: note = hypo
  source 1..30: mol_type = genomic DNA
catggaggttgcacacggcacaatgaggtc

SEQ ID NO: 16551 - DNA, 23 bp, Homo sapiens
  misc_feature 1..23: note = chr19:58964230-58964253
  misc_feature 1..23: note = hypo
  source 1..23: mol_type = genomic DNA
gtgggaaagaaattgcgggagcg

SEQ ID NO: 16552 - DNA, 73 bp, Homo sapiens
  misc_feature 1..73: note = chr20:399996-400069
  misc_feature 1..73: note = hypo
  source 1..73: mol_type = genomic DNA
gcttcaaggacctcacgctgcagccgcggggccctctggagccaggccccccaaagcccggggtcccccagga

SEQ ID NO: 16553 - DNA, 411 bp, Homo sapiens; identical to SEQ ID NO: 5234
  misc_feature 1..411: note = chr20:401582-401993
  misc_feature 1..411: note = hypo
  source 1..411: mol_type = genomic DNA

SEQ ID NO: 16554 - DNA, 43 bp, Homo sapiens; identical to SEQ ID NO: 5235
  misc_feature 1..43: note = chr20:799104-799147
  misc_feature 1..43: note = hypo
  source 1..43: mol_type = genomic DNA

SEQ ID NO: 16555 - DNA, 43 bp, Homo sapiens; identical to SEQ ID NO: 5236
  misc_feature 1..43: note = chr20:799687-799730
  misc_feature 1..43: note = hypo
  source 1..43: mol_type = genomic DNA

SEQ ID NO: 16556 - DNA, 41 bp, Homo sapiens
  misc_feature 1..41: note = chr20:1323452-1323493
  misc_feature 1..41: note = hypo
  source 1..41: mol_type = genomic DNA
caggacacccaaacacgtatgcaatgcgtacactggaagtt

SEQ ID NO: 16557 - DNA, 30 bp, Homo sapiens
  misc_feature 1..30: note = chr20:1692274-1692304
  misc_feature 1..30: note = hypo
  source 1..30: mol_type = genomic DNA
aacggcgggaagacccgtgaatgcacttcc

SEQ ID NO: 16558 - DNA, 147 bp, Homo sapiens; identical to SEQ ID NO: 5237
  misc_feature 1..147: note = chr20:2113428-2113575
  misc_feature 1..147: note = hypo
  source 1..147: mol_type = genomic DNA

SEQ ID NO: 16559 - DNA, 30 bp, Homo sapiens
  misc_feature 1..30: note = chr20:2444402-2444432
  misc_feature 1..30: note = hypo
  source 1..30: mol_type = genomic DNA
ggcccgccaaccccacggactggcccagca

SEQ ID NO: 16560 - DNA, 32 bp, Homo sapiens
  misc_feature 1..32: note = chr20:2645508-2645540
  misc_feature 1..32: note = hypo
  source 1..32: mol_type = genomic DNA
aacatagggagacctcgactctacaaaaaatt

SEQ ID NO: 16561 - DNA, 43 bp, Homo sapiens; identical to SEQ ID NO: 1636
  misc_feature 1..43: note = chr20:3027758-3027801
  misc_feature 1..43: note = hypo
  source 1..43: mol_type = genomic DNA

SEQ ID NO: 16562 - DNA, 91 bp, Homo sapiens
  misc_feature 1..91: note = chr20:3202418-3202509
  misc_feature 1..91: note = hypo
  source 1..91: mol_type = genomic DNA
ggccactgccctcctcgtgcttgtcctctggacccagttacacacctgtcccccctttcctgtggcagggccggatcgtggcacccagagg

SEQ ID NO: 16563 - DNA, 92 bp, Homo sapiens
  misc_feature 1..92: note = chr20:3204883-3204975
  misc_feature 1..92: note = hypo
  source 1..92: mol_type = genomic DNA
ctcgaccccactcggcgtgatcgccacagttcagcctgcgggctgcaggcccctcgggaggccctgcttatgccacacgcccttactctgtg

SEQ ID NO: 16564 - DNA, 30 bp, Homo sapiens
  misc_feature 1..30: note = chr20:3763473-3763503
  misc_feature 1..30: note = hypo
  source 1..30: mol_type = genomic DNA
ccagggctcggatttcgggagggaaggtgg

SEQ ID NO: 16565 - DNA, 105 bp, Homo sapiens
  misc_feature 1..105: note = chr20:3820924-3821029
  misc_feature 1..105: note = hypo
  source 1..105: mol_type = genomic DNA
ccactgcactccagtcgctgcactctcgccaaaaacaaaaacaaataaatatgattgagtattaccataggctctggttcctgccctgagggaaggtgagttaaa

SEQ ID NO: 16566 - DNA, 33 bp, Homo sapiens
  misc_feature 1..33: note = chr20:4690739-4690772
  misc_feature 1..33: note = hypo
  source 1..33: mol_type = genomic DNA
agatctaaaactttacgccggatcatgttcctc

SEQ ID NO: 16567 - DNA, 30 bp, Homo sapiens
  misc_feature 1..30: note = chr20:5762556-5762586
  misc_feature 1..30: note = hypo
  source 1..30: mol_type = genomic DNA
tttcaacaaccggcacgactgtacaggtgc

SEQ ID NO: 16568 - DNA, 20 bp, Homo sapiens
  misc_feature 1..20: note = chr20:16554697-16554717
  misc_feature 1..20: note = hypo
  source 1..20: mol_type = genomic DNA
taagggagttaaaggcgaac

SEQ ID NO: 16569 - DNA, 139 bp, Homo sapiens; identical to SEQ ID NO: 5240
  misc_feature 1..139: note = chr20:16555017-16555156
  misc_feature 1..139: note = hypo
  source 1..139: mol_type = genomic DNA

SEQ ID NO: 16570 - DNA, 40 bp, Homo sapiens
  misc_feature 1..40: note = chr20:18233341-18233381
  misc_feature 1..40: note = hypo
  source 1..40: mol_type = genomic DNA
ccaggttttgttttccgagtcttggcgtccccagccaaag

SEQ ID NO: 16571 - DNA, 30 bp, Homo sapiens
  misc_feature 1..30: note = chr20:19674013-19674043
  misc_feature 1..30: note = hypo
  source 1..30: mol_type = genomic DNA
cgtttgcttcctccacgctgtggatcgcag

SEQ ID NO: 16572 - DNA, 120 bp, Homo sapiens
  misc_feature 1..120: note = chr20:24571035-24571155
  misc_feature 1..120: note = hypo
  source 1..120: mol_type = genomic DNA
tgggataagaagcctcgggggtttgagcggaggagaagcccctgtggccacatgctcccgggagccttcagagaacagggcggagggggaggcgcagggcgacgacggcagtggtcaaac

SEQ ID NO: 16573 - DNA, 20 bp, Homo sapiens
  misc_feature 1..20: note = chr20:25230509-25230529
  misc_feature 1..20: note = hypo
  source 1..20: mol_type = genomic DNA
agtcttgccctgtagcgtga

SEQ ID NO: 16574 - DNA, 19 bp, Homo sapiens
  misc_feature 1..19: note = chr20:25230769-25230788
  misc_feature 1..19: note = hypo
  source 1..19: mol_type = genomic DNA
ccaacgcacccgacccgca

SEQ ID NO: 16575 - DNA, 30 bp, Homo sapiens
  misc_feature 1..30: note = chr20:30101713-30101743
  misc_feature 1..30: note = hypo
  source 1..30: mol_type = genomic DNA
aggcgtgagccactgcgcccagcccatttt

SEQ ID NO: 16576 - DNA, 18 bp, Homo sapiens
  misc_feature 1..18: note = chr20:30468303-30468321
  misc_feature 1..18: note = hypo
  source 1..18: mol_type = genomic DNA
tttttttttttgagacgg

SEQ ID NO: 16577 - DNA, 153 bp, Homo sapiens; identical to SEQ ID NO: 5243
  misc_feature 1..153: note = chr20:30864866-30865019
  misc_feature 1..153: note = hypo
  source 1..153: mol_type = genomic DNA

SEQ ID NO: 16578 - DNA, 165 bp, Homo sapiens
  misc_feature 1..165: note = chr20:31115652-31115817
  misc_feature 1..165: note = hypo
  source 1..165: mol_type = genomic DNA
aatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccg

SEQ ID NO: 16579 - DNA, 160 bp, Homo sapiens
  misc_feature 1..160: note = chr20:32242529-32242689
  misc_feature 1..160: note = hypo
  source 1..160: mol_type = genomic DNA
tttacagggaatggacggggtgggagccaggtaaagaagttgctgcagtcttccacgccagagaggacggtggccctgacttgggggctggggcgaggcacaatggtggggatggcaggctacagatgaggtgggctcgtgagatcgacagacaaggcag

SEQ ID NO: 16580 - DNA, 152 bp, Homo sapiens
  misc_feature 1..152: note = chr20:32450366-32450518
  misc_feature 1..152: note = hypo
  source 1..152: mol_type = genomic DNA
cgagccaccgcgcccggctggcttgtgtttatttaaggaatggaagcgttcactcaagccagacttcaggggcaaatgtacattgggaatctccaagggacatctcccaaactacctgaccagggtgtgggttccgccgaatatcttttggg

SEQ ID NO: 16581 - DNA, 30 bp, Homo sapiens
  misc_feature 1..30: note = chr20:32524318-32524348
  misc_feature 1..30: note = hypo
  source 1..30: mol_type = genomic DNA
tgtacagatgagctgcgtgcatttgggaaa

SEQ ID NO: 16582 - DNA, 30 bp, Homo sapiens
  misc_feature 1..30: note = chr20:33134914-33134944
  misc_feature 1..30: note = hypo
  source 1..30: mol_type = genomic DNA
gcagggaaggtgcctcgcaggagaggagag

SEQ ID NO: 16583 - DNA, 30 bp, Homo sapiens
  misc_feature 1..30: note = chr20:33547626-33547656
  misc_feature 1..30: note = hypo
  source 1..30: mol_type = genomic DNA
ctttattgatctggtcgctaagtgtcaggt

SEQ ID NO: 16584 - DNA, 30 bp, Homo sapiens
  misc_feature 1..30: note = chr20:33866905-33866935
  misc_feature 1..30: note = hypo
  source 1..30: mol_type = genomic DNA
ctccctgccagcatccggtacagattgggc

SEQ ID NO: 16585 - DNA, 64 bp, Homo sapiens
  misc_feature 1..64: note = chr20:34148190-34148254
  misc_feature 1..64: note = hypo
  source 1..64: mol_type = genomic DNA
ccgctctcagcaccacggagggcctggggtcggggctctggactcagcccgagggcccacaccc

SEQ ID NO: 16586 - DNA, 67 bp, Homo sapiens
  misc_feature 1..67: note = chr20:35089090-35089157
  misc_feature 1..67: note = hypo
  source 1..67: mol_type = genomic DNA
tgaggagaggggactcgcggggtagaagccaggaactgggaaggcgaggaggcgtgaaggcaccacc

SEQ ID NO: 16587 - DNA, 34 bp, Homo sapiens
  misc_feature 1..34: note = chr20:35924375-35924409
  misc_feature 1..34: note = hypo
  source 1..34: mol_type = genomic DNA
gaactagatgagagccgtacggcgcacagtgtgt

SEQ ID NO: 16588 - DNA, 39 bp, Homo sapiens
  misc_feature 1..39: note = chr20:36151122-36151161
  misc_feature 1..39: note = hypo
  source 1..39: mol_type = genomic DNA
caggtgttgggggagcgcaggcagcgagcccccaactga

SEQ ID NO: 16589 - DNA, 30 bp, Homo sapiens
  misc_feature 1..30: note = chr20:36571234-36571264
  misc_feature 1..30: note = hypo
  source 1..30: mol_type = genomic DNA
gtcaaagtacaaagacgaatataacaaaca

SEQ ID NO: 16590 - DNA, 102 bp, Homo sapiens; identical to SEQ ID NO: 1637
  misc_feature 1..102: note = chr20:42218592-42218694
  misc_feature 1..102: note = hypo
  source 1..102: mol_type = genomic DNA

SEQ ID NO: 16591 - DNA, 128 bp, Homo sapiens
  misc_feature 1..128: note = chr20:43065628-43065756
  misc_feature 1..128: note = hypo
  source 1..128: mol_type = genomic DNA
accagcatcatttgccgtaaataagaggtgactgcaaaattagtgaaaagaaaacaatgtttttcagctgcagccaggtggaatcgccccagggaaagctctgctcttgttttcgtattaaaaaggaa

SEQ ID NO: 16592 - DNA, 24 bp, Homo sapiens
  misc_feature 1..24: note = chr20:43952320-43952344
  misc_feature 1..24: note = hypo
  source 1..24: mol_type = genomic DNA
gagtttcaccgtgttagccaggat

SEQ ID NO: 16593 - DNA, 32 bp, Homo sapiens
  misc_feature 1..32: note = chr20:44601522-44601554
  misc_feature 1..32: note = hypo
  source 1..32: mol_type = genomic DNA
gggcgctgtgagtcacgcctgtaattccaaca

SEQ ID NO: 16594 - DNA, 300 bp, Homo sapiens
  misc_feature 1..300: note = chr20:44601794-44602094
  misc_feature 1..300: note = hypo
  source 1..300: mol_type = genomic DNA
gcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaactcctaagcaggctgggcgcgg

SEQ ID NO: 16595 - DNA, 120 bp, Homo sapiens
  misc_feature 1..120: note = chr20:44602334-44602454
  misc_feature 1..120: note = hypo
  source 1..120: mol_type = genomic DNA
cctggggaacaacagcggaaactcttgtctcaaacaaacaaacaaaaagtcctaaggagaagacctattaataaggagaaaaggtccgggctcggtgggtcacacctgtaataaccagca

SEQ ID NO: 16596 - DNA, 30 bp, Homo sapiens
  misc_feature 1..30: note = chr20:44756572-44756602
  misc_feature 1..30: note = hypo
  source 1..30: mol_type = genomic DNA
gcaaatatttccaaacgttaagaaaatgtt

SEQ ID NO: 16597 - DNA, 217 bp, Homo sapiens
  misc_feature 1..217: note = chr20:45337804-45338021
  misc_feature 1..217: note = hypo
  source 1..217: mol_type = genomic DNA
gtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttct

SEQ ID NO: 16598 - DNA, 95 bp, Homo sapiens
  misc_feature 1..95: note = chr20:46013566-46013661
  misc_feature 1..95: note = hypo
  source 1..95: mol_type = genomic DNA
cagtactaaagctatagtgttgtgatgagagtccggcgtgctccctgaatgccggtgcccgattcataacctagtgcattcgttcacacattatt

SEQ ID NO: 16599 - DNA, 68 bp, Homo sapiens
  misc_feature 1..68: note = chr20:47247201-47247269
  misc_feature 1..68: note = hypo
  source 1..68: mol_type = genomic DNA
gtcctgactcctgagcgccccaccctgcccaagctccctgcagcaggagggcacgtggacatacctgg

SEQ ID NO: 16600 - DNA, 69 bp, Homo sapiens
  misc_feature 1..69: note = chr20:47274233-47274302
  misc_feature 1..69: note = hypo
  source 1..69: mol_type = genomic DNA
ccacccacctgcacacgccccaggcaaagccggaaggccccagggctgaatcctcggccagccacaccc

SEQ ID NO: 16601 - DNA, 80 bp, Homo sapiens
  misc_feature 1..80: note = chr20:47296109-47296189
  misc_feature 1..80: note = hypo
  source 1..80: mol_type = genomic DNA
aggcctgctctgaggcgaacccagggtggaggtgaacgaggccagctgagtcagagtcacaggggcggagggcccctacc

SEQ ID NO: 16602 - DNA, 184 bp, Homo sapiens
  misc_feature 1..184: note = chr20:47428537-47428721
  misc_feature 1..184: note = hypo
  source 1..184: mol_type = genomic DNA
ccccttcctgaaaagcgagatgattggatgagatgatgtctcagtgtcttccagctccaacagccggtttccaggattctagtgctaataatttctttgggctaataaggaccaaagggtcctaaacccaggttttttcagccctcagttactaaattgacaaaagaaccggtagcaatcaaca

SEQ ID NO: 16603 - DNA, 86 bp, Homo sapiens; identical to SEQ ID NO: 5245
  misc_feature 1..86: note = chr20:47905517-47905603
  misc_feature 1..86: note = hypo
  source 1..86: mol_type = genomic DNA

SEQ ID NO: 16604 - DNA, 30 bp, Homo sapiens
  misc_feature 1..30: note = chr20:48477511-48477541
  misc_feature 1..30: note = hypo
  source 1..30: mol_type = genomic DNA
aaatgggcaggcctgcgtgaagggatcagg

SEQ ID NO: 16605 - DNA, 16 bp, Homo sapiens
  misc_feature 1..16: note = chr20:48720810-48720826
  misc_feature 1..16: note = hypo
  source 1..16: mol_type = genomic DNA
ccgtctcaaaaaaaaa

SEQ ID NO: 16606 - DNA, 30 bp, Homo sapiens
  misc_feature 1..30: note = chr20:48771341-48771371
  misc_feature 1..30: note = hypo
  source 1..30: mol_type = genomic DNA
ttccatacaggcagccgggcgcggtggctc

SEQ ID NO: 16607 - DNA, 30 bp, Homo sapiens
  misc_feature 1..30: note = chr20:48863456-48863486
  misc_feature 1..30: note = hypo
  source 1..30: mol_type = genomic DNA
agggggacctgtgggcggcctctgcctctc

SEQ ID NO: 16608 - DNA, 131 bp, Homo sapiens
  misc_feature 1..131: note = chr20:49047031-49047162
  misc_feature 1..131: note = hypo
  source 1..131: mol_type = genomic DNA
ctacagcgcacaacacggcccttgccagaaagaatcaacagggctgtgggcgaggagccctggtctcacgagaggttgcccacccctcacctggtgccccaggaggtgggaggcttcgcgggctccaggtc

SEQ ID NO: 16609 - DNA, 33 bp, Homo sapiens
  misc_feature 1..33: note = chr20:49200517-49200550
  misc_feature 1..33: note = hypo
  source 1..33: mol_type = genomic DNA
ctttaggcagcctgccgccgtctctgtcccggt

SEQ ID NO: 16610 - DNA, 249 bp, Homo sapiens
  misc_feature 1..249: note = chr20:49204179-49204428
  misc_feature 1..249: note = hypo
  source 1..249: mol_type = genomic DNA
acaaagggtggaggtcggctctgtgccagggctgctaacggtgcccatcccaggtgccccagagttgttctgcctgctgggagagctgggtgtggcctctcgcagattctaagggccccaggcaccccgctgcgctgcacagtttgtgccactttttaccgaacgacagtgtggtttcccgggctgccgcccgcacggcctccaggtcagactggcacaggctggcagtctggtcgatgctttcaatgc

SEQ ID NO: 16611 - DNA, 60 bp, Homo sapiens
  misc_feature 1..60: note = chr20:49218718-49218778
  misc_feature 1..60: note = hypo
  source 1..60: mol_type = genomic DNA
gggccacgccaggcccgtcctctctgtccccggttgccccttcctcgtggccgttctggc

SEQ ID NO: 16612 - DNA, 343 bp, Homo sapiens; identical to SEQ ID NO: 1638
  misc_feature 1..343: note = chr20:49261761-49262104
  misc_feature 1..343: note = hypo
  source 1..343: mol_type = genomic DNA

SEQ ID NO: 16613 - DNA, 68 bp, Homo sapiens; identical to SEQ ID NO: 5247
  misc_feature 1..68: note = chr20:49286826-49286894
  misc_feature 1..68: note = hypo
  source 1..68: mol_type = genomic DNA

SEQ ID NO: 16614 - DNA, 30 bp, Homo sapiens
  misc_feature 1..30: note = chr20:49345697-49345727
  misc_feature 1..30: note = hypo
  source 1..30: mol_type = genomic DNA
ggaatgcagggcccacgcaggtgcactggc

SEQ ID NO: 16615 - DNA, 212 bp, Homo sapiens; identical to SEQ ID NO: 1639
  misc_feature 1..212: note = chr20:49346547-49346759
  misc_feature 1..212: note = hypo
  source 1..212: mol_type = genomic DNA

SEQ ID NO: 16616 - DNA, 26 bp, Homo sapiens
  misc_feature 1..26: note = chr20:49350870-49350896
  misc_feature 1..26: note = hypo
  source 1..26: mol_type = genomic DNA
aactaggtagtgtgccggtccttttt

SEQ ID NO: 16617 - DNA, 24 bp, Homo sapiens
  misc_feature 1..24: note = chr20:49358372-49358396
  misc_feature 1..24: note = hypo
  source 1..24: mol_type = genomic DNA
gcgcccggccgcactctgtctttt

SEQ ID NO: 16618 - DNA, 139 bp, Homo sapiens; identical to SEQ ID NO: 5250
  misc_feature 1..139: note = chr20:49377921-49378060
  misc_feature 1..139: note = hypo
  source 1..139: mol_type = genomic DNA

SEQ ID NO: 16619 - DNA, 30 bp, Homo sapiens
  misc_feature 1..30: note = chr20:49380822-49380852
  misc_feature 1..30: note = hypo
  source 1..30: mol_type = genomic DNA
ttgacattcctcagtcgtagtgccacagtg

SEQ ID NO: 16620 - DNA, 36 bp, Homo sapiens
  misc_feature 1..36: note = chr20:52693155-52693191
  misc_feature 1..36: note = hypo
  source 1..36: mol_type = genomic DNA
tttttttttttgagacggagtcttgctctgtcacca

SEQ ID NO: 16621 - DNA, 18 bp, Homo sapiens
  misc_feature 1..18: note = chr20:53052060-53052078
  misc_feature 1..18: note = hypo
  source 1..18: mol_type = genomic DNA
aatagctgttaaggccgg

SEQ ID NO: 16622 - DNA, 30 bp, Homo sapiens
  misc_feature 1..30: note = chr20:55693399-55693429
  misc_feature 1..30: note = hypo
  source 1..30: mol_type = genomic DNA
tcaccccactacacccgcagcactgcccgc

SEQ ID NO: 16623 - DNA, 26 bp, Homo sapiens
  misc_feature 1..26: note = chr20:55693632-55693658
  misc_feature 1..26: note = hypo
  source 1..26: mol_type = genomic DNA
tctcagggccgggcgcggtggctcac

SEQ ID NO: 16624 - DNA, 30 bp, Homo sapiens
  misc_feature 1..30: note = chr20:55925381-55925411
  misc_feature 1..30: note = hypo
  source 1..30: mol_type = genomic DNA
agtaagagtagttcacgtatgatttcactt

SEQ ID NO: 16625 - DNA, 222 bp, Homo sapiens
  misc_feature 1..222: note = chr20:55958990-55959212
  misc_feature 1..222: note = hypo
  source 1..222: mol_type = genomic DNA
gcttaaaatgtaaatcggctcccgaaaaagaactgacctgcattcttaatcttttattctttttccctcctgactgtggtgcagaggaggcagtatgggaggagacaaagctcaaagaaggcactgacaatccccagcatcctacgggcccgaatccacactgcggattccgtcagctcactggcggcagcactctctggtgtctttttttttttttttttt

SEQ ID NO: 16626 - DNA, 84 bp, Homo sapiens
  misc_feature 1..84: note = chr20:56766160-56766244
  misc_feature 1..84: note = hypo
  source 1..84: mol_type = genomic DNA
cccccaacacatgcacgtgccaagaaccagtctggtcagttagaatcctccatcctggccgggcgcggtggctcacgcctgtaa

SEQ ID NO: 16627 - DNA, 30 bp, Homo sapiens
  misc_feature 1..30: note = chr20:57198958-57198988
  misc_feature 1..30: note = hypo
  source 1..30: mol_type = genomic DNA
gggtgtgtgccctcccgtgccctctgcctg

SEQ ID NO: 16628 - DNA, 30 bp, Homo sapiens
  misc_feature 1..30: note = chr20:57699792-57699822
  misc_feature 1..30: note = hypo
  source 1..30: mol_type = genomic DNA
aggggctggccccttcgagaggctcagtgt

SEQ ID NO: 16629 - DNA, 97 bp, Homo sapiens
  misc_feature 1..97: note = chr20:58507740-58507837
  misc_feature 1..97: note = hypo
  source 1..97: mol_type = genomic DNA
aacaaaaaaaaaccacgctgccgtattcgcagatgctcggccagcctggagcccggtccagaaaaggccgcacgtggagccacgtgtcgcgcattga

SEQ ID NO: 16630 - DNA, 236 bp, Homo sapiens
  misc_feature 1..236: note = chr20:58514132-58514368
  misc_feature 1..236: note = hypo
  source 1..236: mol_type = genomic DNA
tgcagcgcgtggttgcgacatgtgaggctgtagtctcggtggtcgttgttgtcccagtactcggcacccgccacttggtagcgcaccgcgaagtgcacgcgggagccgagctccagcaggaagggcggtactggaaagccgaaggtgaaaacgtcctccgtgccctcggggcctgcgggcccgcgccaccgcgccaccgcctcgtgggtactgcgccagcccgagaaagtgtagcg

SEQ ID NO: 16631 - DNA, 21 bp, Homo sapiens
  misc_feature 1..21: note = chr20:59185811-59185832
  misc_feature 1..21: note = hypo
  source 1..21: mol_type = genomic DNA
cacgcccggccgagtaaaagt

SEQ ID NO: 16632 - DNA, 30 bp, Homo sapiens
  misc_feature 1..30: note = chr20:59910323-59910353
  misc_feature 1..30: note = hypo
  source 1..30: mol_type = genomic DNA
tggtccaacggagatcgaaggtcattatat

SEQ ID NO: 16633 - DNA, 35 bp, Homo sapiens
  misc_feature 1..35: note = chr20:60120848-60120883
  misc_feature 1..35: note = hypo
  source 1..35: mol_type = genomic DNA
ggggtatgtgggatacggtgcgtgttcacatgtgt

SEQ ID NO: 16634 - DNA, 30 bp, Homo sapiens
  misc_feature 1..30: note = chr20:60202364-60202394
  misc_feature 1..30: note = hypo
  source 1..30: mol_type = genomic DNA
tgccagcctgcctgccggcttcaggcccgt

SEQ ID NO: 16635 - DNA, 30 bp, Homo sapiens
  misc_feature 1..30: note = chr20:60202615-60202645
  misc_feature 1..30: note = hypo
  source 1..30: mol_type = genomic DNA
gagagctctttgtgtcgaccatgactgctt

SEQ ID NO: 16636 - DNA, 120 bp, Homo sapiens
  misc_feature 1..120: note = chr20:60238291-60238411
  misc_feature 1..120: note = hypo
  source 1..120: mol_type = genomic DNA
cagaggagctttcatcgagggcttggcgcccacgacaaatgagtccacgcaggaaaggagtggcacccgcaggaggcctgtgctgcggagctcctgggagggtgacgctggggcaggggc

SEQ ID NO: 16637 - DNA, 103 bp, Homo sapiens
  misc_feature 1..103: note = chr20:60238877-60238980
  misc_feature 1..103: note = hypo
  source 1..103: mol_type = genomic DNA
caccagtcactcccacgctgggtcttccagctccctcgaggccgccctggccctccacactcccaccgctggcgccagcatctgtgcccgcggcagtttagag

SEQ ID NO: 16638 - DNA, 30 bp, Homo sapiens
  misc_feature 1..30: note = chr20:60281435-60281465
  misc_feature 1..30: note = hypo
  source 1..30: mol_type = genomic DNA
acagaaaactgcagccggcctcatttgccg

SEQ ID NO: 16639 - DNA, 19 bp, Homo sapiens
  misc_feature 1..19: note = chr20:60329650-60329669
  misc_feature 1..19: note = hypo
  source 1..19: mol_type = genomic DNA
ggaacaccacacacacggt

SEQ ID NO: 16640 - DNA, 30 bp, Homo sapiens
  misc_feature 1..30: note = chr20:60375036-60375066
  misc_feature 1..30: note = hypo
  source 1..30: mol_type = genomic DNA
tcccttcccatgacccgctcggctgcagcg

SEQ ID NO: 16641 - DNA, 150 bp, Homo sapiens
  misc_feature 1..150: note = chr20:60385207-60385357
  misc_feature 1..150: note = hypo
  source 1..150: mol_type = genomic DNA
gacctgttctcaagacggagacagagatgggtgagggaggccgggccagccacactaacatcccactggcagaccccgggaaaggccatggccacccacatggatgtgtgggtatggccacatgtggctatccaccgggccagtcggggc

SEQ ID NO: 16642 - DNA, 30 bp, Homo sapiens
  misc_feature 1..30: note = chr20:60428191-60428221
  misc_feature 1..30: note = hypo
  source 1..30: mol_type = genomic DNA
gctgggaagaaaacccgggcactgggagtc

SEQ ID NO: 16643 - DNA, 30 bp, Homo sapiens
  misc_feature 1..30: note = chr20:60448710-60448740
  misc_feature 1..30: note = hypo
  source 1..30: mol_type = genomic DNA
ctgcccaggtgtgtgcgggggtggcagcct

SEQ ID NO: 16644 - DNA, 157 bp, Homo sapiens; identical to SEQ ID NO: 5251
  misc_feature 1..157: note = chr20:60477380-60477537
  misc_feature 1..157: note = hypo
  source 1..157: mol_type = genomic DNA

SEQ ID NO: 16645 - DNA, 30 bp, Homo sapiens
  misc_feature 1..30: note = chr20:60502281-60502311
  misc_feature 1..30: note = hypo
  source 1..30: mol_type = genomic DNA
acagtcagaacatgccgccaccaccgccgc

SEQ ID NO: 16646 - DNA, 212 bp, Homo sapiens
  misc_feature 1..212: note = chr20:60502848-60503060
  misc_feature 1..212: note = hypo
  source 1..212: mol_type = genomic DNA
gtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatggcgtgtggcagggtgtcggtcaggagccatg

SEQ ID NO: 16647 - DNA, 240 bp, Homo sapiens
  misc_feature 1..240: note = chr20:60773311-60773551
  misc_feature 1..240: note = hypo
  source 1..240: mol_type = genomic DNA
tctgaccccatgagccgacctctgactgagggaggccactggcacccagcgggcctgcgtctccttcgcgagctgaattcactcgtctcttagatgttttttctggtgcttcagttcacactaacgttttagaaacactatttgaaaaagccctttgtgcagtcagaagggtgtgtacgcagccccgtgaaagccctggagcactgggaccttttccttgtgctccggagctgttggcag

SEQ ID NO: 16648 - DNA, 155 bp, Homo sapiens
  misc_feature 1..155: note = chr20:60781351-60781506
  misc_feature 1..155: note = hypo
  source 1..155: mol_type = genomic DNA
tcatcagtgaacacacgtgccggggacctgtcctggtgccgctaaagaggctgcagagccgcggggtgcggcagtgcttggcgggggcggggtgcagctctgcgtgcatggcgtccacctggggaccgcaggtgtcaagccggggagagccagtg

SEQ ID NO: 16649 - DNA, 35 bp, Homo sapiens
  misc_feature 1..35: note = chr20:60790112-60790147
  misc_feature 1..35: note = hypo
  source 1..35: mol_type = genomic DNA
gtgcacagcacatggcgaagcggcccctgcccggg

SEQ ID NO: 16650 - DNA, 40 bp, Homo sapiens
  misc_feature 1..40: note = chr20:60925501-60925541
  misc_feature 1..40: note = hypo
  source 1..40: mol_type = genomic DNA
gctcccgcctctgctcggcactggccgtgagaatgggagt

SEQ ID NO: 16651 - DNA, 70 bp, Homo sapiens
  misc_feature 1..70: note = chr20:60925868-60925938
  misc_feature 1..70: note = hypo
  source 1..70: mol_type = genomic DNA
aggtgctcctgaggccgggctggggtcccaccctgtgttcccattcccaggaaaacggcccagcgtgtgt

SEQ ID NO: 16652 - DNA, 96 bp, Homo sapiens
  misc_feature 1..96: note = chr20:60953312-60953408
  misc_feature 1..96: note = hypo
  source 1..96: mol_type = genomic DNA
caagacaagcctgggcgactcacctggggcaggaatgtggattccatcactccgcagaggctttcaagcaaaacacagcctcgtctctgggcctgt

SEQ ID NO: 16653 - DNA, 50 bp, Homo sapiens
  misc_feature 1..50: note = chr20:60970933-60970983
  misc_feature 1..50: note = hypo
  source 1..50: mol_type = genomic DNA
ctctcagggtgcagccggtgccagctgcggccctccgccagctttgggca

SEQ ID NO: 16654 - DNA, 85 bp, Homo sapiens
  misc_feature 1..85: note = chr20:60983881-60983966
  misc_feature 1..85: note = hypo
  source 1..85: mol_type = genomic DNA
gggtggagggcaggacgcaggaggcaggaggcagctgtccgtgctggctgcagcgccgggtcctggggatcggctgtgcagtagg

SEQ ID NO: 16655 - DNA, 30 bp, Homo sapiens
  misc_feature 1..30: note = chr20:60984485-60984515
  misc_feature 1..30: note = hypo
  source 1..30: mol_type = genomic DNA
tgagcaggtgtcaagcgcagggctctgtct

SEQ ID NO: 16656 - DNA, 471 bp, Homo sapiens
  misc_feature 1..471: note = chr20:61288063-61288534
  misc_feature 1..471: note = hypo
  source 1..471: mol_type = genomic DNA
cggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacc

SEQ ID NO: 16657 - DNA, 30 bp, Homo sapiens
  misc_feature 1..30: note = chr20:61294663-61294693
  misc_feature 1..30: note = hypo
  source 1..30: mol_type = genomic DNA
aggcattcagagttgcgttcatcggaacca

SEQ ID NO: 16658 - DNA, 30 bp, Homo sapiens
  misc_feature 1..30: note = chr20:61312730-61312760
  misc_feature 1..30: note = hypo
  source 1..30: mol_type = genomic DNA
gcgtgtgtattaagccgtgtcacttgtgtg

SEQ ID NO: 16659 - DNA, 52 bp, Homo sapiens
  misc_feature 1..52: note = chr20:61393835-61393887
  misc_feature 1..52: note = hypo
  source 1..52: mol_type = genomic DNA
tatctgtgcacttaccgtaggtagggacacgtgtccacgcaccacagacaca

SEQ ID NO: 16660 - DNA, 463 bp, Homo sapiens; identical to SEQ ID NO: 5252
  misc_feature 1..463: note = chr20:61505867-61506330
  misc_feature 1..463: note = hypo
  source 1..463: mol_type = genomic DNA

SEQ ID NO: 16661 - DNA, 109 bp, Homo sapiens
  misc_feature 1..109: note = chr20:61570765-61570874
  misc_feature 1..109: note = hypo
  source 1..109: mol_type = genomic DNA
cagcaccgccccccccgccccttatttcactaattcatgttttcagctctgagctcaggatctgtaattcagacacctgcttgatttctccagacgcatgtctaatagt

SEQ ID NO: 16662 - DNA, 30 bp, Homo sapiens
  misc_feature 1..30: note = chr20:61695664-61695694
  misc_feature 1..30: note = hypo
  source 1..30: mol_type = genomic DNA
ggtcctgcaagagaacgggctccatttgcg

SEQ ID NO: 16663 - DNA, 136 bp, Homo sapiens
  misc_feature 1..136: note = chr20:61725275-61725411
  misc_feature 1..136: note = hypo
  source 1..136: mol_type = genomic DNA
aaaaaatgtaaacatcgcaagctgcacccaggtgtgaatctggagggcgcctccttggaaaacttggctggtgaccgcaccctcagttcaagctcaccggccgcccttccctgtgcacacacgtgagctctccagt

SEQ ID NO: 16664 - DNA, 30 bp, Homo sapiens
  misc_feature 1..30: note = chr20:61763598-61763628
  misc_feature 1..30: note = hypo
  source 1..30: mol_type = genomic DNA
catgaagcttcccaccgggtaggcactcac

SEQ ID NO: 16665 - DNA, 30 bp, Homo sapiens
  misc_feature 1..30: note = chr20:61838532-61838562
  misc_feature 1..30: note = hypo
  source 1..30: mol_type = genomic DNA
cattaaccccgggcacggtgactcatgcct

SEQ ID NO: 16666 - DNA, 466 bp, Homo sapiens
  misc_feature 1..466: note = chr20:61973894-61974360
  misc_feature 1..466: note = hypo
  source 1..466: mol_type = genomic DNA
agcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcaggggattcctgggtgccggctctatgcgaatattcttcagtctgtgaaagaaaatgccttgtcatgccgctgaggattcatacgcacgctgtgtaccttaccccgcgaggcaggcaaatgccaagaaatgccagctcggattagcgcagcgggagcgcctgtctgcagac

SEQ ID NO: 16667 - DNA, 115 bp, Homo sapiens
  misc_feature 1..115: note = chr20:61980815-61980930
  misc_feature 1..115: note = hypo
  source 1..115: mol_type = genomic DNA
tcagcctgggacctgcggccacatagcaggcttgggaagaggctgctgcagcaggggccacgccctgcaccccaaagcgaagcagcctgaggcctgggcccggctcctggattac

SEQ ID NO: 16668 - DNA, 30 bp, Homo sapiens
  misc_feature 1..30: note = chr20:61982304-61982334
  misc_feature 1..30: note = hypo
  source 1..30: mol_type = genomic DNA
ggagtccactgcacccgcccgtcatggaac

SEQ ID NO: 16669 - DNA, 35 bp, Homo sapiens
  misc_feature 1..35: note = chr20:61990913-61990948
  misc_feature 1..35: note = hypo
  source 1..35: mol_type = genomic DNA
gagcgatggacaggccgaagcggacgaggaccacg

SEQ ID NO: 16670 - DNA, 30 bp, Homo sapiens
  misc_feature 1..30: note = chr20:62011933-62011963
  misc_feature 1..30: note = hypo
  source 1..30: mol_type = genomic DNA
agctgtcctccctgccgcagccggcatgcc

SEQ ID NO: 16671 - DNA, 66 bp, Homo sapiens; identical to SEQ ID NO: 5253
  misc_feature 1..66: note = chr20:62031666-62031732
  misc_feature 1..66: note = hypo
  source 1..66: mol_type = genomic DNA

SEQ ID NO: 16672 - DNA, 112 bp, Homo sapiens
  misc_feature 1..112: note = chr20:62031976-62032088
  misc_feature 1..112: note = hypo
  source 1..112: mol_type = genomic DNA
agccagaggcaacggcgcaaatggggaagctgcagccaccgtcacggccagaggatggcagactgcaatggcgtggggcgcgggcatggcgggcacacgtgggccgtgtgga

SEQ ID NO: 16673 - DNA, 53 bp, Homo sapiens
  misc_feature 1..53: note = chr20:62033547-62033600
  misc_feature 1..53: note = hypo
  source 1..53: mol_type = genomic DNA
agcaggtccaagcctcgtgagccgtccctctcacgccacgtctgccgggcacc

SEQ ID NO: 16674 - DNA, 30 bp, Homo sapiens
  misc_feature 1..30: note = chr20:62038095-62038125
  misc_feature 1..30: note = hypo
  source 1..30: mol_type = genomic DNA
gtctgactctccctccgcaatgtagggcct

SEQ ID NO: 16675 - DNA, 41 bp, Homo sapiens
  misc_feature 1..41: note = chr20:62038570-62038611
  misc_feature 1..41: note = hypo
  source 1..41: mol_type = genomic DNA
ctgtcgacatgctcccggctgtcttccgggctgtggtacgg

SEQ ID NO: 16676 - DNA, 309 bp, Homo sapiens; identical to SEQ ID NO: 1641
  misc_feature 1..309: note = chr20:62046201-62046510
  misc_feature 1..309: note = hypo
  source 1..309: mol_type = genomic DNA

SEQ ID NO: 16677 - DNA, 113 bp, Homo sapiens
  misc_feature 1..113: note = chr20:62053226-62053339
  misc_feature 1..113: note = hypo
  source 1..113: mol_type = genomic DNA
cccacccgaccccaacgtagacgcttcctctgactccagcacagccccagtggtccctacgggaaccgagcccccgccagccgggtcgcctgccaccacgtgcctgtgttctg

SEQ ID NO: 16678 - DNA, 38 bp, Homo sapiens
  misc_feature 1..38: note = chr20:62054264-62054302
  misc_feature 1..38: note = hypo
  source 1..38: mol_type = genomic DNA
cacctgggacagcaccgaggttccgcccaaatcacagc

SEQ ID NO: 16679 - DNA, 30 bp, Homo sapiens
  misc_feature 1..30: note = chr20:62058730-62058760
  misc_feature 1..30: note = hypo
  source 1..30: mol_type = genomic DNA
acccgcgcttgtaggcgtttgccacagccg

SEQ ID NO: 16680 - DNA, 136 bp, Homo sapiens
  misc_feature 1..136: note = chr20:62090500-62090636
  misc_feature 1..136: note = hypo
  source 1..136: mol_type = genomic DNA
acctgagggcaggctcggcaaggaaagccaggcacaaaacggcaccacgatgacaactccacttacacgaaacatccgaagcaaacaggccaggcccggcggccacgcctgtactcccagagcttggcgaggccga

SEQ ID NO: 16681 - DNA, 39 bp, Homo sapiens
  misc_feature 1..39: note = chr20:62097848-62097887
  misc_feature 1..39: note = hypo
  source 1..39: mol_type = genomic DNA
ccctcctggcctccacgctccgtccggggtgaggccttc

SEQ ID NO: 16682 - DNA, 86 bp, Homo sapiens; identical to SEQ ID NO: 1642
  misc_feature 1..86: note = chr20:62115180-62115266
  misc_feature 1..86: note = hypo
  source 1..86: mol_type = genomic DNA

SEQ ID NO: 16683 - DNA, 348 bp, Homo sapiens; identical to SEQ ID NO: 5256
  misc_feature 1..348: note = chr20:62126081-62126429
  misc_feature 1..348: note = hypo
  source 1..348: mol_type = genomic DNA

SEQ ID NO: 16684 - DNA, 40 bp, Homo sapiens
  misc_feature 1..40: note = chr20:62153405-62153445
  misc_feature 1..40: note = hypo
  source 1..40: mol_type = genomic DNA
aaccagtgagagccccgctctctaccgcccggccccagca

SEQ ID NO: 16685 - DNA, 237 bp, Homo sapiens
  misc_feature 1..237: note = chr20:62165598-62165835
  misc_feature 1..237: note = hypo
  source 1..237: mol_type = genomic DNA
tcgttcaggtgcagccggcccccggcacgccgccagatcttgtagtgccgcacagcctgcgtgtcccgcactgggagggagagcgtgagctgtgtggccaccccaactccgacgcctccctgcgtccccagccctgctggccacacctgcgcagagtttctgggtccccacagttgctgttggtgcttcctcagtaccacccctgcctcccctccctcagaacggctccctcctgcc

SEQ ID NO: 16686 - DNA, 30 bp, Homo sapiens
  misc_feature 1..30: note = chr20:62167765-62167795
  misc_feature 1..30: note = hypo
  source 1..30: mol_type = genomic DNA
gttgcttgggtcccccgggagctaacccta

SEQ ID NO: 16687 - DNA, 30 bp, Homo sapiens
  misc_feature 1..30: note = chr20:62168240-62168270
  misc_feature 1..30: note = hypo
  source 1..30: mol_type = genomic DNA
ctgggcactcctgggcgccagcgcatgggg

SEQ ID NO: 16688 - DNA, 30 bp, Homo sapiens
  misc_feature 1..30: note = chr20:62170163-62170193
  misc_feature 1..30: note = hypo
  source 1..30: mol_type = genomic DNA
atgtccaggaagcctcgagtatccctgagt

SEQ ID NO: 16689 - DNA, 336 bp, Homo sapiens
  misc_feature 1..336: note = chr20:62172667-62173003
  misc_feature 1..336: note = hypo
  source 1..336: mol_type = genomic DNA
cttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggcggcagacgcagggcccggccctcgggggctgcaggagacagcgcggggtcttttaggg

SEQ ID NO: 16690 - DNA, 32 bp, Homo sapiens
  misc_feature 1..32: note = chr20:62221371-62221403
  misc_feature 1..32: note = hypo
  source 1..32: mol_type = genomic DNA
cccgctccctgctgccgcggctgagagacagc

SEQ ID NO: 16691 - DNA, 470 bp, Homo sapiens
  misc_feature 1..470: note = chr20:62320923-62321393
  misc_feature 1..470: note = hypo
  source 1..470: mol_type = genomic DNA
ccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaaccc

SEQ ID NO: 16692 - DNA, 30 bp, Homo sapiens
  misc_feature 1..30: note = chr20:62321804-62321834
  misc_feature 1..30: note = hypo
  source 1..30: mol_type = genomic DNA
gcagcgctgggtgggcggtgtgggggtggc

SEQ ID NO: 16693 - DNA, 30 bp, Homo sapiens
  misc_feature 1..30: note = chr20:62329526-62329556
  misc_feature 1..30: note = hypo
  source 1..30: mol_type = genomic DNA
ctcctgcaaaccccccgagtggggcccaga

SEQ ID NO: 16694 - DNA, 247 bp, Homo sapiens; identical to SEQ ID NO: 5257
  misc_feature 1..247: note = chr20:62383189-62383436
  misc_feature 1..247: note = hypo
  source 1..247: mol_type = genomic DNA

SEQ ID NO: 16695 - DNA, 30 bp, Homo sapiens
  misc_feature 1..30: note = chr20:62384067-62384097
  misc_feature 1..30: note = hypo
  source 1..30: mol_type = genomic DNA
gcgtgaacttcttcccgcagatctcgcagg

SEQ ID NO: 16696 - DNA, 71 bp, Homo sapiens
  misc_feature 1..71: note = chr20:62400829-62400900
  misc_feature 1..71: note = hypo
  source 1..71: mol_type = genomic DNA
catgcggtgtgagcccggtgatgccccaagggtctcgctggaggcaggtgtttgaacgctttgatcagctg

SEQ ID NO: 16697 - DNA, 35 bp, Homo sapiens
  misc_feature 1..35: note = chr20:62481615-62481650
  misc_feature 1..35: note = hypo
  source 1..35: mol_type = genomic DNA
cgggatgctgagtcacgctacgtctcctttcctga

SEQ ID NO: 16698 - DNA, 206 bp, Homo sapiens
  misc_feature 1..206: note = chr20:62488224-62488430
  misc_feature 1..206: note = hypo
  source 1..206: mol_type = genomic DNA
aaaaaaagaaaagaaaagaagaaaagaaaagcccctagaggccagggtccttgaacaaaagtgcgcgatgccctgtgtctgcagcggggagaggtctggagcccgtgtgtccgacagcagaagtggacacagtggtgccagggcaggaaccctgggggcatttgcaggcctgtgctgcgagactgcagtggcgctcaggacacacc

SEQ ID NO: 16699 - DNA, 144 bp, Homo sapiens
  misc_feature 1..144: note = chr20:62722776-62722920
  misc_feature 1..144: note = hypo
  source 1..144: mol_type = genomic DNA
acacctctgaggcttcgtgctctcagcagtggccgggtatggtgggggtgactgagctccaggagcacacagcaggtgctgggccagtgccgtgtcctggacccaagcatcttacccgcttgtttacgacgaagctttgatctg

SEQ ID NO: 16700 - DNA, 36 bp, Homo sapiens
  misc_feature 1..36: note = chr20:62762699-62762735
  misc_feature 1..36: note = hypo
  source 1..36: mol_type = genomic DNA
actggagtatctagtcgtgtgcgtgtgtgagtagag

SEQ ID NO: 16701 - DNA, 79 bp, Homo sapiens
  misc_feature 1..79: note = chr21:15694241-15694320
  misc_feature 1..79: note = hypo
  source 1..79: mol_type = genomic DNA
gccaccacgcccagcctaggctaattcttacacaagctaattatactgatgatagcttgtatgtcgtggatagtaacga

SEQ ID NO: 16702 - DNA, 30 bp, Homo sapiens
  misc_feature 1..30: note = chr21:20360095-20360125
  misc_feature 1..30: note = hypo
  source 1..30: mol_type = genomic DNA
gtttactccggttcccgcacttgtttgcta

SEQ ID NO: 16703 - DNA, 71 bp, Homo sapiens
  misc_feature 1..71: note = chr21:33983236-33983307
  misc_feature 1..71: note = hypo
  source 1..71: mol_type = genomic DNA
caggaagtatcatcccgtcaagttcaaaaactatgctgtctaatgcggcagctactcgctccacttggcga

SEQ ID NO: 16704 - DNA, 95 bp, Homo sapiens
  misc_feature 1..95: note = chr21:34459377-34459472
  misc_feature 1..95: note = hypo
  source 1..95: mol_type = genomic DNA
tgtgtatcttcttaacgtcattgaattgcacgcttaaacaatggttaagacagtaagctttacttatgaatattttaccgcagcaaaatataatt

SEQ ID NO: 16705 - DNA, 30 bp, Homo sapiens
  misc_feature 1..30: note = chr21:37750050-37750080
  misc_feature 1..30: note = hypo
  source 1..30: mol_type = genomic DNA
gcctgtgatctcagacgcttgattcttgct

SEQ ID NO: 16706 - DNA, 108 bp, Homo sapiens
  misc_feature 1..108: note = chr21:37758492-37758600
  misc_feature 1..108: note = hypo
  source 1..108: mol_type = genomic DNA
acttccagcatgggacggctgggaggatccacagactggcgtctgccggcgtggacaccaatgtcagggtaaactggggcagagatagacatccgggaacactgcttg

SEQ ID NO: 16707 - DNA, 50 bp, Homo sapiens
  misc_feature 1..50: note = chr21:37775108-37775158
  misc_feature 1..50: note = hypo
  source 1..50: mol_type = genomic DNA
actgagtttcactcccgacggatctttgcttctcacgccaggtgtgtttc

SEQ ID NO: 16708 - DNA, 42 bp, Homo sapiens
  misc_feature 1..42: note = chr21:38092179-38092221
  misc_feature 1..42: note = hypo
  source 1..42: mol_type = genomic DNA
tgaccgctgtcctcacggcccaccagccgctgcaccaccacc

SEQ ID NO: 16709 - DNA, 63 bp, Homo sapiens
  misc_feature 1..63: note = chr21:38935380-38935443
  misc_feature 1..63: note = hypo
  source 1..63: mol_type = genomic DNA
ggagaccatttttcacgcctggccggctctgtgcttaagtggccccatcgcagccagagtagc

SEQ ID NO: 16710 - DNA, 30 bp, Homo sapiens
  misc_feature 1..30: note = chr21:42613756-42613786
  misc_feature 1..30: note = hypo
  source 1..30: mol_type = genomic DNA
tctggagaccttcttcgactccctggtgac

SEQ ID NO: 16711 - DNA, 195 bp, Homo sapiens
  misc_feature 1..195: note = chr21:43248726-43248921
  misc_feature 1..195: note = hypo
  source 1..195: mol_type = genomic DNA
gtaaataacatctcacgcaggcacgcacgtgtggcctgaacgtcaataaagcgcgggtgacgggcatgagagtcacggggatgcgtggccaggaagaaaacagcacctgtgtgtcatacactgtctaccccaggaactcacgatgcagagacgggaaccccggtgcttgaaaagcagacacggagctcacctttc

SEQ ID NO: 16712 - DNA, 183 bp, Homo sapiens
  misc_feature 1..183: note = chr21:43786558-43786741
  misc_feature 1..183: note = hypo
  source 1..183: mol_type = genomic DNA
acaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgag

SEQ ID NO: 16713 - DNA, 30 bp, Homo sapiens
  misc_feature 1..30: note = chr21:44338342-44338372
  misc_feature 1..30: note = hypo
  source 1..30: mol_type = genomic DNA
ttttcacctacggcgcgatgggttttatca

SEQ ID NO: 16714 - DNA, 49 bp, Homo sapiens
  misc_feature 1..49: note = chr21:44837100-44837149
  misc_feature 1..49: note = hypo
  source 1..49: mol_type = genomic DNA
tgccgagggcaggtgcgtggctgatccctgaccgcgccccacctttcat

SEQ ID NO: 16715 - DNA, 300 bp, Homo sapiens; identical to SEQ ID NO: 5258
  misc_feature 1..300: note = chr21:44866603-44866903
  misc_feature 1..300: note = hypo
  source 1..300: mol_type = genomic DNA

SEQ ID NO: 16716 - DNA, 57 bp, Homo sapiens
  misc_feature 1..57: note = chr21:45170351-45170408
  misc_feature 1..57: note = hypo
  source 1..57: mol_type = genomic DNA
ccacccgcctgtccccgcctgtcttccaggttactgagtggccggaagatccacagc

SEQ ID NO: 16717 - DNA, 69 bp, Homo sapiens
  misc_feature 1..69: note = chr21:45195259-45195328
  misc_feature 1..69: note = hypo
  source 1..69: mol_type = genomic DNA
gaatcttctggcaggcgcagagcaacaggacgtccattttacagacgaggaaaccgagacacagggaag

SEQ ID NO: 16718 - DNA, 30 bp, Homo sapiens
  misc_feature 1..30: note = chr21:45232947-45232977
  misc_feature 1..30: note = hypo
  source 1..30: mol_type = genomic DNA
gcaggcacagcagggcgcaccccatgacgc

SEQ ID NO: 16719 - DNA, 30 bp, Homo sapiens
  misc_feature 1..30: note = chr21:45247147-45247177
  misc_feature 1..30: note = hypo
  source 1..30: mol_type = genomic DNA
acagaaagaatgagtcgctggaacctggga

SEQ ID NO: 16720 - DNA, 30 bp, Homo sapiens
  misc_feature 1..30: note = chr21:45273840-45273870
  misc_feature 1..30: note = hypo
  source 1..30: mol_type = genomic DNA
tttgcatctgtaaggcgtatattaccgtag

SEQ ID NO: 16721 - DNA, 30 bp, Homo sapiens
  misc_feature 1..30: note = chr21:45365737-45365767
  misc_feature 1..30: note = hypo
  source 1..30: mol_type = genomic DNA
atgcttgcacaggagcgtggctttgtcaga

SEQ ID NO: 16722 - DNA, 62 bp, Homo sapiens
  misc_feature 1..62: note = chr21:45844751-45844813
  misc_feature 1..62: note = hypo
  source 1..62: mol_type = genomic DNA
agccctgcactggatcgtgaggacgctgcgggccagcggcttcagctcggaggcggacgtcc

SEQ ID NO: 16723 - DNA, 132 bp, Homo sapiens
  misc_feature 1..132: note = chr21:45929217-45929349
  misc_feature 1..132: note = hypo
  source 1..132: mol_type = genomic DNA
ggaagatcctctccccgatctggaagacctcccagtctgcagcaccgaacgtctaggaccaaaggagagcaggtgcagaggtgtgggggagcgggcgcagaggtgtgggggagcgggcgcagaggtgtgggg

SEQ ID NO: 16724 - DNA, 30 bp, Homo sapiens
  misc_feature 1..30: note = chr21:46015435-46015465
  misc_feature 1..30: note = hypo
  source 1..30: mol_type = genomic DNA
gttttctctgtaagacgtgctggagccttc

SEQ ID NO: 16725 - DNA, 222 bp, Homo sapiens; identical to SEQ ID NO: 5259
  misc_feature 1..222: note = chr21:46036605-46036827
  misc_feature 1..222: note = hypo
  source 1..222: mol_type = genomic DNA

SEQ ID NO: 16726 - DNA, 30 bp, Homo sapiens
  misc_feature 1..30: note = chr21:46068645-46068675
  misc_feature 1..30: note = hypo
  source 1..30: mol_type = genomic DNA
cctcccgatggctcccgaggggaaaggcag

SEQ ID NO: 16727 - DNA, 112 bp, Homo sapiens
  misc_feature 1..112: note = chr21:46256944-46257056
  misc_feature 1..112: note = hypo
  source 1..112: mol_type = genomic DNA
tttcaggggcacctccgtgcagtccccggcacccagggtgcagcccccagcacctccgtgtagcccccgacacccagggtgcagcccccggcacctccgtgtagcccccggc

SEQ ID NO: 16728 - DNA, 30 bp, Homo sapiens
  misc_feature 1..30: note = chr21:46257286-46257316
  misc_feature 1..30: note = hypo
  source 1..30: mol_type = genomic DNA
tggtagacaggaggccggagaagcccggat

SEQ ID NO: 16729 - DNA, 196 bp, Homo sapiens
  misc_feature 1..196: note = chr21:46308621-46308817
  misc_feature 1..196: note = hypo
  source 1..196: mol_type = genomic DNA
acatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggg

SEQ ID NO: 16730 - DNA, 157 bp, Homo sapiens
  misc_feature 1..157: note = chr21:46310607-46310764
  misc_feature 1..157: note = hypo
  source 1..157: mol_type = genomic DNA
aagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagt

SEQ ID NO: 16731 - DNA, 30 bp, Homo sapiens
  misc_feature 1..30: note = chr21:46311771-46311801
  misc_feature 1..30: note = hypo
  source 1..30: mol_type = genomic DNA
tctctgctctggtcccggcaccggcactca

SEQ ID NO: 16732 - DNA, 349 bp, Homo sapiens; identical to SEQ ID NO: 5260
  misc_feature 1..349: note = chr21:46319156-46319505
  misc_feature 1..349: note = hypo
  source 1..349: mol_type = genomic DNA

SEQ ID NO: 16733 - DNA, 30 bp, Homo sapiens
  misc_feature 1..30: note = chr21:46321598-46321628
  misc_feature 1..30: note = hypo
  source 1..30: mol_type = genomic DNA
gtgcgtgttcacgaacggcagcacggtctt

SEQ ID NO: 16734 - DNA, 259 bp, Homo sapiens
  misc_feature 1..259: note = chr21:46452280-46452539
  misc_feature 1..259: note = hypo
  source 1..259: mol_type = genomic DNA
ctggtcttggggaggcgggctccagctcgaaaggaggcacacaaaactgctgggaaacgggccgggcaggcaggggcggggccgggcgggtgaggacatggcttctgtgcgcacggcccggcgcgatggctggtgtggacccctacctttggaacacgtggggccaggccgagggggttccgccacgtctcctgggcagagcgccagcctcagtcaccgtgtcactgtgtgtccctccacaccccgagtcctggcaaac

SEQ ID NO: 16735 - DNA, 32 bp, Homo sapiens
  misc_feature 1..32: note = chr21:46677808-46677840
  misc_feature 1..32: note = hypo
  source 1..32: mol_type = genomic DNA
gtcctcgtgggaaaccgcgggggcacgtgggg

SEQ ID NO: 16736 - DNA, 43 bp, Homo sapiens
  misc_feature 1..43: note = chr21:46844706-46844749
  misc_feature 1..43: note = hypo
  source 1..43: mol_type = genomic DNA
ctgggaggcccgtggcgcagccccttcccgcctcctgcccgtc

SEQ ID NO: 16737 - DNA, 34 bp, Homo sapiens
  misc_feature 1..34: note = chr21:46863752-46863786
  misc_feature 1..34: note = hypo
  source 1..34: mol_type = genomic DNA
atgatcccctagatgcgtccgagggacactggac

SEQ ID NO: 16738 - DNA, 50 bp, Homo sapiens
  misc_feature 1..50: note = chr21:46908931-46908981
  misc_feature 1..50: note = hypo
  source 1..50: mol_type = genomic DNA
aagcgtcctctgctgcgtgcggggccaagggcgcacggggcccaccctgg

SEQ ID NO: 16739 - DNA, 127 bp, Homo sapiens
  misc_feature 1..127: note = chr21:46912135-46912262
  misc_feature 1..127: note = hypo
  source 1..127: mol_type = genomic DNA
atcagaaaagcctcccgtaggccgagccacctccgccggcaagcaagggagcgtctagcagaggcaggagcattttaaaacaaaatggaagtaaaaaccatggcccttagggcgtctggagtctgca

SEQ ID NO: 16740 - DNA, 57 bp, Homo sapiens
  misc_feature 1..57: note = chr21:46921503-46921560
  misc_feature 1..57: note = hypo
  source 1..57: mol_type = genomic DNA
ccctcacactgcagccgcaggggccttgccctgcacaatccccggtctcccaggtgg

SEQ ID NO: 16741 - DNA, 30 bp, Homo sapiens
  misc_feature 1..30: note = chr21:46925754-46925784
  misc_feature 1..30: note = hypo
  source 1..30: mol_type = genomic DNA
aggctctgggctacacgccaggccatgctg

SEQ ID NO: 16742 - DNA, 44 bp, Homo sapiens
  misc_feature 1..44: note = chr21:46926540-46926584
  misc_feature 1..44: note = hypo
  source 1..44: mol_type = genomic DNA
cccatgccgccgaaacggcctgtgacatccgtgggagcctccat

SEQ ID NO: 16743 - DNA, 30 bp, Homo sapiens
  misc_feature 1..30: note = chr21:47013235-47013265
  misc_feature 1..30: note = hypo
  source 1..30: mol_type = genomic DNA
atcaccccatggccccgtcatttcagcact

SEQ ID NO: 16744 - DNA, 48 bp, Homo sapiens
  misc_feature 1..48: note = chr21:47287102-47287150
  misc_feature 1..48: note = hypo
  source 1..48: mol_type = genomic DNA
agggaaggcggcggacggaacaaaacgcgggcacgcaacggctgctgc

SEQ ID NO: 16745 - DNA, 44 bp, Homo sapiens
  misc_feature 1..44: note = chr21:47404135-47404179
  misc_feature 1..44: note = hypo
  source 1..44: mol_type = genomic DNA
gcgccaggggccgcccgcctcacgcccgccgtgcctgttcctgg

SEQ ID NO: 16746 - DNA, 30 bp, Homo sapiens
  misc_feature 1..30: note = chr21:47425521-47425551
  misc_feature 1..30: note = hypo
  source 1..30: mol_type = genomic DNA
ggctgttctgggggccgctaggggactaag

SEQ ID NO: 16747 - DNA, 30 bp, Homo sapiens
  misc_feature 1..30: note = chr21:47501864-47501894
  misc_feature 1..30: note = hypo
  source 1..30: mol_type = genomic DNA
aaccttcacaccacacggaggaacccgcaa

SEQ ID NO: 16748 - DNA, 34 bp, Homo sapiens
  misc_feature 1..34: note = chr21:47503061-47503095
  misc_feature 1..34: note = hypo
  source 1..34: mol_type = genomic DNA
gccaccacatctgcacgtgcggggatctaataag

SEQ ID NO: 16749 - DNA, 37 bp, Homo sapiens
  misc_feature 1..37: note = chr21:47531922-47531959
  misc_feature 1..37: note = hypo
  source 1..37: mol_type = genomic DNA
tcgtgctggacacctcggagagcgtcaccatgcagtc

SEQ ID NO: 16750 - DNA, 37 bp, Homo sapiens
  misc_feature 1..37: note = chr21:47737928-47737965
  misc_feature 1..37: note = hypo
  source 1..37: mol_type = genomic DNA
tcccaagagcttcagcgtcagtcgggtcacttgctct

SEQ ID NO: 16751 - DNA, 215 bp, Homo sapiens; identical to SEQ ID NO: 5261
  misc_feature 1..215: note = chr21:47746178-47746393
  misc_feature 1..215: note = hypo
  source 1..215: mol_type = genomic DNA

SEQ ID NO: 16752 - DNA, 16 bp, Homo sapiens
  misc_feature 1..16: note = chr22:18110631-18110647
  misc_feature 1..16: note = hypo
  source 1..16: mol_type = genomic DNA
acgaccttgtcaaaac

SEQ ID NO: 16753 - DNA, 30 bp, Homo sapiens
  misc_feature 1..30: note = chr22:18553893-18553923
  misc_feature 1..30: note = hypo
  source 1..30: mol_type = genomic DNA
caaactgggagtgtccgcagaaaactgaat

SEQ ID NO: 16754 - DNA, 57 bp, Homo sapiens
  misc_feature 1..57: note = chr22:19117537-19117594
  misc_feature 1..57: note = hypo
  source 1..57: mol_type = genomic DNA
catgcactgcagccccgacccacccatacacaggcccttgctcgctggagcagcagc

SEQ ID NO: 16755 - DNA, 15 bp, Homo sapiens
  misc_feature 1..15: note = chr22:20864657-20864672
  misc_feature 1..15: note = hypo
  source 1..15: mol_type = genomic DNA
cgagactccatctca

SEQ ID NO: 16756 - DNA, 26 bp, Homo sapiens
  misc_feature 1..26: note = chr22:21214345-21214371
  misc_feature 1..26: note = hypo
  source 1..26: mol_type = genomic DNA
aacaattattctggccgagcgcagtg

SEQ ID NO: 16757 - DNA, 250 bp, Homo sapiens
  misc_feature 1..250: note = chr22:22899696-22899946
  misc_feature 1..250: note = hypo
  source 1..250: mol_type = genomic DNA
accgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggagga

SEQ ID NO: 16758 - DNA, 42 bp, Homo sapiens
  misc_feature 1..42: note = chr22:24374229-24374271
  misc_feature 1..42: note = hypo
  source 1..42: mol_type = genomic DNA
tactgcacaccagccggggcgacaaagcgagactgtctcaaa

SEQ ID NO: 16759 - DNA, 30 bp, Homo sapiens
  misc_feature 1..30: note = chr22:27045927-27045957
  misc_feature 1..30: note = hypo
  source 1..30: mol_type = genomic DNA
catgtcgggtgtgtccgacagtctcccaga

SEQ ID NO: 16760 - DNA, 83 bp, Homo sapiens
  misc_feature 1..83: note = chr22:29445929-29446012
  misc_feature 1..83: note = hypo
  source 1..83: mol_type = genomic DNA
cagctccctcagcagcgactatgaccccttcatctaccgcagccggagcccctgtcgtgccagtgaggcggggggctcgggca

SEQ ID NO: 16761 - DNA, 30 bp, Homo sapiens
  misc_feature 1..30: note = chr22:29446295-29446325
  misc_feature 1..30: note = hypo
  source 1..30: mol_type = genomic DNA
gtgtgcctgctgctgcgagccccagccctc

SEQ ID NO: 16762 - DNA, 18 bp, Homo sapiens
  misc_feature 1..18: note = chr22:29701031-29701049
  misc_feature 1..18: note = hypo
  source 1..18: mol_type = genomic DNA
gcccggccgggaatgtta

SEQ ID NO: 16763 - DNA, 38 bp, Homo sapiens
  misc_feature 1..38: note = chr22:29977653-29977691
  misc_feature 1..38: note = hypo
  source 1..38: mol_type = genomic DNA
caagggttcttaacaaggctgtccgggatgtgcagcag

SEQ ID NO: 16764 - DNA, 29 bp, Homo sapiens
  misc_feature 1..29: note = chr22:29977934-29977963
  misc_feature 1..29: note = hypo
  source 1..29: mol_type = genomic DNA
tagggagtggaagccgtcctcttgtgctg

SEQ ID NO: 16765 - DNA, 27 bp, Homo sapiens
  misc_feature 1..27: note = chr22:29998650-29998677
  misc_feature 1..27: note = hypo
  source 1..27: mol_type = genomic DNA
aataataattctaggcggggcgtggtg

SEQ ID NO: 16766 - DNA, 23 bp, Homo sapiens
  misc_feature 1..23: note = chr22:30158368-30158391
  misc_feature 1..23: note = hypo
  source 1..23: mol_type = genomic DNA
tgtcaggagctgggccgcacagc

SEQ ID NO: 16767 - DNA, 38 bp, Homo sapiens
  misc_feature 1..38: note = chr22:30783975-30784013
  misc_feature 1..38: note = hypo
  source 1..38: mol_type = genomic DNA
atgggcaccataggccgggcgcggtggctcacgcctgt

SEQ ID NO: 16768 - DNA, 35 bp, Homo sapiens
  misc_feature 1..35: note = chr22:32014233-32014268
  misc_feature 1..35: note = hypo
  source 1..35: mol_type = genomic DNA
aggtgtccctggggacgccccgggctgtgctccct

SEQ ID NO: 16769 - DNA, 29 bp, Homo sapiens
  misc_feature 1..29: note = chr22:32356777-32356806
  misc_feature 1..29: note = hypo
  source 1..29: mol_type = genomic DNA
aaaaactccgtccccgccccccccccccc

SEQ ID NO: 16770 - DNA, 30 bp, Homo sapiens
  misc_feature 1..30: note = chr22:33255298-33255328
  misc_feature 1..30: note = hypo
  source 1..30: mol_type = genomic DNA
tactgcagctggtaccgaggatgggccccc

SEQ ID NO: 16771 - DNA, 30 bp, Homo sapiens; identical to SEQ ID NO: 5265
  misc_feature 1..30: note = chr22:35079354-35079384
  misc_feature 1..30: note = hypo
  source 1..30: mol_type = genomic DNA

SEQ ID NO: 16772 - DNA, 30 bp, Homo sapiens; identical to SEQ ID NO: 5266
  misc_feature 1..30: note = chr22:35768487-35768517
  misc_feature 1..30: note = hypo
  source 1..30: mol_type = genomic DNA

SEQ ID NO: 16773 - DNA, 30 bp, Homo sapiens
  misc_feature 1..30: note = chr22:35822752-35822782
  misc_feature 1..30: note = hypo
  source 1..30: mol_type = genomic DNA
cagcctctgccatctcggatttcacctttt

SEQ ID NO: 16774 - DNA, 40 bp, Homo sapiens
  misc_feature 1..40: note = chr22:36585960-36586000
  misc_feature 1..40: note = hypo
  source 1..40: mol_type = genomic DNA
cctaaaaaatgtctgcgttttgtcccggcctgtgtctggc

SEQ ID NO: 16775 - DNA, 58 bp, Homo sapiens
  misc_feature 1..58: note = chr22:36684241-36684299
  misc_feature 1..58: note = hypo
  source 1..58: mol_type = genomic DNA
tgtagttggctcagtcgggtgccgcccaccctcacctgggccccgcccacccttacct

SEQ ID NO: 16776 - DNA, 30 bp, Homo sapiens
  misc_feature 1..30: note = chr22:36878964-36878994
  misc_feature 1..30: note = hypo
  source 1..30: mol_type = genomic DNA
cagcagctgaaagagcgtttttaaaagaac

SEQ ID NO: 16777 - DNA, 57 bp, Homo sapiens
  misc_feature 1..57: note = chr22:36902482-36902539
  misc_feature 1..57: note = hypo
  source 1..57: mol_type = genomic DNA
agaggggtaaggcctcgcacccggcccggcggctgggagacacgaggcccagaaaga

SEQ ID NO: 16778 - DNA, 112 bp, Homo sapiens
  misc_feature 1..112: note = chr22:38199743-38199855
  misc_feature 1..112: note = hypo
  source 1..112: mol_type = genomic DNA
taagtgaacagtgaccggcctctatgcttagggaataaaagcggggttgtgggagaggggcccagggagcaaacgtcgcagaatctcagcccagggccgctgccaagcggac

SEQ ID NO: 16779 - DNA, 30 bp, Homo sapiens
  misc_feature 1..30: note = chr22:38520276-38520306
  misc_feature 1..30: note = hypo
  source 1..30: mol_type = genomic DNA
aggcaggagccactgcgcctactctctgtg

SEQ ID NO: 16780 - DNA, 44 bp, Homo sapiens
  misc_feature 1..44: note = chr22:38578694-38578738
  misc_feature 1..44: note = hypo
  source 1..44: mol_type = genomic DNA
ttacaggcgtgagccaccacgcccggctccgaaatttttaacat

SEQ ID NO: 16781 - DNA, 43 bp, Homo sapiens
  misc_feature 1..43: note = chr22:38694550-38694593
  misc_feature 1..43: note = hypo
  source 1..43: mol_type = genomic DNA
agatcctccttgttccgacgggagacagcgccctgcctggccc

SEQ ID NO: 16782 - DNA, 30 bp, Homo sapiens
  misc_feature 1..30: note = chr22:39757008-39757038
  misc_feature 1..30: note = hypo
  source 1..30: mol_type = genomic DNA
tcgtccttctagccacggttcttcaggtgt

SEQ ID NO: 16783 - DNA, 165 bp, Homo sapiens
  misc_feature 1..165: note = chr22:40018163-40018328
  misc_feature 1..165: note = hypo
  source 1..165: mol_type = genomic DNA
cagaactctgcctggcggacagaaggcgcgccaaagacacgtgtgaaatggacacagcaggtgtactgagctgtgtactgtgccaggaccacagagctatacatgctcctgtgccgggcatgaggaggcagggagaatggggctgggggtcgggaggcctccggg

SEQ ID NO: 16784 - DNA, 270 bp, Homo sapiens
  misc_feature 1..270: note = chr22:40042590-40042860
  misc_feature 1..270: note = hypo
  source 1..270: mol_type = genomic DNA
gatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggcc

SEQ ID NO: 16785 - DNA, 16 bp, Homo sapiens
  misc_feature 1..16: note = chr22:40991414-40991430
  misc_feature 1..16: note = hypo
  source 1..16: mol_type = genomic DNA
gcgcccggccgagaaa

SEQ ID NO: 16786 - DNA, 61 bp, Homo sapiens
  misc_feature 1..61: note = chr22:41634431-41634492
  misc_feature 1..61: note = hypo
  source 1..61: mol_type = genomic DNA
tggtgtaggctgagccgtctcagggcgggcaggccagccagggcctcgggggccagcacgc

SEQ ID NO: 16787 - DNA, 30 bp, Homo sapiens
  misc_feature 1..30: note = chr22:41637166-41637196
  misc_feature 1..30: note = hypo
  source 1..30: mol_type = genomic DNA
caccagcagctggcccgggagtcagcagtc

SEQ ID NO: 16788 - DNA, 17 bp, Homo sapiens
  misc_feature 1..17: note = chr22:41839926-41839943
  misc_feature 1..17: note = hypo
  source 1..17: mol_type = genomic DNA
gccggaaggtttttcag

SEQ ID NO: 16789 - DNA, 37 bp, Homo sapiens
  misc_feature 1..37: note = chr22:42109085-42109122
  misc_feature 1..37: note = hypo
  source 1..37: mol_type = genomic DNA
tacatgcgtgagccaccgcgcccggctgggcattaga

SEQ ID NO: 16790 - DNA, 30 bp, Homo sapiens
  misc_feature 1..30: note = chr22:42995705-42995735
  misc_feature 1..30: note = hypo
  source 1..30: mol_type = genomic DNA
tgtggtggagaaagccgcctgaggctgcaa

SEQ ID NO: 16791 - DNA, 30 bp, Homo sapiens
  misc_feature 1..30: note = chr22:43012543-43012573
  misc_feature 1..30: note = hypo
  source 1..30: mol_type = genomic DNA
agtgtagggcagatgcggaggacaatttta

SEQ ID NO: 16792 - DNA, 30 bp, Homo sapiens
  misc_feature 1..30: note = chr22:43083005-43083035
  misc_feature 1..30: note = hypo
  source 1..30: mol_type = genomic DNA
tctcctccaccctcacggcctctgtcttgt

SEQ ID NO: 16793 - DNA, 32 bp, Homo sapiens
  misc_feature 1..32: note = chr22:43434445-43434477
  misc_feature 1..32: note = hypo
  source 1..32: mol_type = genomic DNA
gggaacaaccacgctcgcgcagcctgtcccgc

SEQ ID NO: 16794 - DNA, 92 bp, Homo sapiens
  misc_feature 1..92: note = chr22:43524971-43525063
  misc_feature 1..92: note = hypo
  source 1..92: mol_type = genomic DNA
ctcacctgtgcccaccgggtgtctttgcctgtgtcccgcagactggcaggcccaggccacgctggcctctctggccacgtcctcagggccac

SEQ ID NO: 16795 - DNA, 30 bp, Homo sapiens
  misc_feature 1..30: note = chr22:43581330-43581360
  misc_feature 1..30: note = hypo
  source 1..30: mol_type = genomic DNA
cctttccagggcagccggcctaaggtgagg

SEQ ID NO: 16796 - DNA, 197 bp, Homo sapiens
  misc_feature 1..197: note = chr22:43601102-43601299
  misc_feature 1..197: note = hypo
  source 1..197: mol_type = genomic DNA
ggacctcgggaacatcgctttgctgctctgactttcattcttccctgcacagagaggtcacgatgcctcttcccggggctgcgaggaaaatgatctgcactggcgtgagcagagaacctctcctcagcggtgctcagtacaggtttgctgcagggatctaggcagcaaacggggctgtcctccggagcagtctctgg

SEQ ID NO: 16797 - DNA, 140 bp, Homo sapiens
  misc_feature 1..140: note = chr22:44455600-44455740
  misc_feature 1..140: note = hypo
  source 1..140: mol_type = genomic DNA
aataaagaaagatgccgtacacattttcctttaaaaagtctcacttggcttgtttgacaggcacagaagatgtgttattaaacacttgcaaagcctgctgtcatttggttttaaacagcactcgtcgtctttggcggggc

SEQ ID NO: 16798 - DNA, 39 bp, Homo sapiens
  misc_feature 1..39: note = chr22:44538737-44538776
  misc_feature 1..39: note = hypo
  source 1..39: mol_type = genomic DNA
tgctgcttctgctgacgcaggttccgaagtctcctggtt

SEQ ID NO: 16799 - DNA, 30 bp, Homo sapiens
  misc_feature 1..30: note = chr22:44580569-44580599
  misc_feature 1..30: note = hypo
  source 1..30: mol_type = genomic DNA
acagggtccctggcacggcagatgagaccc

SEQ ID NO: 16800 - DNA, 73 bp, Homo sapiens
  misc_feature 1..73: note = chr22:45088693-45088766
  misc_feature 1..73: note = hypo
  source 1..73: mol_type = genomic DNA
gcctgcctggcagggcggctgcaaacacgaaggttcggaagtgcacgagctctcagcacggggccaggcacag

SEQ ID NO: 16801 - DNA, 49 bp, Homo sapiens
  misc_feature 1..49: note = chr22:45593666-45593715
  misc_feature 1..49: note = hypo
  source 1..49: mol_type = genomic DNA
ttacctgttaaaatccgatgcagcggcaacgtgacgtaggttaagtgtg

SEQ ID NO: 16802 - DNA, 51 bp, Homo sapiens
  misc_feature 1..51: note = chr22:46929253-46929304
  misc_feature 1..51: note = hypo
  source 1..51: mol_type = genomic DNA
gaaggcgctgatccccggtcttgaacttgggagaaccgcaggcctgctccc

SEQ ID NO: 16803 - DNA, 41 bp, Homo sapiens
  misc_feature 1..41: note = chr22:46929668-46929709
  misc_feature 1..41: note = hypo
  source 1..41: mol_type = genomic DNA
gtcggggtcatgggccgggatgcagccgatcacgccggtgg

SEQ ID NO: 16804 - DNA, 44 bp, Homo sapiens
  misc_feature 1..44: note = chr22:46931911-46931955
  misc_feature 1..44: note = hypo
  source 1..44: mol_type = genomic DNA
cgttgatgggcgagtcgcggtcgctggcgcggatggtcagcacc

SEQ ID NO: 16805 - DNA, 74 bp, Homo sapiens; identical to SEQ ID NO: 5268
  misc_feature 1..74: note = chr22:47005080-47005154
  misc_feature 1..74: note = hypo
  source 1..74: mol_type = genomic DNA

SEQ ID NO: 16806 - DNA, 30 bp, Homo sapiens
  misc_feature 1..30: note = chr22:47005505-47005535
  misc_feature 1..30: note = hypo
  source 1..30: mol_type = genomic DNA
tctttggtgccaggccgtgtgctgggcccc

SEQ ID NO: 16807 - DNA, 30 bp, Homo sapiens
  misc_feature 1..30: note = chr22:47054582-47054612
  misc_feature 1..30: note = hypo
  source 1..30: mol_type = genomic DNA
cccagtgccccaccccgggggccagcccgg

SEQ ID NO: 16808 - DNA, 210 bp, Homo sapiens
  misc_feature 1..210: note = chr22:47525714-47525924
  misc_feature 1..210: note = hypo
  source 1..210: mol_type = genomic DNA
tgtcagcgtcactgccgctgagtcaccacgtgcactgtgcctgtcatccctttctgggacagcatgtcactttccttggtgtcaccaatcatctcccttaggagtctgtgaaccacccactccctccctccccaccagacaggttaccggagcgggcgtgtctggaggagcaggcagagcaggtgctgtacacctcgtgtcctctgggac

SEQ ID NO: 16809 - DNA, 233 bp, Homo sapiens
  misc_feature 1..233: note = chr22:48931835-48932068
  misc_feature 1..233: note = hypo
  source 1..233: mol_type = genomic DNA
gagtgcccgtgttgtcgagcccccgccacagagctgcaccgccgcttggtgccgcatgcagcgagttcccgcatgggttggttttcgtctcctgaaactaatttggcagaagcaagtgtccatatgtaggtgtgggtctctgtcttcatgcgtcccccatgccccgacacacacacacgtttccattaattagcagggacttggaaacctaccgtccccggctcaaggcaaat

SEQ ID NO: 16810 - DNA, 167 bp, Homo sapiens
  misc_feature 1..167: note = chr22:49115643-49115810
  misc_feature 1..167: note = hypo
  source 1..167: mol_type = genomic DNA
aacgtatatggccggcgccacatcagctagtattgtaagcagtgacactcttcattttctcagcagaaatgagcccagaaacaaaaaaaaattggtttgaccaaacccacattatttctgtctgcactttgggccacttttgtaatgggagacgtgacacgctgggc

SEQ ID NO: 16811 - DNA, 30 bp, Homo sapiens
  misc_feature 1..30: note = chr22:49117093-49117123
  misc_feature 1..30: note = hypo
  source 1..30: mol_type = genomic DNA
gccaccatttcagcccgcccactgccttca

SEQ ID NO: 16812 - DNA, 30 bp, Homo sapiens
  misc_feature 1..30: note = chr22:49387651-49387681
  misc_feature 1..30: note = hypo
  source 1..30: mol_type = genomic DNA
tctttctgatcatctcggttccaatcgagg

SEQ ID NO: 16813 - DNA, 30 bp, Homo sapiens
  misc_feature 1..30: note = chr22:49831409-49831439
  misc_feature 1..30: note = hypo
  source 1..30: mol_type = genomic DNA
cacggtcttctcgtacgcgtgaggagccag

SEQ ID NO: 16814 - DNA, 30 bp, Homo sapiens
  misc_feature 1..30: note = chr22:49941803-49941833
  misc_feature 1..30: note = hypo
  source 1..30: mol_type = genomic DNA
tcccgccgctgtcagcgcacctctgcattg

SEQ ID NO: 16815 - DNA, 40 bp, Homo sapiens
  misc_feature 1..40: note = chr22:49979613-49979653
  misc_feature 1..40: note = hypo
  source 1..40: mol_type = genomic DNA
accccatccctgggccggggctgaccggtcatcagcgaaa

SEQ ID NO: 16816 - DNA, 130 bp, Homo sapiens
  misc_feature 1..130: note = chr22:50001685-50001815
  misc_feature 1..130: note = hypo
  source 1..130: mol_type = genomic DNA
gcctctcctgggtgccggggattcagctgcgatgaacaggacaaagtccagatctcatgggaccggcatgggggtgatctcagggaggacaacagagaaaatggaagccaagaaccgggaacagggattc

SEQ ID NO: 16817 - DNA, 30 bp, Homo sapiens
  misc_feature 1..30: note = chr22:50002771-50002801
  misc_feature 1..30: note = hypo
  source 1..30: mol_type = genomic DNA
ggacagtccctgcttcggctccccaggaac

SEQ ID NO: 16818 - DNA, 78 bp, Homo sapiens
  misc_feature 1..78: note = chr22:50003204-50003282
  misc_feature 1..78: note = hypo
  source 1..78: mol_type = genomic DNA
cggttcctccaaacacgagacgcttggaacagggtctctgaggggtggacacaaaacagggaccgcagtctgtgcctc

SEQ ID NO: 16819 - DNA, 30 bp, Homo sapiens
  misc_feature 1..30: note = chr22:50007987-50008017
  misc_feature 1..30: note = hypo
  source 1..30: mol_type = genomic DNA
agccccaacgacctgcggcacacggcacac

SEQ ID NO: 16820 - DNA, 30 bp, Homo sapiens
  misc_feature 1..30: note = chr22:50010606-50010636
  misc_feature 1..30: note = hypo
  source 1..30: mol_type = genomic DNA
gaaggggcatccctgcgactttccatccac

SEQ ID NO: 16821 - DNA, 30 bp, Homo sapiens
  misc_feature 1..30: note = chr22:50024083-50024113
  misc_feature 1..30: note = hypo
  source 1..30: mol_type = genomic DNA
ccccactaccacccccggcaagaccagaaa

SEQ ID NO: 16822 - DNA, 138 bp, Homo sapiens; identical to SEQ ID NO: 5269
  misc_feature 1..138: note = chr22:50149332-50149470
  misc_feature 1..138: note = hypo
  source 1..138: mol_type = genomic DNA

SEQ ID NO: 16823 - DNA, 36 bp, Homo sapiens
  misc_feature 1..36: note = chr22:50170666-50170702
  misc_feature 1..36: note = hypo
  source 1..36: mol_type = genomic DNA
gtccgggcgactcaccggctgcgatcctggccgcct

SEQ ID NO: 16824 - DNA, 77 bp, Homo sapiens
  misc_feature 1..77: note = chr22:50466962-50467039
  misc_feature 1..77: note = hypo
  source 1..77: mol_type = genomic DNA
tgggaatcagggaggcggcaacacctgcgtgccgtcataaagacccccaccatgccctcgtaaagacccccatcaca

SEQ ID NO: 16825 - DNA, 105 bp, Homo sapiens
  misc_feature 1..105: note = chr22:50507059-50507164
  misc_feature 1..105: note = hypo
  source 1..105: mol_type = genomic DNA
gggggcgggcatggccgggcactcatgggcatagtcccaagctggttccctgcatgactcctgctgaaacctctgccttttcttttttctttttctttttttttt

SEQ ID NO: 16826 - DNA, 30 bp, Homo sapiens
  misc_feature 1..30: note = chr22:50529568-50529598
  misc_feature 1..30: note = hypo
  source 1..30: mol_type = genomic DNA
cgatgcccggggggccggctgtgttacctg

SEQ ID NO: 16827 - DNA, 30 bp, Homo sapiens
  misc_feature 1..30: note = chr22:50686625-50686655
  misc_feature 1..30: note = hypo
  source 1..30: mol_type = genomic DNA
ctgcagcctagcacccggccacactgacct

SEQ ID NO: 16828 - DNA, 37 bp, Homo sapiens
  misc_feature 1..37: note = chr22:50695483-50695520
  misc_feature 1..37: note = hypo
  source 1..37: mol_type = genomic DNA
ccctgcagcctcccccggggcccgtaccctcagcccc

SEQ ID NO: 16829 - DNA, 410 bp, Homo sapiens; identical to SEQ ID NO: 1644
  misc_feature 1..410: note = chr22:50899279-50899689
  misc_feature 1..410: note = hypo
  source 1..410: mol_type = genomic DNA

SEQ ID NO: 16830 - DNA, 38 bp, Homo sapiens
  misc_feature 1..38: note = chrX:20160933-20160971
  misc_feature 1..38: note = hypo
  source 1..38: mol_type = genomic DNA
cgcagtcctttcactcgcccagccgggttgggagcctg

SEQ ID NO: 16831 - DNA, 21 bp, Homo sapiens
  misc_feature 1..21: note = chrX:44755607-44755628
  misc_feature 1..21: note = hypo
  source 1..21: mol_type = genomic DNA
tcaccgcgcccggccaaaaat

SEQ ID NO: 16832 - DNA, 30 bp, Homo sapiens
  misc_feature 1..30: note = AEKP01139090.1_11256-14570:719-749
  misc_feature 1..30: note = hypo
  source 1..30: mol_type = genomic DNA
atggaagatagagaccgaaatttcaggtag

SEQ ID NO: 16833 - DNA, 86 bp, Homo sapiens
  misc_feature 1..86: note = AEKP01153556.1_1-5252:404-490
  misc_feature 1..86: note = hypo
  source 1..86: mol_type = genomic DNA
catcaccattatctccaccactgttgctgtgaacgcatactgcactattatcacctgaggtacagtgacaacgttgtgtgatgcta

SEQ ID NO: 16834 - DNA, 126 bp, Homo sapiens
  misc_feature 1..126: note = AEKP01196136.1_22995-25251:484-610
  misc_feature 1..126: note = hypo
  source 1..126: mol_type = genomic DNA
aaagaggcagggcaacgcgcactacagtgagggatcttacaggcctgtttttgagggaaaatggtaagtgagctacagcgagcacacgtgtgtagatcccagttacaggtccgtcaagatggctag

SEQ ID NO: 16835 - DNA, 34 bp, Homo sapiens
  misc_feature 1..34: note = NW_001838014.1_249000-295694:4094-4128
  misc_feature 1..34: note = hypo
  source 1..34: mol_type = genomic DNA
agccagagccagagccgtgcggagacacggagcc

SEQ ID NO: 16836 - DNA, 37 bp, Homo sapiens
  misc_feature 1..37: note = NW_001841145.1_177495-186900:5222-5259
  misc_feature 1..37: note = hypo
  source 1..37: mol_type = genomic DNA
atcaacctgctccctcgtgggtcgactttgcccacac

SEQ ID NO: 16837 - DNA, 30 bp, Homo sapiens
  misc_feature 1..30: note = NW_001841145.1_90215-97412:6862-6892
  misc_feature 1..30: note = hypo
  source 1..30: mol_type = genomic DNA
ggcctggatgctgcacgggctcagtgtttc

SEQ ID NO: 16838 - DNA, 30 bp, Homo sapiens; identical to SEQ ID NO: 5271
  misc_feature 1..30: note = chr1:975836-975866
  misc_feature 1..30: note = hyper
  source 1..30: mol_type = genomic DNA

SEQ ID NO: 16839 - DNA, 19 bp, Homo sapiens
  misc_feature 1..19: note = chr1:1475537-1475556
  misc_feature 1..19: note = hyper
  source 1..19: mol_type = genomic DNA
ggccggggaggggagcgca

SEQ ID NO: 16840 - DNA, 39 bp, Homo sapiens; identical to SEQ ID NO: 5273
  misc_feature 1..39: note = chr1:1535851-1535890
  misc_feature 1..39: note = hyper
  source 1..39: mol_type = genomic DNA

SEQ ID NO: 16841 - DNA, 30 bp, Homo sapiens; identical to SEQ ID NO: 5274
  misc_feature 1..30: note = chr1:1567286-1567316
  misc_feature 1..30: note = hyper
  source 1..30: mol_type = genomic DNA

SEQ ID NO: 16842 - DNA, 33 bp, Homo sapiens; identical to SEQ ID NO: 5275
  misc_feature 1..33: note = chr1:1567781-1567814
  misc_feature 1..33: note = hyper
  source 1..33: mol_type = genomic DNA

SEQ ID NO: 16843 - DNA, 154 bp, Homo sapiens
  misc_feature 1..154: note = chr1:2374994-2375148
  misc_feature 1..154: note = hyper
  source 1..154: mol_type = genomic DNA
aaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgg

SEQ ID NO: 16844 - DNA, 62 bp, Homo sapiens
  misc_feature 1..62: note = chr1:2375543-2375605
  misc_feature 1..62: note = hyper
  source 1..62: mol_type = genomic DNA
cggtggcacgggcaggggtgcgggcgcgggactgtgggcgggacgggcggagcggtcttgag

SEQ ID NO: 16845 - DNA, 64 bp, Homo sapiens; identical to SEQ ID NO: 5278
  misc_feature 1..64: note = chr1:2560861-2560925
  misc_feature 1..64: note = hyper
  source 1..64: mol_type = genomic DNA

SEQ ID NO: 16846 - DNA, 30 bp, Homo sapiens; identical to SEQ ID NO: 5280
  misc_feature 1..30: note = chr1:2985189-2985219
  misc_feature 1..30: note = hyper
  source 1..30: mol_type = genomic DNA

SEQ ID NO: 16847 - DNA, 42 bp, Homo sapiens; identical to SEQ ID NO: 5281
  misc_feature 1..42: note = chr1:2987163-2987205
  misc_feature 1..42: note = hyper
  source 1..42: mol_type = genomic DNA

SEQ ID NO: 16848 - DNA, 69 bp, Homo sapiens; identical to SEQ ID NO: 5282
  misc_feature 1..69: note = chr1:3087621-3087690
  misc_feature 1..69: note = hyper
  source 1..69: mol_type = genomic DNA

SEQ ID NO: 16849 - DNA, 85 bp, Homo sapiens; identical to SEQ ID NO: 5283
  misc_feature 1..85: note = chr1:3310353-3310438
  misc_feature 1..85: note = hyper
  source 1..85: mol_type = genomic DNA

SEQ ID NO: 16850 - DNA, 51 bp, Homo sapiens
  misc_feature 1..51: note = chr1:3568226-3568277
  misc_feature 1..51: note = hyper
  source 1..51: mol_type = genomic DNA
caagcgcaccgacgcccgcgagctccttccaaacaccgaacgggatccaga

SEQ ID NO: 16851 - DNA, 35 bp, Homo sapiens; identical to SEQ ID NO: 5287
  misc_feature 1..35: note = chr1:3663252-3663287
  misc_feature 1..35: note = hyper
  source 1..35: mol_type = genomic DNA

SEQ ID NO: 16852 - DNA, 224 bp, Homo sapiens
  misc_feature 1..224: note = chr1:3663650-3663874
  misc_feature 1..224: note = hyper
  source 1..224: mol_type = genomic DNA
gggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccat

SEQ ID NO: 16853 - DNA, 152 bp, Homo sapiens; identical to SEQ ID NO: 5289
  misc_feature 1..152: note = chr1:4712671-4712823
  misc_feature 1..152: note = hyper
  source 1..152: mol_type = genomic DNA

SEQ ID NO: 16854 - DNA, 79 bp, Homo sapiens; identical to SEQ ID NO: 5295
  misc_feature 1..79: note = chr1:6208701-6208780
  misc_feature 1..79: note = hyper
  source 1..79: mol_type = genomic DNA

SEQ ID NO: 16855 - DNA, 145 bp, Homo sapiens; identical to SEQ ID NO: 5296
  misc_feature 1..145: note = chr1:6241066-6241211
  misc_feature 1..145: note = hyper
  source 1..145: mol_type = genomic DNA

SEQ ID NO: 16856 - DNA, 188 bp, Homo sapiens; identical to SEQ ID NO: 5297
  misc_feature 1..188: note = chr1:6301754-6301942
  misc_feature 1..188: note = hyper
  source 1..188: mol_type = genomic DNA

SEQ ID NO: 16857 - DNA, 83 bp, Homo sapiens
  misc_feature 1..83: note = chr1:6304118-6304201
  misc_feature 1..83: note = hyper
  source 1..83: mol_type = genomic DNA
gggagcttcccagtgcgtcctccctcggtcccctcctcctcaaggtttctagagtccagagggcctcattgacatgtaaacga

SEQ ID NO: 16858 - DNA, 68 bp, Homo sapiens
  misc_feature 1..68: note = chr1:6304242-6304310
  misc_feature 1..68: note = hyper
  source 1..68: mol_type = genomic DNA
actgcaacatgggcacggagcctgctgcccggggcagcctccccggcaacttccgaaaggtctggggt

SEQ ID NO: 16859 - DNA, 763 bp, Homo sapiens; identical to SEQ ID NO: 5299
  misc_feature 1..763: note = chr1:6309258-6310021
  misc_feature 1..763: note = hyper
  source 1..763: mol_type = genomic DNA

SEQ ID NO: 16860 - DNA, 146 bp, Homo sapiens
  misc_feature 1..146: note = chr1:6480368-6480514
  misc_feature 1..146: note = hyper
  source 1..146: mol_type = genomic DNA
cagcaggggacccagcggttacgggagctcccatgagggacagcagcgggagggacttgcacccccagctgctttatcgggtgaagggctgagctggacgggaaatccgagttccggagaaaggtcgtgacttgctccagtcctcg

SEQ ID NO: 16861 - DNA, 54 bp, Homo sapiens
  misc_feature 1..54: note = chr1:6480831-6480885
  misc_feature 1..54: note = hyper
  source 1..54: mol_type = genomic DNA
gctgcggcaaactggctggcgtcccccgcccatctgctccgggctcccctcccc

SEQ ID NO: 16862 - DNA, 15 bp, Homo sapiens
  misc_feature 1..15: note = chr1:6500973-6500988
  misc_feature 1..15: note = hyper
  source 1..15: mol_type = genomic DNA
ctcactgcgtgcccc

SEQ ID NO: 16863 - DNA, 34 bp, Homo sapiens; identical to SEQ ID NO: 5303
  misc_feature 1..34: note = chr1:6507490-6507524
  misc_feature 1..34: note = hyper
  source 1..34: mol_type = genomic DNA

SEQ ID NO: 16864 - DNA, 53 bp, Homo sapiens; identical to SEQ ID NO: 5305
  misc_feature 1..53: note = chr1:6508969-6509022
  misc_feature 1..53: note = hyper
  source 1..53: mol_type = genomic DNA

SEQ ID NO: 16865 - DNA, 77 bp, Homo sapiens; identical to SEQ ID NO: 5306
  misc_feature 1..77: note = chr1:8002422-8002499
  misc_feature 1..77: note = hyper
  source 1..77: mol_type = genomic DNA

SEQ ID NO: 16866 - DNA, 30 bp, Homo sapiens; identical to SEQ ID NO: 9
  misc_feature 1..30: note = chr1:8277113-8277143
  misc_feature 1..30: note = hyper
  source 1..30: mol_type = genomic DNA

SEQ ID NO: 16867 - DNA, 48 bp, Homo sapiens; identical to SEQ ID NO: 5308
  misc_feature 1..48: note = chr1:9243236-9243284
  misc_feature 1..48: note = hyper
  source 1..48: mol_type = genomic DNA

SEQ ID NO: 16868 - DNA, 270 bp, Homo sapiens
  misc_feature 1..270: note = chr1:9712291-9712561
  misc_feature 1..270: note = hyper
  source 1..270: mol_type = genomic DNA
ggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagat

SEQ ID NO: 16869 - DNA, 78 bp, Homo sapiens; identical to SEQ ID NO: 5311
  misc_feature 1..78: note = chr1:10057431-10057509
  misc_feature 1..78: note = hyper
  source 1..78: mol_type = genomic DNA

SEQ ID NO: 16870 - DNA, 38 bp, Homo sapiens
  misc_feature 1..38: note = chr1:10948582-10948620
  misc_feature 1..38: note = hyper
  source 1..38: mol_type = genomic DNA
gcttcccgcccggggcggctgagcggtcccggggagag

SEQ ID NO: 16871 - DNA, 61 bp, Homo sapiens; identical to SEQ ID NO: 5314
  misc_feature 1..61: note = chr1:11752522-11752583
  misc_feature 1..61: note = hyper
  source 1..61: mol_type = genomic DNA

SEQ ID NO: 16872 - DNA, 40 bp, Homo sapiens; identical to SEQ ID NO: 5315
  misc_feature 1..40: note = chr1:11919143-11919183
  misc_feature 1..40: note = hyper
  source 1..40: mol_type = genomic DNA

SEQ ID NO: 16873 - DNA, 13 bp, Homo sapiens
  misc_feature 1..13: note = chr1:11959080-11959093
  misc_feature 1..13: note = hyper
  source 1..13: mol_type = genomic DNA
acctggatccgag

SEQ ID NO: 16874 - DNA, 42 bp, Homo sapiens
  misc_feature 1..42: note = chr1:11959196-11959238
  misc_feature 1..42: note = hyper
  source 1..42: mol_type = genomic DNA
tgtaggatttgtttcaagggctcagaccggcacagagccccc

SEQ ID NO: 16875 - DNA, 15 bp, Homo sapiens
  misc_feature 1..15: note = chr1:12123787-12123802
  misc_feature 1..15: note = hyper
  source 1..15: mol_type = genomic DNA
cgcaagggaggacac

SEQ ID NO: 16876 - DNA, 134 bp, Homo sapiens; identical to SEQ ID NO: 5319
  misc_feature 1..134: note = chr1:13840532-13840666
  misc_feature 1..134: note = hyper
  source 1..134: mol_type = genomic DNA

SEQ ID NO: 16877 - DNA, 106 bp, Homo sapiens
  misc_feature 1..106: note = chr1:13910330-13910436
  misc_feature 1..106: note = hyper
  source 1..106: mol_type = genomic DNA
gcaaagtttgctgtccggctgcctagggtctgggaagctcgggcaccctccctctccggggctcctgctcccacccctccggcccccccaccgtcgcgctcctcca

SEQ ID NO: 16878 - DNA, 30 bp, Homo sapiens; identical to SEQ ID NO: 5322
  misc_feature 1..30: note = chr1:14219604-14219634
  misc_feature 1..30: note = hyper
  source 1..30: mol_type = genomic DNA

SEQ ID NO: 16879 - DNA, 30 bp, Homo sapiens; identical to SEQ ID NO: 5323
  misc_feature 1..30: note = chr1:14924607-14924637
  misc_feature 1..30: note = hyper
  source 1..30: mol_type = genomic DNA

SEQ ID NO: 16880 - DNA, 142 bp, Homo sapiens; identical to SEQ ID NO: 5324
  misc_feature 1..142: note = chr1:14925056-14925198
  misc_feature 1..142: note = hyper
  source 1..142: mol_type = genomic DNA

SEQ ID NO: 16881 - DNA, 302 bp, Homo sapiens
  misc_feature 1..302: note = chr1:14925199-14925501
  misc_feature 1..302: note = hyper
  source 1..302: mol_type = genomic DNA
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatgga

SEQ ID NO: 16882 - DNA, 80 bp, Homo sapiens; identical to SEQ ID NO: 5327
  misc_feature 1..80: note = chr1:16553585-16553665
  misc_feature 1..80: note = hyper
  source 1..80: mol_type = genomic DNA

SEQ ID NO: 16883 - DNA, 30 bp, Homo sapiens; identical to SEQ ID NO: 5328
  misc_feature 1..30: note = chr1:16861712-16861742
  misc_feature 1..30: note = hyper
  source 1..30: mol_type = genomic DNA

SEQ ID NO: 16884 - DNA, 55 bp, Homo sapiens; identical to SEQ ID NO: 5329
  misc_feature 1..55: note = chr1:18436492-18436547
  misc_feature 1..55: note = hyper
  source 1..55: mol_type = genomic DNA

SEQ ID NO: 16885 - DNA, 156 bp, Homo sapiens; identical to SEQ ID NO: 5330
  misc_feature 1..156: note = chr1:18436827-18436983
  misc_feature 1..156: note = hyper
  source 1..156: mol_type = genomic DNA

SEQ ID NO: 16886 - DNA, 229 bp, Homo sapiens; identical to SEQ ID NO: 13
  misc_feature 1..229: note = chr1:18437202-18437431
  misc_feature 1..229: note = hyper
  source 1..229: mol_type = genomic DNA

SEQ ID NO: 16887 - DNA, 25 bp, Homo sapiens
  misc_feature 1..25: note = chr1:18437432-18437457
  misc_feature 1..25: note = hyper
  source 1..25: mol_type = genomic DNA
ggggtctccgggattgcgcgggcgg

SEQ ID NO: 16888 - DNA, 79 bp, Homo sapiens; identical to SEQ ID NO: 5333
  misc_feature 1..79: note = chr1:18437738-18437817
  misc_feature 1..79: note = hyper
  source 1..79: mol_type = genomic DNA

SEQ ID NO: 16889 - DNA, 45 bp, Homo sapiens
  misc_feature 1..45: note = chr1:18956811-18956856
  misc_feature 1..45: note = hyper
  source 1..45: mol_type = genomic DNA
caagtcaccctaggccggttcccggggagcctcactggaggaatt

SEQ ID NO: 16890 - DNA, 41 bp, Homo sapiens
  misc_feature 1..41: note = chr1:18957246-18957287
  misc_feature 1..41: note = hyper
  source 1..41: mol_type = genomic DNA
ccctcctcatgaataaaagaaaagtccgaacctatcagatc

SEQ ID NO: 16891 - DNA, 48 bp, Homo sapiens
  misc_feature 1..48: note = chr1:18957985-18958033
  misc_feature 1..48: note = hyper
  source 1..48: mol_type = genomic DNA
ttaaaaaaaagaagacgaagaagacggaaagaaagagatcgcagcagg

SEQ ID NO: 16892 - DNA, 58 bp, Homo sapiens; identical to SEQ ID NO: 5338
  misc_feature 1..58: note = chr1:18958829-18958887
  misc_feature 1..58: note = hyper
  source 1..58: mol_type = genomic DNA

SEQ ID NO: 16893 - DNA, 35 bp, Homo sapiens; identical to SEQ ID NO: 5339
  misc_feature 1..35: note = chr1:18959220-18959255
  misc_feature 1..35: note = hyper
  source 1..35: mol_type = genomic DNA

SEQ ID NO: 16894 - DNA, 123 bp, Homo sapiens; identical to SEQ ID NO: 5340
  misc_feature 1..123: note = chr1:18959573-18959696
  misc_feature 1..123: note = hyper
  source 1..123: mol_type = genomic DNA

SEQ ID NO: 16895 - DNA, 26 bp, Homo sapiens
  misc_feature 1..26: note = chr1:18963135-18963161
  misc_feature 1..26: note = hyper
  source 1..26: mol_type = genomic DNA
gcggggctgcgcgcctggtctacccc

SEQ ID NO: 16896 - DNA, 30 bp, Homo sapiens; identical to SEQ ID NO: 5343
  misc_feature 1..30: note = chr1:18963693-18963723
  misc_feature 1..30: note = hyper
  source 1..30: mol_type = genomic DNA

SEQ ID NO: 16897 - DNA, 96 bp, Homo sapiens; identical to SEQ ID NO: 5344
  misc_feature 1..96: note = chr1:18964297-18964393
  misc_feature 1..96: note = hyper
  source 1..96: mol_type = genomic DNA

SEQ ID NO: 16898 - DNA, 94 bp, Homo sapiens; identical to SEQ ID NO: 5345
  misc_feature 1..94: note = chr1:18968003-18968097
  misc_feature 1..94: note = hyper
  source 1..94: mol_type = genomic DNA

SEQ ID NO: 16899 - DNA, 92 bp, Homo sapiens
  misc_feature 1..92: note = chr1:18969533-18969625
  misc_feature 1..92: note = hyper
  source 1..92: mol_type = genomic DNA
ctgggagaggaaaagcgtctgcgggtcgctacagcctcgggaggggtgaagggaagttgtgtgcgccccaagtccagctcaaaagaggcccc

SEQ ID NO: 16900 - DNA, 339 bp, Homo sapiens
  misc_feature 1..339: note = chr1:18969819-18970158
  misc_feature 1..339: note = hyper
  source 1..339: mol_type = genomic DNA
ggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagat

SEQ ID NO: 16901 - DNA, 30 bp, Homo sapiens; identical to SEQ ID NO: 5347
  misc_feature 1..30: note = chr1:18970361-18970391
  misc_feature 1..30: note = hyper
  source 1..30: mol_type = genomic DNA

SEQ ID NO: 16902 - DNA, 64 bp, Homo sapiens; identical to SEQ ID NO: 5348
  misc_feature 1..64: note = chr1:18971750-18971814
  misc_feature 1..64: note = hyper
  source 1..64: mol_type = genomic DNA

SEQ ID NO: 16903 - DNA, 29 bp, Homo sapiens
  misc_feature 1..29: note = chr1:19043114-19043143
  misc_feature 1..29: note = hyper
  source 1..29: mol_type = genomic DNA
cgtctccctgatcgcgtcataaccctgag

SEQ ID NO: 16904 - DNA, 107 bp, Homo sapiens
  misc_feature 1..107: note = chr1:19043456-19043563
  misc_feature 1..107: note = hyper
  source 1..107: mol_type = genomic DNA
gggcgggggttggggcggcggccggagcggggatcgggtctggggggatccgcgcggccgcccctccccgcgctccgccgccgccgccgtcgccgccgcgcctttga

SEQ ID NO: 16905 - DNA, 65 bp, Homo sapiens
  misc_feature 1..65: note = chr1:19043678-19043743
  misc_feature 1..65: note = hyper
  source 1..65: mol_type = genomic DNA
gcttaattcccgctgcccgggcctgggatcccgagcagccgcgcgcctggccgccccccggactg

SEQ ID NO: 16906 - DNA, 151 bp, Homo sapiens; identical to SEQ ID NO: 5351
  misc_feature 1..151: note = chr1:19043756-19043907
  misc_feature 1..151: note = hyper
  source 1..151: mol_type = genomic DNA

SEQ ID NO: 16907 - DNA, 160 bp, Homo sapiens
  misc_feature 1..160: note = chr1:20618169-20618329
  misc_feature 1..160: note = hyper
  source 1..160: mol_type = genomic DNA
atgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagca

SEQ ID NO: 16908 - DNA, 76 bp, Homo sapiens
  misc_feature 1..76: note = chr1:20618369-20618445
  misc_feature 1..76: note = hyper
  source 1..76: mol_type = genomic DNA
ctggaagttccaccataacgtctgcggcagccccaacagttccaccccatgctcccgccgccggcaccacagcagc

SEQ ID NO: 16909 - DNA, 72 bp, Homo sapiens; identical to SEQ ID NO: 5353
  misc_feature 1..72: note = chr1:20669776-20669848
  misc_feature 1..72: note = hyper
  source 1..72: mol_type = genomic DNA

SEQ ID NO: 16910 - DNA, 40 bp, Homo sapiens; identical to SEQ ID NO: 5354
  misc_feature 1..40: note = chr1:20692819-20692859
  misc_feature 1..40: note = hyper
  source 1..40: mol_type = genomic DNA

SEQ ID NO: 16911 - DNA, 55 bp, Homo sapiens; identical to SEQ ID NO: 5355
  misc_feature 1..55: note = chr1:20810635-20810690
  misc_feature 1..55: note = hyper
  source 1..55: mol_type = genomic DNA

SEQ ID NO: 16912 - DNA, 92 bp, Homo sapiens; identical to SEQ ID NO: 5356
  misc_feature 1..92: note = chr1:20878524-20878616
  misc_feature 1..92: note = hyper
  source 1..92: mol_type = genomic DNA

SEQ ID NO: 16913 - DNA, 124 bp, Homo sapiens; identical to SEQ ID NO: 5357
  misc_feature 1..124: note = chr1:20878905-20879029
  misc_feature 1..124: note = hyper
  source 1..124: mol_type = genomic DNA

SEQ ID NO: 16914 - skipped

SEQ ID NO: 16915 - DNA, 148 bp, Homo sapiens
  misc_feature 1..148: note = chr1:20879289-20879437
  misc_feature 1..148: note = hyper
  source 1..148: mol_type = genomic DNA
catctgcgaagctagccctgcctggcactgggcatctccaggcaacgactgtccccggccctgcccagcttctcgcgactccagggcggtggacttctgcgcgccttccctcccccggtctcccgacaggacgccggtgagctccctg

SEQ ID NO: 16916 - DNA, 100 bp, Homo sapiens
  misc_feature 1..100: note = chr1:20879462-20879562
  misc_feature 1..100: note = hyper
  source 1..100: mol_type = genomic DNA
cgcgatgctgccctggagacgtaacaaattcgtgctggtggaggacgaggccaagtgcaaggcgaagagcctgagtccggggctcgcctacacgtcgctg

SEQ ID NO: 16917 - DNA, 225 bp, Homo sapiens
  misc_feature 1..225: note = chr1:20879957-20880182
  misc_feature 1..225: note = hyper
  source 1..225: mol_type = genomic DNA
ccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcct

SEQ ID NO: 16918 - DNA, 43 bp, Homo sapiens
  misc_feature 1..43: note = chr1:21044161-21044204
  misc_feature 1..43: note = hyper
  source 1..43: mol_type = genomic DNA
cggcagcgcacgacaaccttcaccgcctcggaggccatggcgc

SEQ ID NO: 16919 - DNA, 102 bp, Homo sapiens; identical to SEQ ID NO: 5363
  misc_feature 1..102: note = chr1:21754482-21754584
  misc_feature 1..102: note = hyper
  source 1..102: mol_type = genomic DNA

SEQ ID NO: 16920 - DNA, 42 bp, Homo sapiens; identical to SEQ ID NO: 5364
  misc_feature 1..42: note = chr1:21835408-21835450
  misc_feature 1..42: note = hyper
  source 1..42: mol_type = genomic DNA

SEQ ID NO: 16921 - DNA, 50 bp, Homo sapiens; identical to SEQ ID NO: 5365
  misc_feature 1..50: note = chr1:21836105-21836155
  misc_feature 1..50: note = hyper
  source 1..50: mol_type = genomic DNA

SEQ ID NO: 16922 - DNA, 70 bp, Homo sapiens
  misc_feature 1..70: note = chr1:22140683-22140753
  misc_feature 1..70: note = hyper
  source 1..70: mol_type = genomic DNA
aagggattgtagatttgaattaaattaaattaaatcatttaatccttacaatcattctgagattgattaa

SEQ ID NO: 16923 - DNA, 118 bp, Homo sapiens
  misc_feature 1..118: note = chr1:22141184-22141302
  misc_feature 1..118: note = hyper
  source 1..118: mol_type = genomic DNA
ggtccccactgtgcggcctgaacatcccggtgcctgtggcatcctccggaccctttctaggcctgcgcctggtcacgagaggccgccagccccgcgtggacttcgtgggcgaagtcac

SEQ ID NO: 16924 - DNA, 30 bp, Homo sapiens; identical to SEQ ID NO: 5368
  misc_feature 1..30: note = chr1:22933907-22933937
  misc_feature 1..30: note = hyper
  source 1..30: mol_type = genomic DNA

SEQ ID NO: 16925 - DNA, 120 bp, Homo sapiens
  misc_feature 1..120: note = chr1:23748862-23748982
  misc_feature 1..120: note = hyper
  source 1..120: mol_type = genomic DNA
gtatgtagctgtgaccgtaggcacttggttgcatgtttgaagttgcttctgttagtgcatgctcagaggatgtgacaaagccttaagtggctgagacttcagcaaccggcagtaaacccc

SEQ ID NO: 16926 - DNA, 47 bp, Homo sapiens
  misc_feature 1..47: note = chr1:23749070-23749117
  misc_feature 1..47: note = hyper
  source 1..47: mol_type = genomic DNA
tcccagagcaggccccacctttctcggccagacgcccagagctccat

SEQ ID NO: 16927 - DNA, 342 bp, Homo sapiens
  misc_feature 1..342: note = chr1:25256012-25256354
  misc_feature 1..342: note = hyper
  source 1..342: mol_type = genomic DNA
ctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaata

SEQ ID NO: 16928 - DNA, 441 bp, Homo sapiens
  misc_feature 1..441: note = chr1:25256383-25256824
  misc_feature 1..441: note = hyper
  source 1..441: mol_type = genomic DNA
caggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctgg

SEQ ID NO: 16929 - DNA, 106 bp, Homo sapiens; identical to SEQ ID NO: 5372
  misc_feature 1..106: note = chr1:26372988-26373094
  misc_feature 1..106: note = hyper
  source 1..106: mol_type = genomic DNA

SEQ ID NO: 16930 - DNA, 282 bp, Homo sapiens
  misc_feature 1..282: note = chr1:26551804-26552086
  misc_feature 1..282: note = hyper
  source 1..282: mol_type = genomic DNA
caaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagctt

SEQ ID NO: 16931 - DNA, 309 bp, Homo sapiens; identical to SEQ ID NO: 5374
  misc_feature 1..309: note = chr1:26735645-26735954
  misc_feature 1..309: note = hyper
  source 1..309: mol_type = genomic DNA

SEQ ID NO: 16932 - DNA, 337 bp, Homo sapiens
  misc_feature 1..337: note = chr1:26737246-26737583
  misc_feature 1..337: note = hyper
  source 1..337: mol_type = genomic DNA
cgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggc

SEQ ID NO: 16933 - DNA, 33 bp, Homo sapiens
  misc_feature 1..33: note = chr1:26737613-26737646
  misc_feature 1..33: note = hyper
  source 1..33: mol_type = genomic DNA
aggagaggcttgtcccgccgtgagtctctggga

SEQ ID NO: 16934 - DNA, 82 bp, Homo sapiens; identical to SEQ ID NO: 5376
  misc_feature 1..82: note = chr1:26738220-26738302
  misc_feature 1..82: note = hyper
  source 1..82: mol_type = genomic DNA

SEQ ID NO: 16935 - DNA, 138 bp, Homo sapiens; identical to SEQ ID NO: 5377
  misc_feature 1..138: note = chr1:28199339-28199477
  misc_feature 1..138: note = hyper
  source 1..138: mol_type = genomic DNA

SEQ ID NO: 16936 - DNA, 52 bp, Homo sapiens; identical to SEQ ID NO: 5378
  misc_feature 1..52: note = chr1:29138840-29138892
  misc_feature 1..52: note = hyper
  source 1..52: mol_type = genomic DNA

SEQ ID NO: 16937 - DNA, 164 bp, Homo sapiens; identical to SEQ ID NO: 5379
  misc_feature 1..164: note = chr1:29448530-29448694
  misc_feature 1..164: note = hyper
  source 1..164: mol_type = genomic DNA

SEQ ID NO: 16938 - skipped

SEQ ID NO: 16939 - DNA, 108 bp, Homo sapiens; identical to SEQ ID NO: 5382
  misc_feature 1..108: note = chr1:30559030-30559138
  misc_feature 1..108: note = hyper
  source 1..108: mol_type = genomic DNA

SEQ ID NO: 16940 - DNA, 213 bp, Homo sapiens
  misc_feature 1..213: note = chr1:32180184-32180397
  misc_feature 1..213: note = hyper
  source 1..213: mol_type = genomic DNA
actcctaatccttcccggctgtggctgctaccgcttgccccgccggcaccgccctgccaagggcgcagagtcgggccagcagagccggagtgatgccgggccatcgaggcgtcctcagcccccgaggtgggaggtggtgggggggcggggaggagaagaagaaggctctcccgacacggtgactcaggcctccttgacccgctcctgggtggg

SEQ ID NO: 16941 - DNA, 228 bp, Homo sapiens; identical to SEQ ID NO: 5385
  misc_feature 1..228: note = chr1:32180905-32181133
  misc_feature 1..228: note = hyper
  source 1..228: mol_type = genomic DNA

SEQ ID NO: 16942 - DNA, 15 bp, Homo sapiens
  misc_feature 1..15: note = chr1:32237531-32237546
  misc_feature 1..15: note = hyper
  source 1..15: mol_type = genomic DNA
cccaccgccggaagc

SEQ ID NO: 16943 - DNA, 139 bp, Homo sapiens
  misc_feature 1..139: note = chr1:32238507-32238646
  misc_feature 1..139: note = hyper
  source 1..139: mol_type = genomic DNA
agggaccccgggcccgccgccagccctgggcacacccgccccttcctccagcggccccgctcgctgacccacgggcactcgatgggcactcgggaggcaatggccggagaggatgggcagttagcgggagggactgagt

SEQ ID NO: 16944 - DNA, 42 bp, Homo sapiens
  misc_feature 1..42: note = chr1:32410234-32410276
  misc_feature 1..42: note = hyper
  source 1..42: mol_type = genomic DNA
ctagagcttcccctgcgtccgcctttgggggaggggagggag

SEQ ID NO: 16945 - DNA, 58 bp, Homo sapiens
  misc_feature 1..58: note = chr1:32410306-32410364
  misc_feature 1..58: note = hyper
  source 1..58: mol_type = genomic DNA
gtcgctcggggcgtgggtccgcgcgcggaggggctcgctgtcccggtgccagcgggag

SEQ ID NO: 16946 - DNA, 16 bp, Homo sapiens
  misc_feature 1..16: note = chr1:32827808-32827824
  misc_feature 1..16: note = hyper
  source 1..16: mol_type = genomic DNA
ggcctctggccatggc

SEQ ID NO: 16947 - DNA, 240 bp, Homo sapiens; identical to SEQ ID NO: 5390
  misc_feature 1..240: note = chr1:32930682-32930922
  misc_feature 1..240: note = hyper
  source 1..240: mol_type = genomic DNA

SEQ ID NO: 16948 - DNA, 35 bp, Homo sapiens; identical to SEQ ID NO: 5391
  misc_feature 1..35: note = chr1:33351678-33351713
  misc_feature 1..35: note = hyper
  source 1..35: mol_type = genomic DNA

SEQ ID NO: 16949 - DNA, 30 bp, Homo sapiens; identical to SEQ ID NO: 5392
  misc_feature 1..30: note = chr1:33772555-33772585
  misc_feature 1..30: note = hyper
  source 1..30: mol_type = genomic DNA

SEQ ID NO: 16950 - DNA, 121 bp, Homo sapiens
  misc_feature 1..121: note = chr1:34628827-34628948
  misc_feature 1..121: note = hyper
  source 1..121: mol_type = genomic DNA
cagcgattcccccaccgcccatgtggcaagtctgggtgaccagcagcgtcggtatgcacagcctcccagtgggtgtgggtgtgcgagaggccagagctcccaggcgcgcgcaccgcgggcg

SEQ ID NO: 16951 - DNA, 491 bp, Homo sapiens
  misc_feature 1..491: note = chr1:34628978-34629469
  misc_feature 1..491: note = hyper
  source 1..491: mol_type = genomic DNA
ttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggg

SEQ ID NO: 16952 - DNA, 84 bp, Homo sapiens
  misc_feature 1..84: note = chr1:34629728-34629812
  misc_feature 1..84: note = hyper
  source 1..84: mol_type = genomic DNA
tggcgcggagtgagcaccgaggggaatgtggcagcgcgaagcctggcggcggcactccctcccccgcctcgggctacaaccccc

SEQ ID NO: 16953 - DNA, 303 bp, Homo sapiens
  misc_feature 1..303: note = chr1:34630245-34630548
  misc_feature 1..303: note = hyper
  source 1..303: mol_type = genomic DNA
cccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccag

SEQ ID NO: 16954 - DNA, 224 bp, Homo sapiens
  misc_feature 1..224: note = chr1:34630635-34630859
  misc_feature 1..224: note = hyper
  source 1..224: mol_type = genomic DNA
gccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggaga

SEQ ID NO: 16955 - skipped

SEQ ID NO: 16956 - DNA, 30 bp, Homo sapiens; identical to SEQ ID NO: 5395
  misc_feature 1..30: note = chr1:34631535-34631565
  misc_feature 1..30: note = hyper
  source 1..30: mol_type = genomic DNA

SEQ ID NO: 16957 - DNA, 192 bp, Homo sapiens; identical to SEQ ID NO: 5396
  misc_feature 1..192: note = chr1:34632140-34632332
  misc_feature 1..192: note = hyper
  source 1..192: mol_type = genomic DNA

SEQ ID NO: 16958 - DNA, 21 bp, Homo sapiens
  misc_feature 1..21: note = chr1:34642862-34642883
  misc_feature 1..21: note = hyper
  source 1..21: mol_type = genomic DNA
gctctgcgaggggctccctgg

SEQ ID NO: 16959 - DNA, 59 bp, Homo sapiens
  misc_feature 1..59: note = chr1:35258578-35258637
  misc_feature 1..59: note = hyper
  source 1..59: mol_type = genomic DNA
cccccgccgctcgtgcggtccagcagggctcccgcgggcgtcactccggccatcgtccc

SEQ ID NO: 16960 - DNA, 39 bp, Homo sapiens
  misc_feature 1..39: note = chr1:35351039-35351078
  misc_feature 1..39: note = hyper
  source 1..39: mol_type = genomic DNA
cagggtcagagccctcgtgggcgcctccccgttccatac

SEQ ID NO: 16961 - DNA, 100 bp, Homo sapiens
  misc_feature 1..100: note = chr1:35351659-35351759
  misc_feature 1..100: note = hyper
  source 1..100: mol_type = genomic DNA
aaggtgtactcacaggagccgggcctccctgagacagcggcaggggtagcgaggaggggcaggcagtcgtcgtcttgagagcagccggcctggatggccc

SEQ ID NO: 16962 - DNA, 60 bp, Homo sapiens; identical to SEQ ID NO: 5400
  misc_feature 1..60: note = chr1:35390613-35390673
  misc_feature 1..60: note = hyper
  source 1..60: mol_type = genomic DNA

SEQ ID NO: 16963 - skipped

SEQ ID NO: 16964 - DNA, 36 bp, Homo sapiens; identical to SEQ ID NO: 5403
  misc_feature 1..36: note = chr1:35395964-35396000
  misc_feature 1..36: note = hyper
  source 1..36: mol_type = genomic DNA

SEQ ID NO: 16965 - DNA, 130 bp, Homo sapiens
  misc_feature 1..130: note = chr1:36042549-36042679
  misc_feature 1..130: note = hyper
  source 1..130: mol_type = genomic DNA
ggaccccagcgccagcgggaccccagcgccagcgggaccccagcgccagcgggaccccagcgccagcgggaccccagcgccagcgggaccccagcgccagcgggtctgtggcccagtggagcgagtggag

SEQ ID NO: 16966 - DNA, 30 bp, Homo sapiens; identical to SEQ ID NO: 5405
  misc_feature 1..30: note = chr1:36549840-36549870
  misc_feature 1..30: note = hyper
  source 1..30: mol_type = genomic DNA

SEQ ID NO: 16967 - DNA, 39 bp, Homo sapiens
  misc_feature 1..39: note = chr1:37498753-37498792
  misc_feature 1..39: note = hyper
  source 1..39: mol_type = genomic DNA
aacaaagttaaagaccggagtaagagtctccggcgagaa

SEQ ID NO: 16968 - skipped

SEQ ID NO: 16969 - DNA, 105 bp, Homo sapiens
  misc_feature 1..105: note = chr1:38219795-38219900
  misc_feature 1..105: note = hyper
  source 1..105: mol_type = genomic DNA
accctgccctcaccaccacctggatcaggccttccttcttggccactcccaccccccaccctccgcagtgcagcctggaggggggactcacgggtgcaggaagcc

SEQ ID NO: 16970 - DNA, 156 bp, Homo sapiens
  misc_feature 1..156: note = chr1:38230623-38230779
  misc_feature 1..156: note = hyper
  source 1..156: mol_type = genomic DNA
tcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagcc

SEQ ID NO: 16971 - DNA, 91 bp, Homo sapiens
  misc_feature 1..91: note = chr1:38510087-38510178
  misc_feature 1..91: note = hyper
  source 1..91: mol_type = genomic DNA
aggagggcagggccccgcggggagcaggggccgcgctatgcggcggtcggtctgcagcagggcagaagccccttcccgtctgggtgtgtgg

SEQ ID NO: 16972 - DNA, 32 bp, Homo sapiens
  misc_feature 1..32: note = chr1:38510217-38510249
  misc_feature 1..32: note = hyper
  source 1..32: mol_type = genomic DNA
ggctcggatgaaacgaaacgaaaaatgaacac

SEQ ID NO: 16973 - DNA, 254 bp, Homo sapiens
  misc_feature 1..254: note = chr1:38510309-38510563
  misc_feature 1..254: note = hyper
  source 1..254: mol_type = genomic DNA
gtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggag

SEQ ID NO: 16974 - DNA, 110 bp, Homo sapiens
  misc_feature 1..110: note = chr1:38510624-38510734
  misc_feature 1..110: note = hyper
  source 1..110: mol_type = genomic DNA
ccacgcggggagaggggatggagaactctcctcgcttcgtcctctctcccggggaatccctaaccccgcactgcgttacctgtcgctttggggaggccgctgccgggatc

SEQ ID NO: 16975 - DNA, 81 bp, Homo sapiens
  misc_feature 1..81: note = chr1:38510773-38510854
  misc_feature 1..81: note = hyper
  source 1..81: mol_type = genomic DNA
cgaggggatgggggcagagagcaggcggcgggcaggatgcccggggtgagttggcgagttccggatcttcgctcctctctc

SEQ ID NO: 16976 - DNA, 218 bp, Homo sapiens
  misc_feature 1..218: note = chr1:38511119-38511337
  misc_feature 1..218: note = hyper
  source 1..218: mol_type = genomic DNA
cggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcact

SEQ ID NO: 16977 - DNA, 266 bp, Homo sapiens
  misc_feature 1..266: note = chr1:38511824-38512090
  misc_feature 1..266: note = hyper
  source 1..266: mol_type = genomic DNA
ctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgc

SEQ ID NO: 16978 - DNA, 64 bp, Homo sapiens; identical to SEQ ID NO: 5421
  misc_feature 1..64: note = chr1:39044122-39044186
  misc_feature 1..64: note = hyper
  source 1..64: mol_type = genomic DNA

SEQ ID NO: 16979 - DNA, 98 bp, Homo sapiens
  misc_feature 1..98: note = chr1:39269643-39269741
  misc_feature 1..98: note = hyper
  source 1..98: mol_type = genomic DNA
ccgactagcattgatcgctttttgatcttaaaagaaatactttttaattcgaaagttaatagaaatgcggagtcaggggcaggcctcggcggcgtccg

SEQ ID NO: 16980 - DNA, 165 bp, Homo sapiens; identical to SEQ ID NO: 5423
  misc_feature 1..165: note = chr1:40105139-40105304
  misc_feature 1..165: note = hyper
  source 1..165: mol_type = genomic DNA

SEQ ID NO: 16981 - DNA, 79 bp, Homo sapiens; identical to SEQ ID NO: 5424
  misc_feature 1..79: note = chr1:40105538-40105617
  misc_feature 1..79: note = hyper
  source 1..79: mol_type = genomic DNA

SEQ ID NO: 16982 - DNA, 58 bp, Homo sapiens
  misc_feature 1..58: note = chr1:40237083-40237141
  misc_feature 1..58: note = hyper
  source 1..58: mol_type = genomic DNA
caacagggagggggccggctccgccctgggctgggggcccccgagtcagtcctccgtg

SEQ ID NO: 16983 - DNA, 173 bp, Homo sapiens; identical to SEQ ID NO: 5426
  misc_feature 1..173: note = chr1:40781428-40781601
  misc_feature 1..173: note = hyper
  source 1..173: mol_type = genomic DNA

SEQ ID NO: 16984 - DNA, 91 bp, Homo sapiens; identical to SEQ ID NO: 5427
  misc_feature 1..91: note = chr1:41267904-41267995
  misc_feature 1..91: note = hyper
  source 1..91: mol_type = genomic DNA

SEQ ID NO: 16985 - DNA, 133 bp, Homo sapiens
  misc_feature 1..133: note = chr1:41284463-41284596
  misc_feature 1..133: note = hyper
  source 1..133: mol_type = genomic DNA
tgtggcctgcgggggttggagccctagcaggaggcgaggtctaagcgggtggggcgaagtggattctgaattaggtaggggcgggcctaggagtccggaccggatcagggggcggggccggagaggcggggct

SEQ ID NO: 16986 - DNA, 30 bp, Homo sapiens; identical to SEQ ID NO: 5429
  misc_feature 1..30: note = chr1:41327007-41327037
  misc_feature 1..30: note = hyper
  source 1..30: mol_type = genomic DNA

SEQ ID NO: 16987 - skipped

SEQ ID NO: 16988 - DNA, 105 bp, Homo sapiens
  misc_feature 1..105: note = chr1:41847478-41847583
  misc_feature 1..105: note = hyper
  source 1..105: mol_type = genomic DNA
gcagctgcaggcgcccgagcgaagcccggacgacagctccccgagtgcgcccgccccggggccggtgcctgccgcagccaagtgggccgccagccccgcctcgca

SEQ ID NO: 16989 - DNA, 190 bp, Homo sapiens
  misc_feature 1..190: note = chr1:41847702-41847892
  misc_feature 1..190: note = hyper
  source 1..190: mol_type = genomic DNA
tcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcc

SEQ ID NO: 16990 - DNA, 11 bp, Homo sapiens
  misc_feature 1..11: note = chr1:43533901-43533912
  misc_feature 1..11: note = hyper
  source 1..11: mol_type = genomic DNA
ggtgtgcgccc

SEQ ID NO: 16991 - DNA, 30 bp, Homo sapiens; identical to SEQ ID NO: 5433
  misc_feature 1..30: note = chr1:43534162-43534192
  misc_feature 1..30: note = hyper
  source 1..30: mol_type = genomic DNA

SEQ ID NO: 16992 - DNA, 84 bp, Homo sapiens
  misc_feature 1..84: note = chr1:44873706-44873790
  misc_feature 1..84: note = hyper
  source 1..84: mol_type = genomic DNA
cccagagtattctatatacaaaggcaaccgagagccggagggagaggtcgggccaaagagtagtgggctcggctccgcgttggg

SEQ ID NO: 16993 - DNA, 91 bp, Homo sapiens; identical to SEQ ID NO: 5441
  misc_feature 1..91: note = chr1:45250257-45250348
  misc_feature 1..91: note = hyper
  source 1..91: mol_type = genomic DNA

SEQ ID NO: 16994 - DNA, 32 bp, Homo sapiens; identical to SEQ ID NO: 5442
  misc_feature 1..32: note = chr1:45252161-45252193
  misc_feature 1..32: note = hyper
  source 1..32: mol_type = genomic DNA

SEQ ID NO: 16995 - DNA, 112 bp, Homo sapiens
  misc_feature 1..112: note = chr1:46632764-46632876
  misc_feature 1..112: note = hyper
  source 1..112: mol_type = genomic DNA
gctgcgggactctagcggggaaggcacccccaattctgggccctggcgaccttgggtcagggccaggaaaggcacttccagccaagcgctggcgccgggtgcgcctcgcttt

SEQ ID NO: 16996 - DNA, 22 bp, Homo sapiens
  misc_feature 1..22: note = chr1:46632923-46632945
  misc_feature 1..22: note = hyper
  source 1..22: mol_type = genomic DNA
gcagccgcgagaaggctagctg

SEQ ID NO: 16997 - DNA, 137 bp, Homo sapiens; identical to SEQ ID NO: 1694
  misc_feature 1..137: note = chr1:46914285-46914422
  misc_feature 1..137: note = hyper
  source 1..137: mol_type = genomic DNA

SEQ ID NO: 16998 - DNA, 11 bp, Homo sapiens
  misc_feature 1..11: note = chr1:46951196-46951207
  misc_feature 1..11: note = hyper
  source 1..11: mol_type = genomic DNA
gtagccgtcgg

SEQ ID NO: 16999 - DNA, 67 bp, Homo sapiens
  misc_feature 1..67: note = chr1:46956387-46956454
  misc_feature 1..67: note = hyper
  source 1..67: mol_type = genomic DNA
ttgagggtggttcggcgctcagccagcctctgccctcgaagacgcggccttggtctaggaaccttca

SEQ ID NO: 17000 - DNA, 13 bp, Homo sapiens
  misc_feature 1..13: note = chr1:46956603-46956616
  misc_feature 1..13: note = hyper
  source 1..13: mol_type = genomic DNA
agtcaaagggttg

SEQ ID NO: 17001 - DNA, 139 bp, Homo sapiens
  misc_feature 1..139: note = chr1:46956684-46956823
  misc_feature 1..139: note = hyper
  source 1..139: mol_type = genomic DNA
cgacaggccaggggccctgatggactgtgcagggtcccgggcaccaccggctgaactttctggcggtcacaaattcccggaacctgcgcaggggcttcgttggcactggtggttcacttaaggagcttgagggaaacct

SEQ ID NO: 17002 - DNA, 326 bp, Homo sapiens; identical to SEQ ID NO: 36
  misc_feature 1..326: note = chr1:47009560-47009886
  misc_feature 1..326: note = hyper
  source 1..326: mol_type = genomic DNA

SEQ ID NO: 17003 - DNA, 19 bp, Homo sapiens
  misc_feature 1..19: note = chr1:47009910-47009929
  misc_feature 1..19: note = hyper
  source 1..19: mol_type = genomic DNA
cgcctcccgccacccggaa

SEQ ID NO: 17004 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 17005 - DNA, 30 bp, Homo sapiens; identical to SEQ ID NO: 5456
  misc_feature 1..30: note = chr1:47695896-47695926
  misc_feature 1..30: note = hyper
  source 1..30: mol_type = genomic DNA

SEQ ID NO: 17006 - DNA, 201 bp, Homo sapiens
  misc_feature 1..201: note = chr1:47696620-47696821
  misc_feature 1..201: note = hyper
  source 1..201: mol_type = genomic DNA
cgaatgtccccacccgaggctcgaggcctggtgaatgtgcccattgtcctttcggggcctctcccttggagcccggcggccgcacccacgaaactgaccagaaatggatgaagccggagtgcagcgggaaccgaagcccgcagctaccggctcgaaggcgccggcctcggcgagcgctgctcagcttcaagcctggaggag

SEQ ID NO: 17007 - DNA, 15 bp, Homo sapiens
  misc_feature 1..15: note = chr1:47697341-47697356
  misc_feature 1..15: note = hyper
  source 1..15: mol_type = genomic DNA
tgctgagaacaccaa

SEQ ID NO: 17008 - DNA, 222 bp, Homo sapiens
  misc_feature 1..222: note = chr1:47697510-47697732
  misc_feature 1..222: note = hyper
  source 1..222: mol_type = genomic DNA
tgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggag

SEQ ID NO: 17009 - DNA, 12 bp, Homo sapiens
  misc_feature 1..12: note = chr1:47882051-47882063
  misc_feature 1..12: note = hyper
  source 1..12: mol_type = genomic DNA
tcgcgccgtcgg

SEQ ID NO: 17010 - DNA, 143 bp, Homo sapiens
  misc_feature 1..143: note = chr1:47909575-47909718
  misc_feature 1..143: note = hyper
  source 1..143: mol_type = genomic DNA
ttgctcttgccacagcgggcgcgtcttcgtggttacaaagcgctttttccctgatgacttttttccccttttcaaaaacacttctttctccccccttcaactagcaaccctccccaggcccacccctcctccctctccgctcc

SEQ ID NO: 17011 - DNA, 21 bp, Homo sapiens
  misc_feature 1..21: note = chr1:48059057-48059078
  misc_feature 1..21: note = hyper
  source 1..21: mol_type = genomic DNA
gggctagggggaggccgggcg

SEQ ID NO: 17012 - DNA, 36 bp, Homo sapiens
  misc_feature 1..36: note = chr1:48059243-48059279
  misc_feature 1..36: note = hyper
  source 1..36: mol_type = genomic DNA
ggtggggctcagtctgtctctcgttttctctccctg

SEQ ID NO: 17013 - DNA, 52 bp, Homo sapiens; identical to SEQ ID NO: 5468
  misc_feature 1..52: note = chr1:48191010-48191062
  misc_feature 1..52: note = hyper
  source 1..52: mol_type = genomic DNA

SEQ ID NO: 17014 - DNA, 79 bp, Homo sapiens; identical to SEQ ID NO: 5469
  misc_feature 1..79: note = chr1:48462159-48462238
  misc_feature 1..79: note = hyper
  source 1..79: mol_type = genomic DNA

SEQ ID NO: 17015 - skipped

SEQ ID NO: 17016 - DNA, 64 bp, Homo sapiens; identical to SEQ ID NO: 5472
  misc_feature 1..64: note = chr1:49242884-49242948
  misc_feature 1..64: note = hyper
  source 1..64: mol_type = genomic DNA

SEQ ID NO: 17017 - DNA, 166 bp, Homo sapiens
  misc_feature 1..166: note = chr1:50513745-50513911
  misc_feature 1..166: note = hyper
  source 1..166: mol_type = genomic DNA
gagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacgg

SEQ ID NO: 17018 - DNA, 34 bp, Homo sapiens; identical to SEQ ID NO: 5474
  misc_feature 1..34: note = chr1:50514141-50514175
  misc_feature 1..34: note = hyper
  source 1..34: mol_type = genomic DNA

SEQ ID NO: 17019 - DNA, 626 bp, Homo sapiens
  misc_feature 1..626: note = chr1:50798652-50799278
  misc_feature 1..626: note = hyper
  source 1..626: mol_type = genomic DNA
aaaggccagctggggcgccagacgactcgccctgccccgtcgacgccccagacggtgttgccgacctccgccccgcagcgctggtgtgggcgcggccggacctcactcagcctgcactgccccgcgccgctcgccgcgtccacactgtccttgggaggacgcgcggggaagccgcgcacgatgcggcagcgccccctgccgggctccgggcgctccgctcccagccggctcggcgagtgctccgggaaaggggtccggaccccacacgcactgggttccaggacaggctctcgctcgggctgggccgactctggcccgcctaggccccgggcacgctgcagtgaaggcggtaccctcaccacagtcacagaacgtgtcggctgcccgcgcgtcctcccaaggacagtggacgggagctggggctggagagggtaacgacctgcccaaggtcacacagcaccgcagtggcacagccaggactggcacccacacctcccgcggaaccttgcaggggcccaaaccacctgggttctagagctccttgaactggcctcttgggctttagggaagagctggggacgagggaatggggtggggccacaccacattagcacggacccttgggt

SEQ ID NO: 17020 - DNA, 120 bp, Homo sapiens
  misc_feature 1..120: note = chr1:50799400-50799520
  misc_feature 1..120: note = hyper
  source 1..120: mol_type = genomic DNA
agccgcggctgccccctactggcggaaggaagagtcgccgctccggggcccttggcggccgccgctcttcgcgcctccttggcctggctgccacccttccaccctcgggggagaccccgc

SEQ ID NO: 17021 - DNA, 84 bp, Homo sapiens
  misc_feature 1..84: note = chr1:50886104-50886188
  misc_feature 1..84: note = hyper
  source 1..84: mol_type = genomic DNA
aaaccagggagggtgcggaagaaactagaaggagggagggcgcagcaagcggttgtccagagggcgttaggaacgcgagaaggg

SEQ ID NO: 17022 - DNA, 30 bp, Homo sapiens; identical to SEQ ID NO: 5489
  misc_feature 1..30: note = chr1:50888238-50888268
  misc_feature 1..30: note = hyper
  source 1..30: mol_type = genomic DNA

SEQ ID NO: 17023 - DNA, 34 bp, Homo sapiens
  misc_feature 1..34: note = chr1:50888675-50888709
  misc_feature 1..34: note = hyper
  source 1..34: mol_type = genomic DNA
ctctcccagacccttcgggcgtccctaaggccca

SEQ ID NO: 17024 - DNA, 310 bp, Homo sapiens
  misc_feature 1..310: note = chr1:50889510-50889820
  misc_feature 1..310: note = hyper
  source 1..310: mol_type = genomic DNA
gcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtg

SEQ ID NO: 17025 - DNA, 256 bp, Homo sapiens
  misc_feature 1..256: note = chr1:50892351-50892607
  misc_feature 1..256: note = hyper
  source 1..256: mol_type = genomic DNA
gaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccagggg

SEQ ID NO: 17026 - DNA, 140 bp, Homo sapiens
  misc_feature 1..140: note = chr1:53098702-53098842
  misc_feature 1..140: note = hyper
  source 1..140: mol_type = genomic DNA
tcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcaga

SEQ ID NO: 17027 - DNA, 299 bp, Homo sapiens
  misc_feature 1..299: note = chr1:53099067-53099366
  misc_feature 1..299: note = hyper
  source 1..299: mol_type = genomic DNA
caggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcaggtaccgtccctggccctca

SEQ ID NO: 17028 - DNA, 52 bp, Homo sapiens; identical to SEQ ID NO: 5503
  misc_feature 1..52: note = chr1:53168843-53168895
  misc_feature 1..52: note = hyper
  source 1..52: mol_type = genomic DNA

SEQ ID NO: 17029 - skipped

SEQ ID NO: 17030 - DNA, 27 bp, Homo sapiens
  misc_feature 1..27: note = chr1:53309248-53309275
  misc_feature 1..27: note = hyper
  source 1..27: mol_type = genomic DNA
cccagcctttgccgaatgcctgttact

SEQ ID NO: 17031 - DNA, 30 bp, Homo sapiens; identical to SEQ ID NO: 5506
  misc_feature 1..30: note = chr1:53527576-53527606
  misc_feature 1..30: note = hyper
  source 1..30: mol_type = genomic DNA

SEQ ID NO: 17032 - DNA, 92 bp, Homo sapiens; identical to SEQ ID NO: 5507
  misc_feature 1..92: note = chr1:53527939-53528031
  misc_feature 1..92: note = hyper
  source 1..92: mol_type = genomic DNA

SEQ ID NO: 17033 - DNA, 119 bp, Homo sapiens
  misc_feature 1..119: note = chr1:53528255-53528374
  misc_feature 1..119: note = hyper
  source 1..119: mol_type = genomic DNA
gaaagaatctgagggcggttgggggcgggggctggagtgggaggacgccggcgggcgacagggaatgtggggggcaggtggaactgcgtaggggcggggacccctgtcatgagagcctg

SEQ ID NO: 17034 - DNA, 135 bp, Homo sapiens; identical to SEQ ID NO: 5510
  misc_feature 1..135: note = chr1:55462748-55462883
  misc_feature 1..135: note = hyper
  source 1..135: mol_type = genomic DNA

SEQ ID NO: 17035 - DNA, 30 bp, Homo sapiens; identical to SEQ ID NO: 5511
  misc_feature 1..30: note = chr1:57111203-57111233
  misc_feature 1..30: note = hyper
  source 1..30: mol_type = genomic DNA

SEQ ID NO: 17036 - DNA, 40 bp, Homo sapiens
  misc_feature 1..40: note = chr1:57888327-57888367
  misc_feature 1..40: note = hyper
  source 1..40: mol_type = genomic DNA
ctctcccagcctaagcggaagtgccccagcagacccccaa

SEQ ID NO: 17037 - DNA, 207 bp, Homo sapiens
  misc_feature 1..207: note = chr1:57888780-57888987
  misc_feature 1..207: note = hyper
  source 1..207: mol_type = genomic DNA
gcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagag

SEQ ID NO: 17038 - DNA, 16 bp, Homo sapiens
  misc_feature 1..16: note = chr1:57889087-57889103
  misc_feature 1..16: note = hyper
  source 1..16: mol_type = genomic DNA
tcgaagccgaatctca

SEQ ID NO: 17039 - DNA, 280 bp, Homo sapiens
  misc_feature 1..280: note = chr1:57889654-57889934
  misc_feature 1..280: note = hyper
  source 1..280: mol_type = genomic DNA
tccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccgggg

SEQ ID NO: 17040 - DNA, 64 bp, Homo sapiens
  misc_feature 1..64: note = chr1:57890367-57890431
  misc_feature 1..64: note = hyper
  source 1..64: mol_type = genomic DNA
gcaggagggggcgctcgctcccagccgccagtgcaggttcggcggctcctgttttgactgaggt

SEQ ID NO: 17041 - DNA, 400 bp, Homo sapiens; identical to SEQ ID NO: 5521
  misc_feature 1..400: note = chr1:59042095-59042495
  misc_feature 1..400: note = hyper
  source 1..400: mol_type = genomic DNA

SEQ ID NO: 17042 - DNA, 30 bp, Homo sapiens; identical to SEQ ID NO: 5522
  misc_feature 1..30: note = chr1:62784565-62784595
  misc_feature 1..30: note = hyper
  source 1..30: mol_type = genomic DNA

SEQ ID NO: 17043 - DNA, 256 bp, Homo sapiens; identical to SEQ ID NO: 5523
  misc_feature 1..256: note = chr1:62784890-62785146
  misc_feature 1..256: note = hyper
  source 1..256: mol_type = genomic DNA

SEQ ID NO: 17044 - DNA, 32 bp, Homo sapiens; identical to SEQ ID NO: 5525
  misc_feature 1..32: note = chr1:63784373-63784405
  misc_feature 1..32: note = hyper
  source 1..32: mol_type = genomic DNA

SEQ ID NO: 17045 - DNA, 306 bp, Homo sapiens; identical to SEQ ID NO: 56
  misc_feature 1..306: note = chr1:63784987-63785293
  misc_feature 1..306: note = hyper
  source 1..306: mol_type = genomic DNA

SEQ ID NO: 17046 - DNA, 102 bp, Homo sapiens; identical to SEQ ID NO: 1737
  misc_feature 1..102: note = chr1:63786656-63786758
  misc_feature 1..102: note = hyper
  source 1..102: mol_type = genomic DNA

SEQ ID NO: 17047 - DNA, 42 bp, Homo sapiens
  misc_feature 1..42: note = chr1:63787568-63787610
  misc_feature 1..42: note = hyper
  source 1..42: mol_type = genomic DNA
atacaggaaaacacgcccgcatcaagccgggaaagagcaggt

SEQ ID NO: 17048 - DNA, 64 bp, Homo sapiens
  misc_feature 1..64: note = chr1:63788359-63788423
  misc_feature 1..64: note = hyper
  source 1..64: mol_type = genomic DNA
cctggaccgctcctgcgccccacgccagggccagaggccgaggaaggcgggctaagtgaggggg

SEQ ID NO: 17049 - DNA, 117 bp, Homo sapiens
  misc_feature 1..117: note = chr1:63788557-63788674
  misc_feature 1..117: note = hyper
  source 1..117: mol_type = genomic DNA
gagtgtgagctgagcccagcgggccccaagccacctgcggccccctcccctctccctgccccccatctttcgggggcactcaaaccctcttcccctgagctccgtggcagcccccga

SEQ ID NO: 17050 - DNA, 106 bp, Homo sapiens
  misc_feature 1..106: note = chr1:65731231-65731337
  misc_feature 1..106: note = hyper
  source 1..106: mol_type = genomic DNA
gggggaagagagaaacgaatttaaataaaaactcaaaaaaggaaagggctaaccgaaaaatgagccaaccaaattttaagttcaacaacaagcattctggaggatt

SEQ ID NO: 17051 - DNA, 60 bp, Homo sapiens
  misc_feature 1..60: note = chr1:65731446-65731506
  misc_feature 1..60: note = hyper
  source 1..60: mol_type = genomic DNA
ggggagcccttccttcctattgcgctggtcgtgctcctggcccgcgtgcccaggaagggc

SEQ ID NO: 17052 - DNA, 125 bp, Homo sapiens
  misc_feature 1..125: note = chr1:65991321-65991446
  misc_feature 1..125: note = hyper
  source 1..125: mol_type = genomic DNA
acctccccacgcactcggctgccctcctcctctcctgagagttgccccgcaccttgggcgaggagttcggagcggccccatcgcagagcccacggccagccgagcgcgcgcgacgcaggtgcccg

SEQ ID NO: 17053 - DNA, 139 bp, Homo sapiens; identical to SEQ ID NO: 5545
  misc_feature 1..139: note = chr1:66259292-66259431
  misc_feature 1..139: note = hyper
  source 1..139: mol_type = genomic DNA

SEQ ID NO: 17054 - DNA, 43 bp, Homo sapiens; identical to SEQ ID NO: 5547
  misc_feature 1..43: note = chr1:66999572-66999615
  misc_feature 1..43: note = hyper
  source 1..43: mol_type = genomic DNA

SEQ ID NO: 17055 - DNA, 99 bp, Homo sapiens
  misc_feature 1..99: note = chr1:67217965-67218064
  misc_feature 1..99: note = hyper
  source 1..99: mol_type = genomic DNA
agttcccctccagctcgccgccaacccaggacgcagcccggctcagagtgacccccagtgggcagtgaagatgagatcctctacatccttagggcagct

SEQ ID NO: 17056 - DNA, 39 bp, Homo sapiens; identical to SEQ ID NO: 5550
  misc_feature 1..39: note = chr1:70033537-70033576
  misc_feature 1..39: note = hyper
  source 1..39: mol_type = genomic DNA

SEQ ID NO: 17057 - DNA, 470 bp, Homo sapiens
  misc_feature 1..470: note = chr1:70033989-70034459
  misc_feature 1..470: note = hyper
  source 1..470: mol_type = genomic DNA
cggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgc

SEQ ID NO: 17058 - DNA, 48 bp, Homo sapiens; identical to SEQ ID NO: 5554
  misc_feature 1..48: note = chr1:71513699-71513747
  misc_feature 1..48: note = hyper
  source 1..48: mol_type = genomic DNA

SEQ ID NO: 17059 - DNA, 76 bp, Homo sapiens; identical to SEQ ID NO: 5555
  misc_feature 1..76: note = chr1:72747951-72748027
  misc_feature 1..76: note = hyper
  source 1..76: mol_type = genomic DNA

SEQ ID NO: 17060 - DNA, 158 bp, Homo sapiens; identical to SEQ ID NO: 5556
  misc_feature 1..158: note = chr1:72750097-72750255
  misc_feature 1..158: note = hyper
  source 1..158: mol_type = genomic DNA

SEQ ID NO: 17061 - DNA, 30 bp, Homo sapiens; identical to SEQ ID NO: 5557
  misc_feature 1..30: note = chr1:72750522-72750552
  misc_feature 1..30: note = hyper
  source 1..30: mol_type = genomic DNA

SEQ ID NO: 17062 - DNA, 30 bp, Homo sapiens; identical to SEQ ID NO: 5558
  misc_feature 1..30: note = chr1:75595334-75595364
  misc_feature 1..30: note = hyper
  source 1..30: mol_type = genomic DNA

SEQ ID NO: 17063 - DNA, 22 bp, Homo sapiens
  misc_feature 1..22: note = chr1:75600203-75600225
  misc_feature 1..22: note = hyper
  source 1..22: mol_type = genomic DNA
cttttattagtggatcggggcg

SEQ ID NO: 17064 - DNA, 77 bp, Homo sapiens
  misc_feature 1..77: note = chr1:75600848-75600925
  misc_feature 1..77: note = hyper
  source 1..77: mol_type = genomic DNA
acctaaaatgccaaaagaaaaccgcagggcacaaaacgagtcacgcggtttgtctgagtagactggggaagctgaca

SEQ ID NO: 17065 - DNA, 107 bp, Homo sapiens
  misc_feature 1..107: note = chr1:75603052-75603159
  misc_feature 1..107: note = hyper
  source 1..107: mol_type = genomic DNA
tgaaggttgtaggcttttgcagaaaatcagcccagtttagggcaactcatgcggtgggataaagtgagaagaaatcccagactcttctatgtcgttgcaaaacagct

SEQ ID NO: 17066 - DNA, 206 bp, Homo sapiens
  misc_feature 1..206: note = chr1:76080278-76080484
  misc_feature 1..206: note = hyper
  source 1..206: mol_type = genomic DNA
gaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcct

SEQ ID NO: 17067 - DNA, 190 bp, Homo sapiens
  misc_feature 1..190: note = chr1:76080768-76080958
  misc_feature 1..190: note = hyper
  source 1..190: mol_type = genomic DNA
aagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggag

SEQ ID NO: 17068 - DNA, 169 bp, Homo sapiens
  misc_feature 1..169: note = chr1:76082209-76082378
  misc_feature 1..169: note = hyper
  source 1..169: mol_type = genomic DNA
accagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 17069 - DNA, 30 bp, Homo sapiens; identical to SEQ ID NO: 5573
  misc_feature 1..30: note = chr1:76540210-76540240
  misc_feature 1..30: note = hyper
  source 1..30: mol_type = genomic DNA

SEQ ID NO: 17070 - DNA, 30 bp, Homo sapiens; identical to SEQ ID NO: 5576
  misc_feature 1..30: note = chr1:77333003-77333033
  misc_feature 1..30: note = hyper
  source 1..30: mol_type = genomic DNA

SEQ ID NO: 17071 - DNA, 54 bp, Homo sapiens; identical to SEQ ID NO: 5580
  misc_feature 1..54: note = chr1:77334828-77334882
  misc_feature 1..54: note = hyper
  source 1..54: mol_type = genomic DNA

SEQ ID NO: 17072 - DNA, 59 bp, Homo sapiens
  misc_feature 1..59: note = chr1:77747307-77747366
  misc_feature 1..59: note = hyper
  source 1..59: mol_type = genomic DNA
agttcctcggagacccggaggtaaccgtgtatgtgcgtgcgagtgtgtctgtgtgcgta

SEQ ID NO: 17073 - DNA, 273 bp, Homo sapiens
  misc_feature 1..273: note = chr1:77747453-77747726
  misc_feature 1..273: note = hyper
  source 1..273: mol_type = genomic DNA
tgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcc

SEQ ID NO: 17074 - DNA, 318 bp, Homo sapiens; identical to SEQ ID NO: 5583
  misc_feature 1..318: note = chr1:77748403-77748721
  misc_feature 1..318: note = hyper
  source 1..318: mol_type = genomic DNA

SEQ ID NO: 17075 - DNA, 178 bp, Homo sapiens; identical to SEQ ID NO: 5584
  misc_feature 1..178: note = chr1:78354744-78354922
  misc_feature 1..178: note = hyper
  source 1..178: mol_type = genomic DNA

SEQ ID NO: 17076 - DNA, 13 bp, Homo sapiens
  misc_feature 1..13: note = chr1:78511453-78511466
  misc_feature 1..13: note = hyper
  source 1..13: mol_type = genomic DNA
attgttctgtagc

SEQ ID NO: 17077 - DNA, 61 bp, Homo sapiens
  misc_feature 1..61: note = chr1:78957231-78957292
  misc_feature 1..61: note = hyper
  source 1..61: mol_type = genomic DNA
cacgtcctcactccccgtgcccgggatgagggagaaaacagccctttggcgtttgagcaat

SEQ ID NO: 17078 - DNA, 30 bp, Homo sapiens; identical to SEQ ID NO: 5588
  misc_feature 1..30: note = chr1:82267630-82267660
  misc_feature 1..30: note = hyper
  source 1..30: mol_type = genomic DNA

SEQ ID NO: 17079 - DNA, 49 bp, Homo sapiens; identical to SEQ ID NO: 5589
  misc_feature 1..49: note = chr1:82267942-82267991
  misc_feature 1..49: note = hyper
  source 1..49: mol_type = genomic DNA

SEQ ID NO: 17080 - DNA, 30 bp, Homo sapiens; identical to SEQ ID NO: 5590
  misc_feature 1..30: note = chr1:82268226-82268256
  misc_feature 1..30: note = hyper
  source 1..30: mol_type = genomic DNA

SEQ ID NO: 17081 - DNA, 132 bp, Homo sapiens; identical to SEQ ID NO: 5591
  misc_feature 1..132: note = chr1:85358461-85358593
  misc_feature 1..132: note = hyper
  source 1..132: mol_type = genomic DNA

SEQ ID NO: 17082 - DNA, 59 bp, Homo sapiens; identical to SEQ ID NO: 5593
  misc_feature 1..59: note = chr1:85359218-85359277
  misc_feature 1..59: note = hyper
  source 1..59: mol_type = genomic DNA

SEQ ID NO: 17083 - DNA, 69 bp, Homo sapiens; identical to SEQ ID NO: 5594
  misc_feature 1..69: note = chr1:85463878-85463947
  misc_feature 1..69: note = hyper
  source 1..69: mol_type = genomic DNA

SEQ ID NO: 17084 - DNA, 80 bp, Homo sapiens
  misc_feature 1..80: note = chr1:86621580-86621660
  misc_feature 1..80: note = hyper
  source 1..80: mol_type = genomic DNA
tagcgtcacagcaatcgccaggctggacgccctgagaagcacctcggggaagcaggacctcgacagggccctgcgggagg

SEQ ID NO: 17085 - DNA, 18 bp, Homo sapiens
  misc_feature 1..18: note = chr1:87617807-87617825
  misc_feature 1..18: note = hyper
  source 1..18: mol_type = genomic DNA
tctcgggaggggaaggcg

SEQ ID NO: 17086 - DNA, 147 bp, Homo sapiens; identical to SEQ ID NO: 5599
  misc_feature 1..147: note = chr1:91176423-91176570
  misc_feature 1..147: note = hyper
  source 1..147: mol_type = genomic DNA

SEQ ID NO: 17087 - DNA, 45 bp, Homo sapiens; identical to SEQ ID NO: 5600
  misc_feature 1..45: note = chr1:91176908-91176953
  misc_feature 1..45: note = hyper
  source 1..45: mol_type = genomic DNA

SEQ ID NO: 17088 - DNA, 101 bp, Homo sapiens
  misc_feature 1..101: note = chr1:91177840-91177941
  misc_feature 1..101: note = hyper
  source 1..101: mol_type = genomic DNA
ggattgcagtgccttcgctgcaatgttttcaccgggggtgtggggtgcctgggatggggctggacaatggattaagggctggctgtcccccaggccctagg

SEQ ID NO: 17089 - DNA, 50 bp, Homo sapiens
  misc_feature 1..50: note = chr1:91178207-91178257
  misc_feature 1..50: note = hyper
  source 1..50: mol_type = genomic DNA
ccagcagctgtgggcatggtccaggcaccaagacccggccccttctctgg

SEQ ID NO: 17090 - DNA, 125 bp, Homo sapiens
  misc_feature 1..125: note = chr1:91181807-91181932
  misc_feature 1..125: note = hyper
  source 1..125: mol_type = genomic DNA
catcccttttatcaacgaaaagtatttcctgtcggatgccctccgccgcccctcaacccccagtagattaaaattaaataaaacaaaggaaggagctggatggccgtgaaggttgtggggtagaa

SEQ ID NO: 17091 - DNA, 18 bp, Homo sapiens
  misc_feature 1..18: note = chr1:91182320-91182338
  misc_feature 1..18: note = hyper
  source 1..18: mol_type = genomic DNA
aattaaaaaagaagacgt

SEQ ID NO: 17092 - DNA, 30 bp, Homo sapiens; identical to SEQ ID NO: 5605
  misc_feature 1..30: note = chr1:91183775-91183805
  misc_feature 1..30: note = hyper
  source 1..30: mol_type = genomic DNA

SEQ ID NO: 17093 - DNA, 139 bp, Homo sapiens; identical to SEQ ID NO: 1759
  misc_feature 1..139: note = chr1:91184274-91184413
  misc_feature 1..139: note = hyper
  source 1..139: mol_type = genomic DNA

SEQ ID NO: 17094 - skipped

SEQ ID NO: 17095 - DNA, 30 bp, Homo sapiens; identical to SEQ ID NO: 5608
  misc_feature 1..30: note = chr1:91184823-91184853
  misc_feature 1..30: note = hyper
  source 1..30: mol_type = genomic DNA

SEQ ID NO: 17096 - DNA, 81 bp, Homo sapiens
  misc_feature 1..81: note = chr1:91189383-91189464
  misc_feature 1..81: note = hyper
  source 1..81: mol_type = genomic DNA
agagctcccgcaaagcggggggatgtgacctgtgggcccccagcaggggtaggaggcagttcagcccgagagggggcgctc

SEQ ID NO: 17097 - DNA, 26 bp, Homo sapiens
  misc_feature 1..26: note = chr1:91190380-91190406
  misc_feature 1..26: note = hyper
  source 1..26: mol_type = genomic DNA
cacattaaaaccgtagtgtgtcccta

SEQ ID NO: 17098 - DNA, 228 bp, Homo sapiens
  misc_feature 1..228: note = chr1:91191310-91191538
  misc_feature 1..228: note = hyper
  source 1..228: mol_type = genomic DNA
agctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctg

SEQ ID NO: 17099 - DNA, 54 bp, Homo sapiens; identical to SEQ ID NO: 74
  misc_feature 1..54: note = chr1:91192681-91192735
  misc_feature 1..54: note = hyper
  source 1..54: mol_type = genomic DNA

SEQ ID NO: 17100 - DNA, 71 bp, Homo sapiens; identical to SEQ ID NO: 5620
  misc_feature 1..71: note = chr1:91194749-91194820
  misc_feature 1..71: note = hyper
  source 1..71: mol_type = genomic DNA

SEQ ID NO: 17101 - DNA, 19 bp, Homo sapiens
  misc_feature 1..19: note = chr1:91316313-91316332
  misc_feature 1..19: note = hyper
  source 1..19: mol_type = genomic DNA
tcctcgggctttagttcag

SEQ ID NO: 17102 - DNA, 73 bp, Homo sapiens
  misc_feature 1..73: note = chr1:91316682-91316755
  misc_feature 1..73: note = hyper
  source 1..73: mol_type = genomic DNA
tcgcctggctgcgccgtcccggcgggccggccctctccacgccctctcctggggtttgcggtgggcacagctc

SEQ ID NO: 17103 - DNA, 39 bp, Homo sapiens; identical to SEQ ID NO: 5626
  misc_feature 1..39: note = chr1:92495704-92495743
  misc_feature 1..39: note = hyper
  source 1..39: mol_type = genomic DNA

SEQ ID NO: 17104 - DNA, 24 bp, Homo sapiens
  misc_feature 1..24: note = chr1:92948817-92948841
  misc_feature 1..24: note = hyper
  source 1..24: mol_type = genomic DNA
cagcagcaaaagggacgttggggc

SEQ ID NO: 17105 - DNA, 280 bp, Homo sapiens
  misc_feature 1..280: note = chr1:92948976-92949256
  misc_feature 1..280: note = hyper
  source 1..280: mol_type = genomic DNA
ggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacg

SEQ ID NO: 17106 - DNA, 41 bp, Homo sapiens; identical to SEQ ID NO: 5629
  misc_feature 1..41: note = chr1:92949786-92949827
  misc_feature 1..41: note = hyper
  source 1..41: mol_type = genomic DNA

SEQ ID NO: 17107 - DNA, 75 bp, Homo sapiens; identical to SEQ ID NO: 5630
  misc_feature 1..75: note = chr1:92950099-92950174
  misc_feature 1..75: note = hyper
  source 1..75: mol_type = genomic DNA

SEQ ID NO: 17108 - DNA, 182 bp, Homo sapiens; identical to SEQ ID NO: 5631
  misc_feature 1..182: note = chr1:92950668-92950850
  misc_feature 1..182: note = hyper
  source 1..182: mol_type = genomic DNA

SEQ ID NO: 17109 - DNA, 215 bp, Homo sapiens; identical to SEQ ID NO: 5632
  misc_feature 1..215: note = chr1:92951530-92951745
  misc_feature 1..215: note = hyper
  source 1..215: mol_type = genomic DNA

SEQ ID NO: 17110 - DNA, 30 bp, Homo sapiens
  misc_feature 1..30: note = chr1:98510761-98510791
  misc_feature 1..30: note = hyper
  source 1..30: mol_type = genomic DNA
acctgagaggggggacgtgccttgcgtttg

SEQ ID NO: 17111 - DNA, 269 bp, Homo sapiens
  misc_feature 1..269: note = chr1:98511359-98511628
  misc_feature 1..269: note = hyper
  source 1..269: mol_type = genomic DNA
ggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgc

SEQ ID NO: 17112 - DNA, 16 bp, Homo sapiens
  misc_feature 1..16: note = chr1:98515071-98515087
  misc_feature 1..16: note = hyper
  source 1..16: mol_type = genomic DNA
gggaagggacctcggc

SEQ ID NO: 17113 - DNA, 54 bp, Homo sapiens
  misc_feature 1..54: note = chr1:98515088-98515142
  misc_feature 1..54: note = hyper
  source 1..54: mol_type = genomic DNA
cctcgcgctggctgtgccccagtgccttcgcgtggtggcggcttgctcatgctt

SEQ ID NO: 17114 - DNA, 30 bp, Homo sapiens; identical to SEQ ID NO: 5639
  misc_feature 1..30: note = chr1:99469618-99469648
  misc_feature 1..30: note = hyper
  source 1..30: mol_type = genomic DNA

SEQ ID NO: 17115 - DNA, 44 bp, Homo sapiens; identical to SEQ ID NO: 5640
  misc_feature 1..44: note = chr1:99469930-99469974
  misc_feature 1..44: note = hyper
  source 1..44: mol_type = genomic DNA

SEQ ID NO: 17116 - DNA, 255 bp, Homo sapiens; identical to SEQ ID NO: 5641
  misc_feature 1..255: note = chr1:99470275-99470530
  misc_feature 1..255: note = hyper
  source 1..255: mol_type = genomic DNA

SEQ ID NO: 17117 - DNA, 36 bp, Homo sapiens; identical to SEQ ID NO: 5642
  misc_feature 1..36: note = chr1:99470582-99470618
  misc_feature 1..36: note = hyper
  source 1..36: mol_type = genomic DNA

SEQ ID NO: 17118 - DNA, 166 bp, Homo sapiens; identical to SEQ ID NO: 5643
  misc_feature 1..166: note = chr1:99470619-99470785
  misc_feature 1..166: note = hyper
  source 1..166: mol_type = genomic DNA

SEQ ID NO: 17119 - DNA, 80 bp, Homo sapiens
  misc_feature 1..80: note = chr1:101004737-101004817
  misc_feature 1..80: note = hyper
  source 1..80: mol_type = genomic DNA
cggctgcgccgccgacctcagcgtctgcgccctctggatgccgcaggaggcggtgctcgggctcctgcccaccggctctg

SEQ ID NO: 17120 - DNA, 216 bp, Homo sapiens
  misc_feature 1..216: note = chr1:101005144-101005360
  misc_feature 1..216: note = hyper
  source 1..216: mol_type = genomic DNA
tgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggc

SEQ ID NO: 17121 - DNA, 49 bp, Homo sapiens
  misc_feature 1..49: note = chr1:101005675-101005724
  misc_feature 1..49: note = hyper
  source 1..49: mol_type = genomic DNA
aacctagccggggcccgagggaagcggagatccccggcttccgacgtcc

SEQ ID NO: 17122 - DNA, 142 bp, Homo sapiens
  misc_feature 1..142: note = chr1:101702616-101702758
  misc_feature 1..142: note = hyper
  source 1..142: mol_type = genomic DNA
ccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaa

SEQ ID NO: 17123 - DNA, 30 bp, Homo sapiens; identical to SEQ ID NO: 5648
  misc_feature 1..30: note = chr1:101703188-101703218
  misc_feature 1..30: note = hyper
  source 1..30: mol_type = genomic DNA

SEQ ID NO: 17124 - DNA, 13 bp, Homo sapiens
  misc_feature 1..13: note = chr1:101703599-101703612
  misc_feature 1..13: note = hyper
  source 1..13: mol_type = genomic DNA
gaaagaaaaggca

SEQ ID NO: 17125 - DNA, 226 bp, Homo sapiens; identical to SEQ ID NO: 5650
  misc_feature 1..226: note = chr1:101775150-101775376
  misc_feature 1..226: note = hyper
  source 1..226: mol_type = genomic DNA

SEQ ID NO: 17126 - DNA, 60 bp, Homo sapiens; identical to SEQ ID NO: 5651
  misc_feature 1..60: note = chr1:103572677-103572737
  misc_feature 1..60: note = hyper
  source 1..60: mol_type = genomic DNA

SEQ ID NO: 17127 - DNA, 281 bp, Homo sapiens; identical to SEQ ID NO: 5652
  misc_feature 1..281: note = chr1:103573722-103574003
  misc_feature 1..281: note = hyper
  source 1..281: mol_type = genomic DNA

SEQ ID NO: 17128 - DNA, 77 bp, Homo sapiens
  misc_feature 1..77: note = chr1:107682658-107682735
  misc_feature 1..77: note = hyper
  source 1..77: mol_type = genomic DNA
cttctgtggaggagccgggggggatggggagtagagggagggggccctgttgcctcagcgccccgaggtcgtggagc

SEQ ID NO: 17129 - DNA, 268 bp, Homo sapiens
  misc_feature 1..268: note = chr1:107683171-107683439
  misc_feature 1..268: note = hyper
  source 1..268: mol_type = genomic DNA
ttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctc

SEQ ID NO: 17130 - DNA, 258 bp, Homo sapiens
  misc_feature 1..258: note = chr1:107683517-107683775
  misc_feature 1..258: note = hyper
  source 1..258: mol_type = genomic DNA
gctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggc

SEQ ID NO: 17131 - DNA, 13 bp, Homo sapiens
  misc_feature 1..13: note = chr1:107683776-107683789
  misc_feature 1..13: note = hyper
  source 1..13: mol_type = genomic DNA
gggagtggcgggc

SEQ ID NO: 17132 - DNA, 436 bp, Homo sapiens
  misc_feature 1..436: note = chr1:108506627-108507063
  misc_feature 1..436: note = hyper
  source 1..436: mol_type = genomic DNA
cttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctc

SEQ ID NO: 17133 - DNA, 172 bp, Homo sapiens
  misc_feature 1..172: note = chr1:108507148-108507320
  misc_feature 1..172: note = hyper
  source 1..172: mol_type = genomic DNA
cgaagtggtcccaaagcagaaggctgggaagcagggcaagctcagcgcacctagacgtttgcatttacacaaagaaattagccgcatgattaatgggagctgccggctggaggcggggcgcccgtgccggcctcctcacctgggacatctgcggcctcaggttgatctcctt

SEQ ID NO: 17134 - DNA, 110 bp, Homo sapiens
  misc_feature 1..110: note = chr1:108507497-108507607
  misc_feature 1..110: note = hyper
  source 1..110: mol_type = genomic DNA
cggctccgggacgcggctgggccggggcgggcggcaaggatgcggccgccgccgccgccgccgcggttcctccgcgccccgccgacgccaacagccgccggccctttccc

SEQ ID NO: 17135 - DNA, 60 bp, Homo sapiens
  misc_feature 1..60: note = chr1:108507657-108507717
  misc_feature 1..60: note = hyper
  source 1..60: mol_type = genomic DNA
cgctaggctcggctccggtcccggcccgggtgcgccgcgacccggccgccgctgcagcga

SEQ ID NO: 17136 - DNA, 242 bp, Homo sapiens
  misc_feature 1..242: note = chr1:108507810-108508052
  misc_feature 1..242: note = hyper
  source 1..242: mol_type = genomic DNA
ccagcacgccggccggtctcgctgcggtccgcaagtccccagacgcgcgggtgggagcgcgccggcggccggggctggggtctgtggccgagggcggggcgcgggggaggggccggcggaggggggcggcggccagaaaggggatcccgcgcccccgcctgcagccttgcggggctcacgcagcccccggcgtcctggggtcttctctcggggcggcttcccggctttgcggggagtgtggc

SEQ ID NO: 17137 - DNA, 537 bp, Homo sapiens
  misc_feature 1..537: note = chr1:109203672-109204209
  misc_feature 1..537: note = hyper
  source 1..537: mol_type = genomic DNA
gcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcgg

SEQ ID NO: 17138 - DNA, 66 bp, Homo sapiens; identical to SEQ ID NO: 5664
  misc_feature 1..66: note = chr1:109656914-109656980
  misc_feature 1..66: note = hyper
  source 1..66: mol_type = genomic DNA

SEQ ID NO: 17139 - DNA, 97 bp, Homo sapiens; identical to SEQ ID NO: 5665
  misc_feature 1..97: note = chr1:110009644-110009741
  misc_feature 1..97: note = hyper
  source 1..97: mol_type = genomic DNA

SEQ ID NO: 17140 - DNA, 42 bp, Homo sapiens; identical to SEQ ID NO: 5666
  misc_feature 1..42: note = chr1:110283094-110283136
  misc_feature 1..42: note = hyper
  source 1..42: mol_type = genomic DNA

SEQ ID NO: 17141 - skipped

SEQ ID NO: 17142 - DNA, 35 bp, Homo sapiens
  misc_feature 1..35: note = chr1:110627578-110627613
  misc_feature 1..35: note = hyper
  source 1..35: mol_type = genomic DNA
ttctaacaccgcgtgatcaccgacaacttttgcag

SEQ ID NO: 17143 - DNA, 54 bp, Homo sapiens
  misc_feature 1..54: note = chr1:110673233-110673287
  misc_feature 1..54: note = hyper
  source 1..54: mol_type = genomic DNA
ggcctaaaatgagggaagatgaggaaatgggggtggggacgatggagaggatgg

SEQ ID NO: 17144 - DNA, 71 bp, Homo sapiens
  misc_feature 1..71: note = chr1:110692902-110692973
  misc_feature 1..71: note = hyper
  source 1..71: mol_type = genomic DNA
gggcagaagccctggcgagggctccagggtctgcatcccctgaccaggggcctcaagaagctaagccccct

SEQ ID NO: 17145 - DNA, 52 bp, Homo sapiens
  misc_feature 1..52: note = chr1:110694117-110694169
  misc_feature 1..52: note = hyper
  source 1..52: mol_type = genomic DNA
aggggacgtgcgtgtggtgcccatctggagggggcgccgtcctggcgggtcg

SEQ ID NO: 17146 - DNA, 244 bp, Homo sapiens
  misc_feature 1..244: note = chr1:111097952-111098196
  misc_feature 1..244: note = hyper
  source 1..244: mol_type = genomic DNA
ataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgc

SEQ ID NO: 17147 - DNA, 51 bp, Homo sapiens; identical to SEQ ID NO: 5679
  misc_feature 1..51: note = chr1:111149588-111149639
  misc_feature 1..51: note = hyper
  source 1..51: mol_type = genomic DNA

SEQ ID NO: 17148 - DNA, 29 bp, Homo sapiens
  misc_feature 1..29: note = chr1:111216734-111216763
  misc_feature 1..29: note = hyper
  source 1..29: mol_type = genomic DNA
ccggcccggagctctcggggtactcgaag

SEQ ID NO: 17149 - DNA, 34 bp, Homo sapiens
  misc_feature 1..34: note = chr1:111217982-111218016
  misc_feature 1..34: note = hyper
  source 1..34: mol_type = genomic DNA
cacacccctaggtacagcccggggagggcaggcg

SEQ ID NO: 17150 - DNA, 96 bp, Homo sapiens
  misc_feature 1..96: note = chr1:111506212-111506308
  misc_feature 1..96: note = hyper
  source 1..96: mol_type = genomic DNA
ccgtggggaggattcgaaaccggtacttaccaacgcgaggcgttgcctgaattttcctctgcgggtttcaggaagaccctccgtaggttatttgac

SEQ ID NO: 17151 - DNA, 18 bp, Homo sapiens
  misc_feature 1..18: note = chr1:112283344-112283362
  misc_feature 1..18: note = hyper
  source 1..18: mol_type = genomic DNA
agcactttgagaggccga

SEQ ID NO: 17152 - DNA, 36 bp, Homo sapiens; identical to SEQ ID NO: 5687
  misc_feature 1..36: note = chr1:112531573-112531609
  misc_feature 1..36: note = hyper
  source 1..36: mol_type = genomic DNA

SEQ ID NO: 17153 - DNA, 110 bp, Homo sapiens
  misc_feature 1..110: note = chr1:114695329-114695439
  misc_feature 1..110: note = hyper
  source 1..110: mol_type = genomic DNA
gagacgccgcagctgcgcgccagggtccagcccggcggggatcgggctcgggactcacccgctccggcgagctcgactcagctcgggctcccgcctcggctaggcagccg

SEQ ID NO: 17154 - DNA, 166 bp, Homo sapiens
  misc_feature 1..166: note = chr1:114695943-114696109
  misc_feature 1..166: note = hyper
  source 1..166: mol_type = genomic DNA
ccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctccca

SEQ ID NO: 17155 - DNA, 56 bp, Homo sapiens
  misc_feature 1..56: note = chr1:115880128-115880184
  misc_feature 1..56: note = hyper
  source 1..56: mol_type = genomic DNA
agggctgaaccttggcgacctctacctgaggttgtccaacgcggctccgtggaggg

SEQ ID NO: 17156 - skipped

SEQ ID NO: 17157 - DNA, 117 bp, Homo sapiens; identical to SEQ ID NO: 5695
  misc_feature 1..117: note = chr1:115880678-115880795
  misc_feature 1..117: note = hyper
  source 1..117: mol_type = genomic DNA

SEQ ID NO: 17158 - DNA, 90 bp, Homo sapiens
  misc_feature 1..90: note = chr1:116371049-116371139
  misc_feature 1..90: note = hyper
  source 1..90: mol_type = genomic DNA
ggcgtcctgagagtgcgtgcgtgagcgagcgagcggcttatcctagactgaagacccagggaaacagatctgtgtggaggatgtttctgt

SEQ ID NO: 17159 - DNA, 93 bp, Homo sapiens; identical to SEQ ID NO: 5698
  misc_feature 1..93: note = chr1:116371436-116371529
  misc_feature 1..93: note = hyper
  source 1..93: mol_type = genomic DNA

SEQ ID NO: 17160 - DNA, 70 bp, Homo sapiens; identical to SEQ ID NO: 5699
  misc_feature 1..70: note = chr1:116380312-116380382
  misc_feature 1..70: note = hyper
  source 1..70: mol_type = genomic DNA

SEQ ID NO: 17161 - DNA, 75 bp, Homo sapiens; identical to SEQ ID NO: 5701
  misc_feature 1..75: note = chr1:116381534-116381609
  misc_feature 1..75: note = hyper
  source 1..75: mol_type = genomic DNA

SEQ ID NO: 17162 - DNA, 35 bp, Homo sapiens; identical to SEQ ID NO: 5702
  misc_feature 1..35: note = chr1:116381836-116381871
  misc_feature 1..35: note = hyper
  source 1..35: mol_type = genomic DNA

SEQ ID NO: 17163 - DNA, 20 bp, Homo sapiens
  misc_feature 1..20: note = chr1:116382478-116382498
  misc_feature 1..20: note = hyper
  source 1..20: mol_type = genomic DNA
ctctacggcaaaataaaaac

SEQ ID NO: 17164 - DNA, 180 bp, Homo sapiens; identical to SEQ ID NO: 5704
  misc_feature 1..180: note = chr1:116711112-116711292
  misc_feature 1..180: note = hyper
  source 1..180: mol_type = genomic DNA

SEQ ID NO: 17165 - DNA, 15 bp, Homo sapiens
  misc_feature 1..15: note = chr1:119521978-119521993
  misc_feature 1..15: note = hyper
  source 1..15: mol_type = genomic DNA
cgtcacgatcccaca

SEQ ID NO: 17166 - DNA, 30 bp, Homo sapiens; identical to SEQ ID NO: 5708
  misc_feature 1..30: note = chr1:119528125-119528155
  misc_feature 1..30: note = hyper
  source 1..30: mol_type = genomic DNA

SEQ ID NO: 17167 - DNA, 32 bp, Homo sapiens; identical to SEQ ID NO: 5710
  misc_feature 1..32: note = chr1:119529378-119529410
  misc_feature 1..32: note = hyper
  source 1..32: mol_type = genomic DNA

SEQ ID NO: 17168 - DNA, 95 bp, Homo sapiens
  misc_feature 1..95: note = chr1:119530005-119530100
  misc_feature 1..95: note = hyper
  source 1..95: mol_type = genomic DNA
cgacgaaaatgcaaggctcagtccagccccaaaaattggttccggtgaatttagggaggctcagggcatttgcgcgaagaaacagaaacctatgt

SEQ ID NO: 17169 - skipped

SEQ ID NO: 17170 - DNA, 45 bp, Homo sapiens; identical to SEQ ID NO: 5716
  misc_feature 1..45: note = chr1:119535667-119535712
  misc_feature 1..45: note = hyper
  source 1..45: mol_type = genomic DNA

SEQ ID NO: 17171 - DNA, 28 bp, Homo sapiens
  misc_feature 1..28: note = chr1:119550278-119550306
  misc_feature 1..28: note = hyper
  source 1..28: mol_type = genomic DNA
tcttgttctttgacggggtggccctgtg

SEQ ID NO: 17172 - DNA, 29 bp, Homo sapiens
  misc_feature 1..29: note = chr1:119551269-119551298
  misc_feature 1..29: note = hyper
  source 1..29: mol_type = genomic DNA
aaggaaaacttctgcgacttcaagaacgt

SEQ ID NO: 17173 - DNA, 15 bp, Homo sapiens
  misc_feature 1..15: note = chr1:147775398-147775413
  misc_feature 1..15: note = hyper
  source 1..15: mol_type = genomic DNA
ggatgctgggtctga

SEQ ID NO: 17174 - DNA, 102 bp, Homo sapiens; identical to SEQ ID NO: 5723
  misc_feature 1..102: note = chr1:147775495-147775597
  misc_feature 1..102: note = hyper
  source 1..102: mol_type = genomic DNA

SEQ ID NO: 17175 - DNA, 76 bp, Homo sapiens; identical to SEQ ID NO: 5724
  misc_feature 1..76: note = chr1:150185869-150185945
  misc_feature 1..76: note = hyper
  source 1..76: mol_type = genomic DNA

SEQ ID NO: 17176 - DNA, 30 bp, Homo sapiens; identical to SEQ ID NO: 5725
  misc_feature 1..30: note = chr1:151689335-151689365
  misc_feature 1..30: note = hyper
  source 1..30: mol_type = genomic DNA

SEQ ID NO: 17177 - DNA, 55 bp, Homo sapiens
  misc_feature 1..55: note = chr1:151694351-151694406
  misc_feature 1..55: note = hyper
  source 1..55: mol_type = genomic DNA
acacatccgaccttagtaaaggcccctcatcctgaacaagcggcagaatgatatt

SEQ ID NO: 17178 - DNA, 30 bp, Homo sapiens; identical to SEQ ID NO: 5727
  misc_feature 1..30: note = chr1:152083749-152083779
  misc_feature 1..30: note = hyper
  source 1..30: mol_type = genomic DNA

SEQ ID NO: 17179 - DNA, 92 bp, Homo sapiens; identical to SEQ ID NO: 5728
  misc_feature 1..92: note = chr1:152084671-152084763
  misc_feature 1..92: note = hyper
  source 1..92: mol_type = genomic DNA

SEQ ID NO: 17180 - DNA, 340 bp, Homo sapiens
  misc_feature 1..340: note = chr1:152085058-152085398
  misc_feature 1..340: note = hyper
  source 1..340: mol_type = genomic DNA
ttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgctt

SEQ ID NO: 17181 - DNA, 129 bp, Homo sapiens; identical to SEQ ID NO: 5730
  misc_feature 1..129: note = chr1:152487828-152487957
  misc_feature 1..129: note = hyper
  source 1..129: mol_type = genomic DNA

SEQ ID NO: 17182 - DNA, 38 bp, Homo sapiens; identical to SEQ ID NO: 5731
  misc_feature 1..38: note = chr1:153438417-153438455
  misc_feature 1..38: note = hyper
  source 1..38: mol_type = genomic DNA

SEQ ID NO: 17183 - DNA, 67 bp, Homo sapiens
  misc_feature 1..67: note = chr1:153651898-153651965
  misc_feature 1..67: note = hyper
  source 1..67: mol_type = genomic DNA
gtgggagcacaaccccgctgtgttcctgggccccggctgcgtgtacgccgccgccccagtggggcgc

SEQ ID NO: 17184 - DNA, 15 bp, Homo sapiens
  misc_feature 1..15: note = chr1:154474763-154474778
  misc_feature 1..15: note = hyper
  source 1..15: mol_type = genomic DNA
tgctctttcctcctg

SEQ ID NO: 17185 - DNA, 81 bp, Homo sapiens; identical to SEQ ID NO: 95
  misc_feature 1..81: note = chr1:154474987-154475068
  misc_feature 1..81: note = hyper
  source 1..81: mol_type = genomic DNA

SEQ ID NO: 17186 - DNA, 13 bp, Homo sapiens
  misc_feature 1..13: note = chr1:154475531-154475544
  misc_feature 1..13: note = hyper
  source 1..13: mol_type = genomic DNA
ggatgccaggcga

SEQ ID NO: 17187 - DNA, 18 bp, Homo sapiens
  misc_feature 1..18: note = chr1:155043657-155043675
  misc_feature 1..18: note = hyper
  source 1..18: mol_type = genomic DNA
ccacgggagccgggctgg

SEQ ID NO: 17188 - DNA, 248 bp, Homo sapiens
  misc_feature 1..248: note = chr1:156215359-156215607
  misc_feature 1..248: note = hyper
  source 1..248: mol_type = genomic DNA
agttgagtgcggcggcaggcacaaagaactggtgcaggtggccgtgcagccaggaggccggcatggagtaggcggcataggggaaggcgcagcctgcggtgaggtgggggcgtgcagctgaggcctgaggggcgcgcccctatgtcccgcgtcccacccctcgccccgctccgggacgcccagaccccgcgctcccgcgcctgtccggctcacccagactgtagaggctgagcgcgccgtagtcgagg

SEQ ID NO: 17189 - DNA, 128 bp, Homo sapiens
  misc_feature 1..128: note = chr1:156357865-156357993
  misc_feature 1..128: note = hyper
  source 1..128: mol_type = genomic DNA
ttctccggaagcagccgctgttctggcttggcgcaagtgcgtgtggacgacagcaggatttcctgcccagggacatctggataagaggcccaaggtccccaggagcccccaggtgcttctgccctgtg

SEQ ID NO: 17190 - DNA, 19 bp, Homo sapiens
  misc_feature 1..19: note = chr1:156358508-156358527
  misc_feature 1..19: note = hyper
  source 1..19: mol_type = genomic DNA
gaggcggccactgcatagg

SEQ ID NO: 17191 - DNA, 151 bp, Homo sapiens
  misc_feature 1..151: note = chr1:156390698-156390849
  misc_feature 1..151: note = hyper
  source 1..151: mol_type = genomic DNA
tgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaa

SEQ ID NO: 17192 - DNA, 59 bp, Homo sapiens; identical to SEQ ID NO: 5740
  misc_feature 1..59: note = chr1:156391157-156391216
  misc_feature 1..59: note = hyper
  source 1..59: mol_type = genomic DNA

SEQ ID NO: 17193 - DNA, 91 bp, Homo sapiens; identical to SEQ ID NO: 5741
  misc_feature 1..91: note = chr1:156391242-156391333
  misc_feature 1..91: note = hyper
  source 1..91: mol_type = genomic DNA

SEQ ID NO: 17194 - DNA, 48 bp, Homo sapiens; identical to SEQ ID NO: 1821
  misc_feature 1..48: note = chr1:156405367-156405415
  misc_feature 1..48: note = hyper
  source 1..48: mol_type = genomic DNA

SEQ ID NO: 17195 - DNA, 30 bp, Homo sapiens; identical to SEQ ID NO: 5745
  misc_feature 1..30: note = chr1:156468873-156468903
  misc_feature 1..30: note = hyper
  source 1..30: mol_type = genomic DNA

SEQ ID NO: 17196 - DNA, 170 bp, Homo sapiens; identical to SEQ ID NO: 5746
  misc_feature 1..170: note = chr1:156594433-156594603
  misc_feature 1..170: note = hyper
  source 1..170: mol_type = genomic DNA

SEQ ID NO: 17197 - DNA, 51 bp, Homo sapiens
  misc_feature 1..51: note = chr1:156594923-156594974
  misc_feature 1..51: note = hyper
  source 1..51: mol_type = genomic DNA
gctgtctgaagcccacgcggcgtgccggcgacgcggcgccgtggtggccaa

SEQ ID NO: 17198 - DNA, 32 bp, Homo sapiens
  misc_feature 1..32: note = chr1:156595021-156595053
  misc_feature 1..32: note = hyper
  source 1..32: mol_type = genomic DNA
gcgacggcggctggctggctgacggcagtgtg

SEQ ID NO: 17199 - DNA, 104 bp, Homo sapiens; identical to SEQ ID NO: 5748
  misc_feature 1..104: note = chr1:156595080-156595184
  misc_feature 1..104: note = hyper
  source 1..104: mol_type = genomic DNA

SEQ ID NO: 17200 - DNA, 114 bp, Homo sapiens
  misc_feature 1..114: note = chr1:156611775-156611889
  misc_feature 1..114: note = hyper
  source 1..114: mol_type = genomic DNA
gaaggcagcgggtcccgtgaccgtcccgagagccccgcgctcccgaccagggggcgggggcggccccggggagggcggggcaggggcggggggaagaaagggggttttgtgctg

SEQ ID NO: 17201 - DNA, 30 bp, Homo sapiens; identical to SEQ ID NO: 5751
  misc_feature 1..30: note = chr1:156626475-156626505
  misc_feature 1..30: note = hyper
  source 1..30: mol_type = genomic DNA

SEQ ID NO: 17202 - DNA, 41 bp, Homo sapiens
  misc_feature 1..41: note = chr1:156626850-156626891
  misc_feature 1..41: note = hyper
  source 1..41: mol_type = genomic DNA
cagcatcagcacacccgaggaacaggacttcatcaacagtg

SEQ ID NO: 17203 - DNA, 39 bp, Homo sapiens; identical to SEQ ID NO: 5753
  misc_feature 1..39: note = chr1:156646736-156646775
  misc_feature 1..39: note = hyper
  source 1..39: mol_type = genomic DNA

SEQ ID NO: 17204 - DNA, 94 bp, Homo sapiens
  misc_feature 1..94: note = chr1:156815146-156815240
  misc_feature 1..94: note = hyper
  source 1..94: mol_type = genomic DNA
gccctagtcctgctcacctttgggggctcttgttgatggacgtcaccttccaaggggatctggggaggccaggagtagccctatcaggcctgtc

SEQ ID NO: 17205 - DNA, 422 bp, Homo sapiens; identical to SEQ ID NO: 5757
  misc_feature 1..422: note = chr1:156818607-156819029
  misc_feature 1..422: note = hyper
  source 1..422: mol_type = genomic DNA

SEQ ID NO: 17206 - DNA, 46 bp, Homo sapiens
  misc_feature 1..46: note = chr1:156863061-156863107
  misc_feature 1..46: note = hyper
  source 1..46: mol_type = genomic DNA
cggtgcccgggaggggtcttaataagatcacggttgctgggcagca

SEQ ID NO: 17207 - DNA, 155 bp, Homo sapiens
  misc_feature 1..155: note = chr1:156863331-156863486
  misc_feature 1..155: note = hyper
  source 1..155: mol_type = genomic DNA
cacccagaatacagttttccctcccgggcgcctggatctcccctcccccggctcctgtttccttgtcaaaacttcctgccttggcgagggcccgagttcccacccccttcctgccccccgcccctcggcgcccctcccggccctgcgatcagcag

SEQ ID NO: 17208 - DNA, 22 bp, Homo sapiens
  misc_feature 1..22: note = chr1:156863640-156863662
  misc_feature 1..22: note = hyper
  source 1..22: mol_type = genomic DNA
cgcgccccctggcaggggaggc

SEQ ID NO: 17209 - DNA, 17 bp, Homo sapiens
  misc_feature 1..17: note = chr1:156893962-156893979
  misc_feature 1..17: note = hyper
  source 1..17: mol_type = genomic DNA
ggccaaatggagggacg

SEQ ID NO: 17210 - DNA, 40 bp, Homo sapiens; identical to SEQ ID NO: 5761
  misc_feature 1..40: note = chr1:156894252-156894292
  misc_feature 1..40: note = hyper
  source 1..40: mol_type = genomic DNA

SEQ ID NO: 17211 - DNA, 54 bp, Homo sapiens; identical to SEQ ID NO: 5762
  misc_feature 1..54: note = chr1:157963737-157963791
  misc_feature 1..54: note = hyper
  source 1..54: mol_type = genomic DNA

SEQ ID NO: 17212 - DNA, 401 bp, Homo sapiens; identical to SEQ ID NO: 5763
  misc_feature 1..401: note = chr1:158083182-158083583
  misc_feature 1..401: note = hyper
  source 1..401: mol_type = genomic DNA

SEQ ID NO: 17213 - DNA, 44 bp, Homo sapiens; identical to SEQ ID NO: 1828
  misc_feature 1..44: note = chr1:158150605-158150649
  misc_feature 1..44: note = hyper
  source 1..44: mol_type = genomic DNA

SEQ ID NO: 17214 - DNA, 147 bp, Homo sapiens; identical to SEQ ID NO: 1829
  misc_feature 1..147: note = chr1:158150650-158150797
  misc_feature 1..147: note = hyper
  source 1..147: mol_type = genomic DNA

SEQ ID NO: 17215 - DNA, 104 bp, Homo sapiens; identical to SEQ ID NO: 1830
  misc_feature 1..104: note = chr1:158150798-158150902
  misc_feature 1..104: note = hyper
  source 1..104: mol_type = genomic DNA

SEQ ID NO: 17216 - DNA, 15 bp, Homo sapiens
  misc_feature 1..15: note = chr1:159158333-159158348
  misc_feature 1..15: note = hyper
  source 1..15: mol_type = genomic DNA
ctggcgaagttcacc

SEQ ID NO: 17217 - DNA, 30 bp, Homo sapiens; identical to SEQ ID NO: 5769
  misc_feature 1..30: note = chr1:161068529-161068559
  misc_feature 1..30: note = hyper
  source 1..30: mol_type = genomic DNA

SEQ ID NO: 17218 - DNA, 51 bp, Homo sapiens
  misc_feature 1..51: note = chr1:161276026-161276077
  misc_feature 1..51: note = hyper
  source 1..51: mol_type = genomic DNA
cttccccttggccctcccacccactggagtagtctccgcccagatggggga

SEQ ID NO: 17219 - DNA, 49 bp, Homo sapiens; identical to SEQ ID NO: 5771
  misc_feature 1..49: note = chr1:161409851-161409900
  misc_feature 1..49: note = hyper
  source 1..49: mol_type = genomic DNA

SEQ ID NO: 17220 - DNA, 152 bp, Homo sapiens; identical to SEQ ID NO: 5772
  misc_feature 1..152: note = chr1:161494827-161494979
  misc_feature 1..152: note = hyper
  source 1..152: mol_type = genomic DNA

SEQ ID NO: 17221 - DNA, 30 bp, Homo sapiens; identical to SEQ ID NO: 5773
  misc_feature 1..30: note = chr1:161591710-161591740
  misc_feature 1..30: note = hyper
  source 1..30: mol_type = genomic DNA

SEQ ID NO: 17222 - DNA, 16 bp, Homo sapiens
  misc_feature 1..16: note = chr1:164290599-164290615
  misc_feature 1..16: note = hyper
  source 1..16: mol_type = genomic DNA
gccagctccgggggcc

SEQ ID NO: 17223 - DNA, 30 bp, Homo sapiens; identical to SEQ ID NO: 5776
  misc_feature 1..30: note = chr1:165204427-165204457
  misc_feature 1..30: note = hyper
  source 1..30: mol_type = genomic DNA

SEQ ID NO: 17224 - DNA, 58 bp, Homo sapiens; identical to SEQ ID NO: 5777
  misc_feature 1..58: note = chr1:165204838-165204896
  misc_feature 1..58: note = hyper
  source 1..58: mol_type = genomic DNA

SEQ ID NO: 17225 - DNA, 30 bp, Homo sapiens; identical to SEQ ID NO: 5778
  misc_feature 1..30: note = chr1:165321661-165321691
  misc_feature 1..30: note = hyper
  source 1..30: mol_type = genomic DNA

SEQ ID NO: 17226 - DNA, 66 bp, Homo sapiens; identical to SEQ ID NO: 5781
  misc_feature 1..66: note = chr1:165324832-165324898
  misc_feature 1..66: note = hyper
  source 1..66: mol_type = genomic DNA

SEQ ID NO: 17227 - DNA, 180 bp, Homo sapiens
  misc_feature 1..180: note = chr1:165325716-165325896
  misc_feature 1..180: note = hyper
  source 1..180: mol_type = genomic DNA
cgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggc

SEQ ID NO: 17228 - DNA, 254 bp, Homo sapiens
  misc_feature 1..254: note = chr1:165325950-165326204
  misc_feature 1..254: note = hyper
  source 1..254: mol_type = genomic DNA
ctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcacc

SEQ ID NO: 17229 - DNA, 39 bp, Homo sapiens; identical to SEQ ID NO: 5785
  misc_feature 1..39: note = chr1:165414376-165414415
  misc_feature 1..39: note = hyper
  source 1..39: mol_type = genomic DNA

SEQ ID NO: 17230 - skipped

SEQ ID NO: 17231 - DNA, 54 bp, Homo sapiens
  misc_feature 1..54: note = chr1:166134306-166134360
  misc_feature 1..54: note = hyper
  source 1..54: mol_type = genomic DNA
ggcgatccttggtcttcaccgcagcagccaagcccggcgcgcaccaaccggcgc

SEQ ID NO: 17232 - DNA, 80 bp, Homo sapiens
  misc_feature 1..80: note = chr1:166134648-166134728
  misc_feature 1..80: note = hyper
  source 1..80: mol_type = genomic DNA
ggttccagacggaaacgcctccgggctccctggcccgggggacaagggttcgaaacttcaacagtcgcgagggcaaggac

SEQ ID NO: 17233 - DNA, 95 bp, Homo sapiens
  misc_feature 1..95: note = chr1:166134796-166134891
  misc_feature 1..95: note = hyper
  source 1..95: mol_type = genomic DNA
acgcgcggcacagcccatgcgcccccggcactccactccactcctctatggtttcccccaaactcttcccggggagccccacaaagcacagacgg

SEQ ID NO: 17234 - DNA, 260 bp, Homo sapiens
  misc_feature 1..260: note = chr1:166134933-166135193
  misc_feature 1..260: note = hyper
  source 1..260: mol_type = genomic DNA
cgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtcc

SEQ ID NO: 17235 - DNA, 297 bp, Homo sapiens
  misc_feature 1..297: note = chr1:166135281-166135578
  misc_feature 1..297: note = hyper
  source 1..297: mol_type = genomic DNA
caccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcg

SEQ ID NO: 17236 - DNA, 286 bp, Homo sapiens
  misc_feature 1..286: note = chr1:167599330-167599616
  misc_feature 1..286: note = hyper
  source 1..286: mol_type = genomic DNA
tgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcc

SEQ ID NO: 17237 - skipped

SEQ ID NO: 17238 - DNA, 19 bp, Homo sapiens
  misc_feature 1..19: note = chr1:169396357-169396376
  misc_feature 1..19: note = hyper
  source 1..19: mol_type = genomic DNA
agactcggtggacctcgga

SEQ ID NO: 17239 - DNA, 130 bp, Homo sapiens; identical to SEQ ID NO: 5799
  misc_feature 1..130: note = chr1:170631315-170631445
  misc_feature 1..130: note = hyper
  source 1..130: mol_type = genomic DNA

SEQ ID NO: 17240 - DNA, 91 bp, Homo sapiens; identical to SEQ ID NO: 5800
  misc_feature 1..91: note = chr1:170633906-170633997
  misc_feature 1..91: note = hyper
  source 1..91: mol_type = genomic DNA

SEQ ID NO: 17241 - DNA, 30 bp, Homo sapiens; identical to SEQ ID NO: 5801
  misc_feature 1..30: note = chr1:170634253-170634283
  misc_feature 1..30: note = hyper
  source 1..30: mol_type = genomic DNA

SEQ ID NO: 17242 - DNA, 126 bp, Homo sapiens; identical to SEQ ID NO: 5804
  misc_feature 1..126: note = chr1:171811091-171811217
  misc_feature 1..126: note = hyper
  source 1..126: mol_type = genomic DNA

SEQ ID NO: 17243 - DNA, 30 bp, Homo sapiens; identical to SEQ ID NO: 5806
  misc_feature 1..30: note = chr1:177133445-177133475
  misc_feature 1..30: note = hyper
  source 1..30: mol_type = genomic DNA

SEQ ID NO: 17244 - DNA, 99 bp, Homo sapiens
  misc_feature 1..99: note = chr1:177133814-177133913
  misc_feature 1..99: note = hyper
  source 1..99: mol_type = genomic DNA
tgagccccggccgccttcctcctagcgctgcgatggtgggggaggaagcgagcggggagggagcgagggagcgagcgcgggaggcgggggaggttaggg

SEQ ID NO: 17245 - DNA, 375 bp, Homo sapiens
  misc_feature 1..375: note = chr1:177150803-177151178
  misc_feature 1..375: note = hyper
  source 1..375: mol_type = genomic DNA
tatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggg

SEQ ID NO: 17246 - DNA, 167 bp, Homo sapiens
  misc_feature 1..167: note = chr1:179544800-179544967
  misc_feature 1..167: note = hyper
  source 1..167: mol_type = genomic DNA
cgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggac

SEQ ID NO: 17247 - DNA, 57 bp, Homo sapiens
  misc_feature 1..57: note = chr1:179545098-179545155
  misc_feature 1..57: note = hyper
  source 1..57: mol_type = genomic DNA
ggggaccctaaagaccgtcgggtgggggctgagggcgaggggcgggacaccggggcc

SEQ ID NO: 17248 - DNA, 30 bp, Homo sapiens; identical to SEQ ID NO: 5812
  misc_feature 1..30: note = chr1:179712006-179712036
  misc_feature 1..30: note = hyper
  source 1..30: mol_type = genomic DNA

SEQ ID NO: 17249 - DNA, 247 bp, Homo sapiens
  misc_feature 1..247: note = chr1:180198209-180198456
  misc_feature 1..247: note = hyper
  source 1..247: mol_type = genomic DNA
tgtatttctgccagaaactcgcgttgaggagaatttgttttaagcgtttctctacctgtccatgcatctcgtaaatacagtaagcatggcaagccctttcgctggttaaccccggcgtccgtgtgctcactgccgccctgcacgcacgaggtcgcggatggttcaaagcacccgcggtggcagccggagaggcagagcgggctctagggacctaagacagggccgagctggacgactggtggcaggg

SEQ ID NO: 17250 - DNA, 158 bp, Homo sapiens; identical to SEQ ID NO: 5816
  misc_feature 1..158: note = chr1:180202237-180202395
  misc_feature 1..158: note = hyper
  source 1..158: mol_type = genomic DNA

SEQ ID NO: 17251 - DNA, 141 bp, Homo sapiens
  misc_feature 1..141: note = chr1:180203016-180203157
  misc_feature 1..141: note = hyper
  source 1..141: mol_type = genomic DNA
aaggtattttattttgtgtttggtagggtcggggtaaaggttttccctgggacttcctctcctggggctcctccggggtgcgtggggtaatgtcccagcgcaggtcgagttgcagatccgagtccccggggttgttgactg

SEQ ID NO: 17252 - DNA, 48 bp, Homo sapiens
  misc_feature 1..48: note = chr1:180203365-180203413
  misc_feature 1..48: note = hyper
  source 1..48: mol_type = genomic DNA
gattctatcatattccgaacattccgatatagcagctgtaggcaccat

SEQ ID NO: 17253 - DNA, 30 bp, Homo sapiens; identical to SEQ ID NO: 5822
  misc_feature 1..30: note = chr1:180205341-180205371
  misc_feature 1..30: note = hyper
  source 1..30: mol_type = genomic DNA

SEQ ID NO: 17254 - DNA, 33 bp, Homo sapiens; identical to SEQ ID NO: 5823
  misc_feature 1..33: note = chr1:180206330-180206363
  misc_feature 1..33: note = hyper
  source 1..33: mol_type = genomic DNA

SEQ ID NO: 17255 - DNA, 118 bp, Homo sapiens; identical to SEQ ID NO: 5824
  misc_feature 1..118: note = chr1:180881433-180881551
  misc_feature 1..118: note = hyper
  source 1..118: mol_type = genomic DNA

SEQ ID NO: 17256 - DNA, 30 bp, Homo sapiens; identical to SEQ ID NO: 5825
  misc_feature 1..30: note = chr1:180882303-180882333
  misc_feature 1..30: note = hyper
  source 1..30: mol_type = genomic DNA

SEQ ID NO: 17257 - DNA, 201 bp, Homo sapiens; identical to SEQ ID NO: 5826
  misc_feature 1..201: note = chr1:181287452-181287653
  misc_feature 1..201: note = hyper
  source 1..201: mol_type = genomic DNA

SEQ ID NO: 17258 - DNA, 14 bp, Homo sapiens
  misc_feature 1..14: note = chr1:181288188-181288202
  misc_feature 1..14: note = hyper
  source 1..14: mol_type = genomic DNA
gcagaggactgagg

SEQ ID NO: 17259 - DNA, 26 bp, Homo sapiens
  misc_feature 1..26: note = chr1:181451381-181451407
  misc_feature 1..26: note = hyper
  source 1..26: mol_type = genomic DNA
gacaccttactagggcggcggcgggc

SEQ ID NO: 17260 - DNA, 239 bp, Homo sapiens
  misc_feature 1..239: note = chr1:181452120-181452359
  misc_feature 1..239: note = hyper
  source 1..239: mol_type = genomic DNA
gtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 17261 - DNA, 180 bp, Homo sapiens
  misc_feature 1..180: note = chr1:181452691-181452871
  misc_feature 1..180: note = hyper
  source 1..180: mol_type = genomic DNA
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgttta

SEQ ID NO: 17262 - DNA, 34 bp, Homo sapiens; identical to SEQ ID NO: 5830
  misc_feature 1..34: note = chr1:181454728-181454762
  misc_feature 1..34: note = hyper
  source 1..34: mol_type = genomic DNA

SEQ ID NO: 17263 - DNA, 206 bp, Homo sapiens
  misc_feature 1..206: note = chr1:181454977-181455183
  misc_feature 1..206: note = hyper
  source 1..206: mol_type = genomic DNA
cctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgt

SEQ ID NO: 17264 - DNA, 11 bp, Homo sapiens
  misc_feature 1..11: note = chr1:181455263-181455274
  misc_feature 1..11: note = hyper
  source 1..11: mol_type = genomic DNA
tgtgagtctta

SEQ ID NO: 17265 - DNA, 43 bp, Homo sapiens
  misc_feature 1..43: note = chr1:183386107-183386150
  misc_feature 1..43: note = hyper
  source 1..43: mol_type = genomic DNA
tcagggcctcccacacgctctctcatccatcccagcccactcg

SEQ ID NO: 17266 - DNA, 15 bp, Homo sapiens
  misc_feature 1..15: note = chr1:183386288-183386303
  misc_feature 1..15: note = hyper
  source 1..15: mol_type = genomic DNA
cgagcagctgcgaag

SEQ ID NO: 17267 - DNA, 37 bp, Homo sapiens
  misc_feature 1..37: note = chr1:183386626-183386663
  misc_feature 1..37: note = hyper
  source 1..37: mol_type = genomic DNA
agcctccgcccggccccctccccgtcctaggcagcgg

SEQ ID NO: 17268 - DNA, 281 bp, Homo sapiens
  misc_feature 1..281: note = chr1:183387319-183387600
  misc_feature 1..281: note = hyper
  source 1..281: mol_type = genomic DNA
aacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgt

SEQ ID NO: 17269 - DNA, 66 bp, Homo sapiens
  misc_feature 1..66: note = chr1:183774363-183774429
  misc_feature 1..66: note = hyper
  source 1..66: mol_type = genomic DNA
cagacattgcgttggcctccgagcagggcgcatcatgcagcgttcgcgcaccggagagaaaactga

SEQ ID NO: 17270 - DNA, 39 bp, Homo sapiens; identical to SEQ ID NO: 5837
  misc_feature 1..39: note = chr1:184006034-184006073
  misc_feature 1..39: note = hyper
  source 1..39: mol_type = genomic DNA

SEQ ID NO: 17271 - DNA, 138 bp, Homo sapiens; identical to SEQ ID NO: 5838
  misc_feature 1..138: note = chr1:184006332-184006470
  misc_feature 1..138: note = hyper
  source 1..138: mol_type = genomic DNA

SEQ ID NO: 17272 - DNA, 147 bp, Homo sapiens; identical to SEQ ID NO: 5839
  misc_feature 1..147: note = chr1:190444251-190444398
  misc_feature 1..147: note = hyper
  source 1..147: mol_type = genomic DNA

SEQ ID NO: 17273 - DNA, 71 bp, Homo sapiens; identical to SEQ ID NO: 5842
  misc_feature 1..71: note = chr1:190445481-190445552
  misc_feature 1..71: note = hyper
  source 1..71: mol_type = genomic DNA

SEQ ID NO: 17274 - DNA, 195 bp, Homo sapiens
  misc_feature 1..195: note = chr1:190447519-190447714
  misc_feature 1..195: note = hyper
  source 1..195: mol_type = genomic DNA
tgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatctt

SEQ ID NO: 17275 - DNA, 35 bp, Homo sapiens
  misc_feature 1..35: note = chr1:196578066-196578101
  misc_feature 1..35: note = hyper
  source 1..35: mol_type = genomic DNA
agcatagcacagtgacggcacgggggtgccttggg

SEQ ID NO: 17276 - DNA, 68 bp, Homo sapiens
  misc_feature 1..68: note = chr1:197880156-197880224
  misc_feature 1..68: note = hyper
  source 1..68: mol_type = genomic DNA
cgggcgtccccccacaccccccccccactgcgccctggacccacgccacgcaccgccaaggagtagct

SEQ ID NO: 17277 - DNA, 111 bp, Homo sapiens; identical to SEQ ID NO: 5847
  misc_feature 1..111: note = chr1:197880543-197880654
  misc_feature 1..111: note = hyper
  source 1..111: mol_type = genomic DNA

SEQ ID NO: 17278 - DNA, 90 bp, Homo sapiens; identical to SEQ ID NO: 5848
  misc_feature 1..90: note = chr1:197881455-197881545
  misc_feature 1..90: note = hyper
  source 1..90: mol_type = genomic DNA

SEQ ID NO: 17279 - skipped

SEQ ID NO: 17280 - DNA, 60 bp, Homo sapiens; identical to SEQ ID NO: 5850
  misc_feature 1..60: note = chr1:197885234-197885294
  misc_feature 1..60: note = hyper
  source 1..60: mol_type = genomic DNA

SEQ ID NO: 17281 - DNA, 145 bp, Homo sapiens
  misc_feature 1..145: note = chr1:197886907-197887052
  misc_feature 1..145: note = hyper
  source 1..145: mol_type = genomic DNA
cttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatc

SEQ ID NO: 17282 - DNA, 311 bp, Homo sapiens
  misc_feature 1..311: note = chr1:197887741-197888052
  misc_feature 1..311: note = hyper
  source 1..311: mol_type = genomic DNA
gggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattacttatctaagcgcttccctttccagattactaacggggggggggggggactacagaagtctccggaaattatttcggccaaacatagctgtgtagatcctttggtaccacagtaggacttgtagcccaaactaatcaggagactgctctagcccttatca

SEQ ID NO: 17283 - DNA, 81 bp, Homo sapiens; identical to SEQ ID NO: 5857
  misc_feature 1..81: note = chr1:197889549-197889630
  misc_feature 1..81: note = hyper
  source 1..81: mol_type = genomic DNA

SEQ ID NO: 17284 - DNA, 55 bp, Homo sapiens; identical to SEQ ID NO: 5858
  misc_feature 1..55: note = chr1:197890716-197890771
  misc_feature 1..55: note = hyper
  source 1..55: mol_type = genomic DNA

SEQ ID NO: 17285 - DNA, 181 bp, Homo sapiens; identical to SEQ ID NO: 5859
  misc_feature 1..181: note = chr1:199998199-199998380
  misc_feature 1..181: note = hyper
  source 1..181: mol_type = genomic DNA

SEQ ID NO: 17286 - DNA, 30 bp, Homo sapiens; identical to SEQ ID NO: 5860
  misc_feature 1..30: note = chr1:199998758-199998788
  misc_feature 1..30: note = hyper
  source 1..30: mol_type = genomic DNA

SEQ ID NO: 17287 - DNA, 42 bp, Homo sapiens; identical to SEQ ID NO: 5864
  misc_feature 1..42: note = chr1:201252751-201252793
  misc_feature 1..42: note = hyper
  source 1..42: mol_type = genomic DNA

SEQ ID NO: 17288 - DNA, 22 bp, Homo sapiens
  misc_feature 1..22: note = chr1:201437642-201437664
  misc_feature 1..22: note = hyper
  source 1..22: mol_type = genomic DNA
tcttccagggggcagcggaagt

SEQ ID NO: 17289 - DNA, 105 bp, Homo sapiens; identical to SEQ ID NO: 5866
  misc_feature 1..105: note = chr1:201437682-201437787
  misc_feature 1..105: note = hyper
  source 1..105: mol_type = genomic DNA

SEQ ID NO: 17290 - DNA, 42 bp, Homo sapiens; identical to SEQ ID NO: 5867
  misc_feature 1..42: note = chr1:202678998-202679040
  misc_feature 1..42: note = hyper
  source 1..42: mol_type = genomic DNA

SEQ ID NO: 17291 - DNA, 33 bp, Homo sapiens; identical to SEQ ID NO: 5869
  misc_feature 1..33: note = chr1:202679642-202679675
  misc_feature 1..33: note = hyper
  source 1..33: mol_type = genomic DNA

SEQ ID NO: 17292 - DNA, 136 bp, Homo sapiens; identical to SEQ ID NO: 5870
  misc_feature 1..136: note = chr1:202996095-202996231
  misc_feature 1..136: note = hyper
  source 1..136: mol_type = genomic DNA

SEQ ID NO: 17293 - DNA, 212 bp, Homo sapiens
  misc_feature 1..212: note = chr1:204653807-204654019
  misc_feature 1..212: note = hyper
  source 1..212: mol_type = genomic DNA
gagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgcc

SEQ ID NO: 17294 - DNA, 104 bp, Homo sapiens; identical to SEQ ID NO: 5872
  misc_feature 1..104: note = chr1:204797791-204797895
  misc_feature 1..104: note = hyper
  source 1..104: mol_type = genomic DNA

SEQ ID NO: 17295 - DNA, 91 bp, Homo sapiens; identical to SEQ ID NO: 5873
  misc_feature 1..91: note = chr1:204798150-204798241
  misc_feature 1..91: note = hyper
  source 1..91: mol_type = genomic DNA

SEQ ID NO: 17296 - DNA, 60 bp, Homo sapiens
  misc_feature 1..60: note = chr1:205312536-205312596
  misc_feature 1..60: note = hyper
  source 1..60: mol_type = genomic DNA
gcagccggggcaaggcggtccactggtcggcctccggggagtagacctcgaagcagtcca

SEQ ID NO: 17297 - DNA, 416 bp, Homo sapiens; identical to SEQ ID NO: 5875
  misc_feature 1..416: note = chr1:205399689-205400105
  misc_feature 1..416: note = hyper
  source 1..416: mol_type = genomic DNA

SEQ ID NO: 17298 - DNA, 54 bp, Homo sapiens
  misc_feature 1..54: note = chr1:205424957-205425011
  misc_feature 1..54: note = hyper
  source 1..54: mol_type = genomic DNA
ccctcagccgcactcgggcccccaacccggccaaggggtcgccaactcgcggca

SEQ ID NO: 17299 - DNA, 115 bp, Homo sapiens
  misc_feature 1..115: note = chr1:207669381-207669496
  misc_feature 1..115: note = hyper
  source 1..115: mol_type = genomic DNA
ggtgggctctgccagcgaaactcgttagaaacaatgcaaatggggagtaaacatgacctcgcccatgaaggggaagctgtggtcaaaagcattttgtcccggaaccccgcagccc

SEQ ID NO: 17300 - DNA, 115 bp, Homo sapiens
  misc_feature 1..115: note = chr1:208084174-208084289
  misc_feature 1..115: note = hyper
  source 1..115: mol_type = genomic DNA
agctcccaggtgaggcgctggccccggggggaagcagctgtgggcggcagtgcgtgggttgggcaggggtcccttccctccgtgagactctgctctgctgttcagcctcccagaa

SEQ ID NO: 17301 - DNA, 39 bp, Homo sapiens; identical to SEQ ID NO: 5880
  misc_feature 1..39: note = chr1:209381523-209381562
  misc_feature 1..39: note = hyper
  source 1..39: mol_type = genomic DNA

SEQ ID NO: 17302 - DNA, 31 bp, Homo sapiens
  misc_feature 1..31: note = chr1:210111357-210111388
  misc_feature 1..31: note = hyper
  source 1..31: mol_type = genomic DNA
aggttggggtgggggcggggtggcgtcacgt

SEQ ID NO: 17303 - DNA, 30 bp, Homo sapiens; identical to SEQ ID NO: 5884
  misc_feature 1..30: note = chr1:211306755-211306785
  misc_feature 1..30: note = hyper
  source 1..30: mol_type = genomic DNA

SEQ ID NO: 17304 - DNA, 30 bp, Homo sapiens; identical to SEQ ID NO: 5885
  misc_feature 1..30: note = chr1:211307339-211307369
  misc_feature 1..30: note = hyper
  source 1..30: mol_type = genomic DNA

SEQ ID NO: 17305 - DNA, 110 bp, Homo sapiens; identical to SEQ ID NO: 5886
  misc_feature 1..110: note = chr1:213124513-213124623
  misc_feature 1..110: note = hyper
  source 1..110: mol_type = genomic DNA

SEQ ID NO: 17306 - DNA, 75 bp, Homo sapiens
  misc_feature 1..75: note = chr1:213124910-213124985
  misc_feature 1..75: note = hyper
  source 1..75: mol_type = genomic DNA
ccgctgcccccaccccaaaggcgccaaaggcacccggtcccggagcagccacgcgcggcccgtgagcctcgccac

SEQ ID NO: 17307 - DNA, 53 bp, Homo sapiens; identical to SEQ ID NO: 5888
  misc_feature 1..53: note = chr1:214155985-214156038
  misc_feature 1..53: note = hyper
  source 1..53: mol_type = genomic DNA

SEQ ID NO: 17308 - DNA, 11 bp, Homo sapiens
  misc_feature 1..11: note = chr1:214158827-214158838
  misc_feature 1..11: note = hyper
  source 1..11: mol_type = genomic DNA
gctcctatttc

SEQ ID NO: 17309 - DNA, 30 bp, Homo sapiens; identical to SEQ ID NO: 5892
  misc_feature 1..30: note = chr1:214160288-214160318
  misc_feature 1..30: note = hyper
  source 1..30: mol_type = genomic DNA

SEQ ID NO: 17310 - DNA, 136 bp, Homo sapiens; identical to SEQ ID NO: 5893
  misc_feature 1..136: note = chr1:214162493-214162629
  misc_feature 1..136: note = hyper
  source 1..136: mol_type = genomic DNA

SEQ ID NO: 17311 - DNA, 21 bp, Homo sapiens
  misc_feature 1..21: note = chr1:214360654-214360675
  misc_feature 1..21: note = hyper
  source 1..21: mol_type = genomic DNA
agctaattgcctaatcggagt

SEQ ID NO: 17312 - DNA, 54 bp, Homo sapiens
  misc_feature 1..54: note = chr1:214360968-214361022
  misc_feature 1..54: note = hyper
  source 1..54: mol_type = genomic DNA
gctcagaacacaccgagatcctttagaaataaatgtaatcgagactaatctgga

SEQ ID NO: 17313 - DNA, 41 bp, Homo sapiens; identical to SEQ ID NO: 5897
  misc_feature 1..41: note = chr1:214387716-214387757
  misc_feature 1..41: note = hyper
  source 1..41: mol_type = genomic DNA

SEQ ID NO: 17314 - DNA, 34 bp, Homo sapiens
  misc_feature 1..34: note = chr1:215255060-215255094
  misc_feature 1..34: note = hyper
  source 1..34: mol_type = genomic DNA
tcatcaggggattcccgctgagaaagtgggaagg

SEQ ID NO: 17315 - DNA, 71 bp, Homo sapiens
  misc_feature 1..71: note = chr1:215255799-215255870
  misc_feature 1..71: note = hyper
  source 1..71: mol_type = genomic DNA
agataggatgcagcgcagtgtgatgtggatgccagacagcgagagtgaggattttgcggggtggggatggg

SEQ ID NO: 17316 - DNA, 315 bp, Homo sapiens; identical to SEQ ID NO: 5899
  misc_feature 1..315: note = chr1:215256457-215256772
  misc_feature 1..315: note = hyper
  source 1..315: mol_type = genomic DNA

SEQ ID NO: 17317 - DNA, 42 bp, Homo sapiens; identical to SEQ ID NO: 5900
  misc_feature 1..42: note = chr1:216896512-216896554
  misc_feature 1..42: note = hyper
  source 1..42: mol_type = genomic DNA

SEQ ID NO: 17318 - DNA, 87 bp, Homo sapiens; identical to SEQ ID NO: 5901
  misc_feature 1..87: note = chr1:216896887-216896974
  misc_feature 1..87: note = hyper
  source 1..87: mol_type = genomic DNA

SEQ ID NO: 17319 - DNA, 75 bp, Homo sapiens; identical to SEQ ID NO: 5903
  misc_feature 1..75: note = chr1:217308622-217308697
  misc_feature 1..75: note = hyper
  source 1..75: mol_type = genomic DNA

SEQ ID NO: 17320 - DNA, 48 bp, Homo sapiens; identical to SEQ ID NO: 5905
  misc_feature 1..48: note = chr1:217309258-217309306
  misc_feature 1..48: note = hyper
  source 1..48: mol_type = genomic DNA

SEQ ID NO: 17321 - DNA, 66 bp, Homo sapiens; identical to SEQ ID NO: 5907
  misc_feature 1..66: note = chr1:217311944-217312010
  misc_feature 1..66: note = hyper
  source 1..66: mol_type = genomic DNA

SEQ ID NO: 17322 - DNA, 17 bp, Homo sapiens
  misc_feature 1..17: note = chr1:217313025-217313042
  misc_feature 1..17: note = hyper
  source 1..17: mol_type = genomic DNA
cccctctgcaattgccg

SEQ ID NO: 17323 - DNA, 30 bp, Homo sapiens; identical to SEQ ID NO: 5910
  misc_feature 1..30: note = chr1:218337322-218337352
  misc_feature 1..30: note = hyper
  source 1..30: mol_type = genomic DNA

SEQ ID NO: 17324 - DNA, 30 bp, Homo sapiens; identical to SEQ ID NO: 5911
  misc_feature 1..30: note = chr1:218337823-218337853
  misc_feature 1..30: note = hyper
  source 1..30: mol_type = genomic DNA

SEQ ID NO: 17325 - DNA, 96 bp, Homo sapiens; identical to SEQ ID NO: 5912
  misc_feature 1..96: note = chr1:218338074-218338170
  misc_feature 1..96: note = hyper
  source 1..96: mol_type = genomic DNA

SEQ ID NO: 17326 - DNA, 28 bp, Homo sapiens
  misc_feature 1..28: note = chr1:220101117-220101145
  misc_feature 1..28: note = hyper
  source 1..28: mol_type = genomic DNA
tccaaaggatgcaaccgaaaggcacctg

SEQ ID NO: 17327 - DNA, 224 bp, Homo sapiens
  misc_feature 1..224: note = chr1:220101385-220101609
  misc_feature 1..224: note = hyper
  source 1..224: mol_type = genomic DNA
tgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtag

SEQ ID NO: 17328 - DNA, 200 bp, Homo sapiens; identical to SEQ ID NO: 5917
  misc_feature 1..200: note = chr1:220702265-220702465
  misc_feature 1..200: note = hyper
  source 1..200: mol_type = genomic DNA

SEQ ID NO: 17329 - DNA, 145 bp, Homo sapiens; identical to SEQ ID NO: 5918
  misc_feature 1..145: note = chr1:220921624-220921769
  misc_feature 1..145: note = hyper
  source 1..145: mol_type = genomic DNA

SEQ ID NO: 17330 - DNA, 13 bp, Homo sapiens
  misc_feature 1..13: note = chr1:221052025-221052038
  misc_feature 1..13: note = hyper
  source 1..13: mol_type = genomic DNA
ggaaaggtttggc

SEQ ID NO: 17331 - DNA, 227 bp, Homo sapiens
  misc_feature 1..227: note = chr1:221052492-221052719
  misc_feature 1..227: note = hyper
  source 1..227: mol_type = genomic DNA
tagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccg

SEQ ID NO: 17332 - DNA, 208 bp, Homo sapiens
  misc_feature 1..208: note = chr1:221053402-221053610
  misc_feature 1..208: note = hyper
  source 1..208: mol_type = genomic DNA
ggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacag

SEQ ID NO: 17333 - DNA, 48 bp, Homo sapiens
  misc_feature 1..48: note = chr1:223302777-223302825
  misc_feature 1..48: note = hyper
  source 1..48: mol_type = genomic DNA
ggaaggccctgctcccgaccgacccggagcgcgctgctgccctctacc

SEQ ID NO: 17334 - skipped

SEQ ID NO: 17335 - DNA, 73 bp, Homo sapiens; identical to SEQ ID NO: 5923
  misc_feature 1..73: note = chr1:223538158-223538231
  misc_feature 1..73: note = hyper
  source 1..73: mol_type = genomic DNA

SEQ ID NO: 17336 - DNA, 13 bp, Homo sapiens
  misc_feature 1..13: note = chr1:224528801-224528814
  misc_feature 1..13: note = hyper
  source 1..13: mol_type = genomic DNA
gctccacctcctc

SEQ ID NO: 17337 - DNA, 30 bp, Homo sapiens; identical to SEQ ID NO: 5927
  misc_feature 1..30: note = chr1:224803373-224803403
  misc_feature 1..30: note = hyper
  source 1..30: mol_type = genomic DNA

SEQ ID NO: 17338 - DNA, 95 bp, Homo sapiens
  misc_feature 1..95: note = chr1:224804002-224804097
  misc_feature 1..95: note = hyper
  source 1..95: mol_type = genomic DNA
caccgctacagttctcgcagtggcaaaggcggcggcggcggcggcggcagcggcagcagcaggtggagcgagctacagcgtttggcctgaaaccc

SEQ ID NO: 17339 - DNA, 206 bp, Homo sapiens
  misc_feature 1..206: note = chr1:224804910-224805116
  misc_feature 1..206: note = hyper
  source 1..206: mol_type = genomic DNA
tgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgc

SEQ ID NO: 17340 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 17341 - DNA, 100 bp, Homo sapiens; identical to SEQ ID NO: 5933
  misc_feature 1..100: note = chr1:225117280-225117380
  misc_feature 1..100: note = hyper
  source 1..100: mol_type = genomic DNA

SEQ ID NO: 17342 - DNA, 41 bp, Homo sapiens; identical to SEQ ID NO: 5934
  misc_feature 1..41: note = chr1:226411183-226411224
  misc_feature 1..41: note = hyper
  source 1..41: mol_type = genomic DNA

SEQ ID NO: 17343 - DNA, 168 bp, Homo sapiens
  misc_feature 1..168: note = chr1:226411273-226411441
  misc_feature 1..168: note = hyper
  source 1..168: mol_type = genomic DNA
tctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgta

SEQ ID NO: 17344 - DNA, 111 bp, Homo sapiens
  misc_feature 1..111: note = chr1:226411832-226411943
  misc_feature 1..111: note = hyper
  source 1..111: mol_type = genomic DNA
gtctggactgcgggctcctgaggccacacccgggacgttgcaggcacggtgcttcccctgaggctctgcgtactagactgaaatagggggtgatatcggcacctgctgcat

SEQ ID NO: 17345 - DNA, 106 bp, Homo sapiens; identical to SEQ ID NO: 5937
  misc_feature 1..106: note = chr1:226737012-226737118
  misc_feature 1..106: note = hyper
  source 1..106: mol_type = genomic DNA

SEQ ID NO: 17346 - DNA, 167 bp, Homo sapiens
  misc_feature 1..167: note = chr1:226924900-226925067
  misc_feature 1..167: note = hyper
  source 1..167: mol_type = genomic DNA
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcg

SEQ ID NO: 17347 - DNA, 349 bp, Homo sapiens
  misc_feature 1..349: note = chr1:226925195-226925544
  misc_feature 1..349: note = hyper
  source 1..349: mol_type = genomic DNA
cgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcg

SEQ ID NO: 17348 - DNA, 131 bp, Homo sapiens; identical to SEQ ID NO: 5939
  misc_feature 1..131: note = chr1:227730464-227730595
  misc_feature 1..131: note = hyper
  source 1..131: mol_type = genomic DNA

SEQ ID NO: 17349 - DNA, 33 bp, Homo sapiens; identical to SEQ ID NO: 5940
  misc_feature 1..33: note = chr1:228074787-228074820
  misc_feature 1..33: note = hyper
  source 1..33: mol_type = genomic DNA

SEQ ID NO: 17350 - DNA, 87 bp, Homo sapiens; identical to SEQ ID NO: 5941
  misc_feature 1..87: note = chr1:228194270-228194357
  misc_feature 1..87: note = hyper
  source 1..87: mol_type = genomic DNA

SEQ ID NO: 17351 - DNA, 428 bp, Homo sapiens
  misc_feature 1..428: note = chr1:228194949-228195377
  misc_feature 1..428: note = hyper
  source 1..428: mol_type = genomic DNA
agcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctc

SEQ ID NO: 17352 - DNA, 154 bp, Homo sapiens
  misc_feature 1..154: note = chr1:228196349-228196503
  misc_feature 1..154: note = hyper
  source 1..154: mol_type = genomic DNA
agggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggc

SEQ ID NO: 17353 - DNA, 71 bp, Homo sapiens; identical to SEQ ID NO: 5943
  misc_feature 1..71: note = chr1:228225753-228225824
  misc_feature 1..71: note = hyper
  source 1..71: mol_type = genomic DNA

SEQ ID NO: 17354 - DNA, 61 bp, Homo sapiens
  misc_feature 1..61: note = chr1:228463250-228463311
  misc_feature 1..61: note = hyper
  source 1..61: mol_type = genomic DNA
gcttaaagtcgcacccgggagggtgcgcagctgcggcccgcgtgtggccagggccgcgctg

SEQ ID NO: 17355 - DNA, 63 bp, Homo sapiens; identical to SEQ ID NO: 5945
  misc_feature 1..63: note = chr1:228603691-228603754
  misc_feature 1..63: note = hyper
  source 1..63: mol_type = genomic DNA

SEQ ID NO: 17356 - DNA, 55 bp, Homo sapiens
  misc_feature 1..55: note = chr1:228604254-228604309
  misc_feature 1..55: note = hyper
  source 1..55: mol_type = genomic DNA
cccgcacagcgcctagtgcacctggccgagcgctcgctgccgggaaaggctgggt

SEQ ID NO: 17357 - DNA, 65 bp, Homo sapiens; identical to SEQ ID NO: 5947
  misc_feature 1..65: note = chr1:228604515-228604580
  misc_feature 1..65: note = hyper
  source 1..65: mol_type = genomic DNA

SEQ ID NO: 17358 - DNA, 107 bp, Homo sapiens; identical to SEQ ID NO: 125
  misc_feature 1..107: note = chr1:228633813-228633920
  misc_feature 1..107: note = hyper
  source 1..107: mol_type = genomic DNA

SEQ ID NO: 17359 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 17360 - skipped

SEQ ID NO: 17361 - DNA, 48 bp, Homo sapiens
  misc_feature 1..48: note = chr1:228645092-228645140
  misc_feature 1..48: note = hyper
  source 1..48: mol_type = genomic DNA
ccatcaaaggggccccgggggcggcgggcggcctcacttgcccttggc

SEQ ID NO: 17362 - DNA, 172 bp, Homo sapiens
  misc_feature 1..172: note = chr1:228645734-228645906
  misc_feature 1..172: note = hyper
  source 1..172: mol_type = genomic DNA
gaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaagg

SEQ ID NO: 17363 - DNA, 121 bp, Homo sapiens
  misc_feature 1..121: note = chr1:228646238-228646359
  misc_feature 1..121: note = hyper
  source 1..121: mol_type = genomic DNA
ggctcttttcagagccacccacacgatcaagaaagggtttcgaacacggtgaagggttatgtaacctaatgtgtctccatgcaccctagcggttgccgggtgcggccgaatctgagccgtg

SEQ ID NO: 17364 - DNA, 74 bp, Homo sapiens; identical to SEQ ID NO: 5954
  misc_feature 1..74: note = chr1:228647217-228647291
  misc_feature 1..74: note = hyper
  source 1..74: mol_type = genomic DNA

SEQ ID NO: 17365 - DNA, 253 bp, Homo sapiens
  misc_feature 1..253: note = chr1:228651626-228651879
  misc_feature 1..253: note = hyper
  source 1..253: mol_type = genomic DNA
acacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaa

SEQ ID NO: 17366 - DNA, 25 bp, Homo sapiens
  misc_feature 1..25: note = chr1:229542813-229542838
  misc_feature 1..25: note = hyper
  source 1..25: mol_type = genomic DNA
catgctgaggttggtcgcttgtttc

SEQ ID NO: 17367 - DNA, 124 bp, Homo sapiens; identical to SEQ ID NO: 132
  misc_feature 1..124: note = chr1:229543220-229543344
  misc_feature 1..124: note = hyper
  source 1..124: mol_type = genomic DNA

SEQ ID NO: 17368 - DNA, 30 bp, Homo sapiens; identical to SEQ ID NO: 5960
  misc_feature 1..30: note = chr1:229566702-229566732
  misc_feature 1..30: note = hyper
  source 1..30: mol_type = genomic DNA

SEQ ID NO: 17369 - DNA, 146 bp, Homo sapiens
  misc_feature 1..146: note = chr1:229568204-229568350
  misc_feature 1..146: note = hyper
  source 1..146: mol_type = genomic DNA
ggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggcca

SEQ ID NO: 17370 - DNA, 46 bp, Homo sapiens; identical to SEQ ID NO: 5964
  misc_feature 1..46: note = chr1:229570083-229570129
  misc_feature 1..46: note = hyper
  source 1..46: mol_type = genomic DNA

SEQ ID NO: 17371 - DNA, 33 bp, Homo sapiens; identical to SEQ ID NO: 5965
  misc_feature 1..33: note = chr1:229570479-229570512
  misc_feature 1..33: note = hyper
  source 1..33: mol_type = genomic DNA

SEQ ID NO: 17372 - DNA, 30 bp, Homo sapiens; identical to SEQ ID NO: 5966
  misc_feature 1..30: note = chr1:230561556-230561586
  misc_feature 1..30: note = hyper
  source 1..30: mol_type = genomic DNA

SEQ ID NO: 17373 - DNA, 15 bp, Homo sapiens
  misc_feature 1..15: note = chr1:231296817-231296832
  misc_feature 1..15: note = hyper
  source 1..15: mol_type = genomic DNA
cgctacgactccggt

SEQ ID NO: 17374 - DNA, 59 bp, Homo sapiens; identical to SEQ ID NO: 1894
  misc_feature 1..59: note = chr1:231297044-231297103
  misc_feature 1..59: note = hyper
  source 1..59: mol_type = genomic DNA

SEQ ID NO: 17375 - DNA, 364 bp, Homo sapiens; identical to SEQ ID NO: 5970
  misc_feature 1..364: note = chr1:231298191-231298555
  misc_feature 1..364: note = hyper
  source 1..364: mol_type = genomic DNA

SEQ ID NO: 17376 - DNA, 30 bp, Homo sapiens; identical to SEQ ID NO: 5971
  misc_feature 1..30: note = chr1:231299494-231299524
  misc_feature 1..30: note = hyper
  source 1..30: mol_type = genomic DNA

SEQ ID NO: 17377 - DNA, 213 bp, Homo sapiens; identical to SEQ ID NO: 1897
  misc_feature 1..213: note = chr1:234041148-234041361
  misc_feature 1..213: note = hyper
  source 1..213: mol_type = genomic DNA

SEQ ID NO: 17378 - skipped

SEQ ID NO: 17379 - DNA, 93 bp, Homo sapiens
  misc_feature 1..93: note = chr1:234350100-234350193
  misc_feature 1..93: note = hyper
  source 1..93: mol_type = genomic DNA
gaggccgggactgagaggggcgagccgctggtgctccccggcggcagagggccgcgtcggccacgggcccgggagagacgcgctccagccggc

SEQ ID NO: 17380 - DNA, 279 bp, Homo sapiens; identical to SEQ ID NO: 5978
  misc_feature 1..279: note = chr1:235812015-235812294
  misc_feature 1..279: note = hyper
  source 1..279: mol_type = genomic DNA

SEQ ID NO: 17381 - DNA, 47 bp, Homo sapiens; identical to SEQ ID NO: 5979
  misc_feature 1..47: note = chr1:235812947-235812994
  misc_feature 1..47: note = hyper
  source 1..47: mol_type = genomic DNA

SEQ ID NO: 17382 - DNA, 114 bp, Homo sapiens
  misc_feature 1..114: note = chr1:235813667-235813781
  misc_feature 1..114: note = hyper
  source 1..114: mol_type = genomic DNA
ggaggggtctggggacggggccgcggtcagcgcgggctccccgaagcctcaggtaccgccctcgctcggggtgagctccagcgcctgggccgttggggcgcgggccgcttccca

SEQ ID NO: 17383 - DNA, 112 bp, Homo sapiens
  misc_feature 1..112: note = chr1:236228096-236228208
  misc_feature 1..112: note = hyper
  source 1..112: mol_type = genomic DNA
gcgcccccggcccgccgcgccctgcagcccctcgcccgccctcccggggctcactcacgtagactgcgtcgatgtcggatctgtcgtagaagcggagcgccccactcagctc

SEQ ID NO: 17384 - DNA, 31 bp, Homo sapiens; identical to SEQ ID NO: 5986
  misc_feature 1..31: note = chr1:236558486-236558517
  misc_feature 1..31: note = hyper
  source 1..31: mol_type = genomic DNA

SEQ ID NO: 17385 - skipped

SEQ ID NO: 17386 - DNA, 42 bp, Homo sapiens; identical to SEQ ID NO: 5988
  misc_feature 1..42: note = chr1:236558782-236558824
  misc_feature 1..42: note = hyper
  source 1..42: mol_type = genomic DNA

SEQ ID NO: 17387 - DNA, 49 bp, Homo sapiens
  misc_feature 1..49: note = chr1:236559127-236559176
  misc_feature 1..49: note = hyper
  source 1..49: mol_type = genomic DNA
ctcccagtccagccccgcgagcggctgctgaccgcccctcccgcgctcg

SEQ ID NO: 17388 - DNA, 97 bp, Homo sapiens
  misc_feature 1..97: note = chr1:236559271-236559368
  misc_feature 1..97: note = hyper
  source 1..97: mol_type = genomic DNA
agacacgtcctgcaaacctctggcagaaatgggcgcaagggggtggatttcgttttcgcctcccgggctttttctttctccccgctcacatgccttc

SEQ ID NO: 17389 - DNA, 52 bp, Homo sapiens; identical to SEQ ID NO: 5994
  misc_feature 1..52: note = chr1:240161034-240161086
  misc_feature 1..52: note = hyper
  source 1..52: mol_type = genomic DNA

SEQ ID NO: 17390 - DNA, 84 bp, Homo sapiens
  misc_feature 1..84: note = chr1:240254860-240254944
  misc_feature 1..84: note = hyper
  source 1..84: mol_type = genomic DNA
gcttcagtttttctccgtgtaaaaatttcttcttttttatttaacttttctcttggcaggtccagcagctttgaagatcagagt

SEQ ID NO: 17391 - DNA, 350 bp, Homo sapiens
  misc_feature 1..350: note = chr1:240255011-240255361
  misc_feature 1..350: note = hyper
  source 1..350: mol_type = genomic DNA
tccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgg

SEQ ID NO: 17392 - DNA, 319 bp, Homo sapiens
  misc_feature 1..319: note = chr1:240255500-240255819
  misc_feature 1..319: note = hyper
  source 1..319: mol_type = genomic DNA
atgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcgga

SEQ ID NO: 17393 - DNA, 26 bp, Homo sapiens
  misc_feature 1..26: note = chr1:240775287-240775313
  misc_feature 1..26: note = hyper
  source 1..26: mol_type = genomic DNA
ttggtctcccgccgccgctttcagtt

SEQ ID NO: 17394 - DNA, 47 bp, Homo sapiens
  misc_feature 1..47: note = chr1:240775378-240775425
  misc_feature 1..47: note = hyper
  source 1..47: mol_type = genomic DNA
cgagagcgcgccccgcgccgcgcggtcccaggctggctgctcctgca

SEQ ID NO: 17395 - DNA, 57 bp, Homo sapiens; identical to SEQ ID NO: 6001
  misc_feature 1..57: note = chr1:241520455-241520512
  misc_feature 1..57: note = hyper
  source 1..57: mol_type = genomic DNA

SEQ ID NO: 17396 - DNA, 80 bp, Homo sapiens
  misc_feature 1..80: note = chr1:241587113-241587193
  misc_feature 1..80: note = hyper
  source 1..80: mol_type = genomic DNA
gtcctgagcggccgctgccatcgcgccggctgcagcggaaaggtacaagcggtggcggcaggagccgctgtgggagcagc

SEQ ID NO: 17397 - DNA, 41 bp, Homo sapiens
  misc_feature 1..41: note = chr1:241587546-241587587
  misc_feature 1..41: note = hyper
  source 1..41: mol_type = genomic DNA
tgccgcacttgcacacggagtgtggggggccaggcctggga

SEQ ID NO: 17398 - DNA, 81 bp, Homo sapiens
  misc_feature 1..81: note = chr1:241587797-241587878
  misc_feature 1..81: note = hyper
  source 1..81: mol_type = genomic DNA
gggcccgcaatctactccggaggctttcccactgggcagggtcgctagcagggtgagagaaagccccgggccatccccgag

SEQ ID NO: 17399 - DNA, 90 bp, Homo sapiens
  misc_feature 1..90: note = chr1:242688094-242688184
  misc_feature 1..90: note = hyper
  source 1..90: mol_type = genomic DNA
ggtgcagtgaggagccgccgccgcccctcccgccgcgcccaggcccgggcggccgcgctcccgctccgcacccgcctttcccgagcaggc

SEQ ID NO: 17400 - DNA, 119 bp, Homo sapiens; identical to SEQ ID NO: 1915
  misc_feature 1..119: note = chr1:242688277-242688396
  misc_feature 1..119: note = hyper
  source 1..119: mol_type = genomic DNA

SEQ ID NO: 17401 - DNA, 30 bp, Homo sapiens; identical to SEQ ID NO: 6009
  misc_feature 1..30: note = chr1:243053994-243054024
  misc_feature 1..30: note = hyper
  source 1..30: mol_type = genomic DNA

SEQ ID NO: 17402 - DNA, 30 bp, Homo sapiens; identical to SEQ ID NO: 6010
  misc_feature 1..30: note = chr1:244014641-244014671
  misc_feature 1..30: note = hyper
  source 1..30: mol_type = genomic DNA

SEQ ID NO: 17403 - DNA, 202 bp, Homo sapiens
  misc_feature 1..202: note = chr1:244080470-244080672
  misc_feature 1..202: note = hyper
  source 1..202: mol_type = genomic DNA
aacagcagcctgatccgtcttgcttttcccttttctccatgcagccagcacttttccttctcactctccccgcacgcccacgcccacccgcttctgcaccgagaacctcgaggcgcgcacgcacgtggaggtgacgccaagcccagcggcgaggtcggggctgggggtggggggagccggcgtcccgcgggcccccgaggcc

SEQ ID NO: 17404 - DNA, 93 bp, Homo sapiens
  misc_feature 1..93: note = chr1:244080702-244080795
  misc_feature 1..93: note = hyper
  source 1..93: mol_type = genomic DNA
agctgaatgcagccgaggggcgagcgcgcgggctcgcacggattagccgtgctttcccatgagccacaaaagaatgcccgaatctgggacatc

SEQ ID NO: 17405 - DNA, 44 bp, Homo sapiens; identical to SEQ ID NO: 6012
  misc_feature 1..44: note = chr1:244893555-244893599
  misc_feature 1..44: note = hyper
  source 1..44: mol_type = genomic DNA

SEQ ID NO: 17406 - DNA, 32 bp, Homo sapiens; identical to SEQ ID NO: 6013
  misc_feature 1..32: note = chr1:247171029-247171061
  misc_feature 1..32: note = hyper
  source 1..32: mol_type = genomic DNA

SEQ ID NO: 17407 - DNA, 52 bp, Homo sapiens; identical to SEQ ID NO: 6014
  misc_feature 1..52: note = chr1:247171365-247171417
  misc_feature 1..52: note = hyper
  source 1..52: mol_type = genomic DNA

SEQ ID NO: 17408 - DNA, 23 bp, Homo sapiens
  misc_feature 1..23: note = chr1:247274349-247274372
  misc_feature 1..23: note = hyper
  source 1..23: mol_type = genomic DNA
cggggccgcgagcaagcctccga

SEQ ID NO: 17409 - DNA, 30 bp, Homo sapiens; identical to SEQ ID NO: 6018
  misc_feature 1..30: note = chr2:287500-287530
  misc_feature 1..30: note = hyper
  source 1..30: mol_type = genomic DNA

SEQ ID NO: 17410 - DNA, 61 bp, Homo sapiens
  misc_feature 1..61: note = chr2:288470-288531
  misc_feature 1..61: note = hyper
  source 1..61: mol_type = genomic DNA
tccacctcccggccatggcgccctcccgcacctgcccggcgccacccgggagccacctgcg

SEQ ID NO: 17411 - DNA, 61 bp, Homo sapiens; identical to SEQ ID NO: 6020
  misc_feature 1..61: note = chr2:288738-288799
  misc_feature 1..61: note = hyper
  source 1..61: mol_type = genomic DNA

SEQ ID NO: 17412 - DNA, 30 bp, Homo sapiens; identical to SEQ ID NO: 6021
  misc_feature 1..30: note = chr2:289223-289253
  misc_feature 1..30: note = hyper
  source 1..30: mol_type = genomic DNA

SEQ ID NO: 17413 - DNA, 235 bp, Homo sapiens; identical to SEQ ID NO: 6022
  misc_feature 1..235: note = chr2:290038-290273
  misc_feature 1..235: note = hyper
  source 1..235: mol_type = genomic DNA

SEQ ID NO: 17414 - DNA, 68 bp, Homo sapiens
  misc_feature 1..68: note = chr2:945845-945913
  misc_feature 1..68: note = hyper
  source 1..68: mol_type = genomic DNA
cccgagctttgggggcgggaagggagggtggaaggaggaggggagcggggttggggaaagttggagct

SEQ ID NO: 17415 - DNA, 10 bp, Homo sapiens
  misc_feature 1..10: note = chr2:946000-946010
  misc_feature 1..10: note = hyper
  source 1..10: mol_type = genomic DNA
ggacgcggcc

SEQ ID NO: 17416 - DNA, 197 bp, Homo sapiens
  misc_feature 1..197: note = chr2:946011-946208
  misc_feature 1..197: note = hyper
  source 1..197: mol_type = genomic DNA
gctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgccc

SEQ ID NO: 17417 - DNA, 115 bp, Homo sapiens; identical to SEQ ID NO: 1922
  misc_feature 1..115: note = chr2:946289-946404
  misc_feature 1..115: note = hyper
  source 1..115: mol_type = genomic DNA

SEQ ID NO: 17418 - DNA, 18 bp, Homo sapiens
  misc_feature 1..18: note = chr2:947159-947177
  misc_feature 1..18: note = hyper
  source 1..18: mol_type = genomic DNA
cttcgggcgcccaggcca

SEQ ID NO: 17419 - DNA, 47 bp, Homo sapiens
  misc_feature 1..47: note = chr2:1746567-1746614
  misc_feature 1..47: note = hyper
  source 1..47: mol_type = genomic DNA
aggaggagaggaactcgggcccccgccccgccccagggcctccagga

SEQ ID NO: 17420 - DNA, 43 bp, Homo sapiens; identical to SEQ ID NO: 6031
  misc_feature 1..43: note = chr2:5831358-5831401
  misc_feature 1..43: note = hyper
  source 1..43: mol_type = genomic DNA

SEQ ID NO: 17421 - DNA, 229 bp, Homo sapiens
  misc_feature 1..229: note = chr2:5831819-5832048
  misc_feature 1..229: note = hyper
  source 1..229: mol_type = genomic DNA
aaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagc

SEQ ID NO: 17422 - DNA, 116 bp, Homo sapiens; identical to SEQ ID NO: 1925
  misc_feature 1..116: note = chr2:5832731-5832847
  misc_feature 1..116: note = hyper
  source 1..116: mol_type = genomic DNA

SEQ ID NO: 17423 - DNA, 51 bp, Homo sapiens
  misc_feature 1..51: note = chr2:5836497-5836548
  misc_feature 1..51: note = hyper
  source 1..51: mol_type = genomic DNA
agggggcgcggggcgcggcgggacccaggctacgagcgggagggaggcggg

SEQ ID NO: 17424 - DNA, 54 bp, Homo sapiens
  misc_feature 1..54: note = chr2:5837414-5837468
  misc_feature 1..54: note = hyper
  source 1..54: mol_type = genomic DNA
ctgagatgattgaccgaggtttggccttccatttttactgagatttggcgagac

SEQ ID NO: 17425 - DNA, 24 bp, Homo sapiens
  misc_feature 1..24: note = chr2:5866074-5866098
  misc_feature 1..24: note = hyper
  source 1..24: mol_type = genomic DNA
ctgggggcagcagagcgacgtgcc

SEQ ID NO: 17426 - DNA, 53 bp, Homo sapiens; identical to SEQ ID NO: 6042
  misc_feature 1..53: note = chr2:7058223-7058276
  misc_feature 1..53: note = hyper
  source 1..53: mol_type = genomic DNA

SEQ ID NO: 17427 - DNA, 30 bp, Homo sapiens; identical to SEQ ID NO: 6043
  misc_feature 1..30: note = chr2:7571320-7571350
  misc_feature 1..30: note = hyper
  source 1..30: mol_type = genomic DNA

SEQ ID NO: 17428 - DNA, 37 bp, Homo sapiens
  misc_feature 1..37: note = chr2:10182790-10182827
  misc_feature 1..37: note = hyper
  source 1..37: mol_type = genomic DNA
agagacgcgagcaaccgaaatatagggagaaaaaaaa

SEQ ID NO: 17429 - DNA, 92 bp, Homo sapiens
  misc_feature 1..92: note = chr2:10182904-10182996
  misc_feature 1..92: note = hyper
  source 1..92: mol_type = genomic DNA
tgggaagaatgggcgggtttcagcgggcgccttctgggtgactgcccgtttcggcttcccctgaccccgtaacagagcggaagaggcccaga

SEQ ID NO: 17430 - DNA, 118 bp, Homo sapiens; identical to SEQ ID NO: 6046
  misc_feature 1..118: note = chr2:10220823-10220941
  misc_feature 1..118: note = hyper
  source 1..118: mol_type = genomic DNA

SEQ ID NO: 17431 - DNA, 15 bp, Homo sapiens
  misc_feature 1..15: note = chr2:10220958-10220973
  misc_feature 1..15: note = hyper
  source 1..15: mol_type = genomic DNA
cgacctttcagtgtc

SEQ ID NO: 17432 - DNA, 25 bp, Homo sapiens
  misc_feature 1..25: note = chr2:10688849-10688874
  misc_feature 1..25: note = hyper
  source 1..25: mol_type = genomic DNA
tctgctgggatgacccggtcctgtt

SEQ ID NO: 17433 - DNA, 30 bp, Homo sapiens; identical to SEQ ID NO: 6049
  misc_feature 1..30: note = chr2:11052420-11052450
  misc_feature 1..30: note = hyper
  source 1..30: mol_type = genomic DNA

SEQ ID NO: 17434 - DNA, 157 bp, Homo sapiens; identical to SEQ ID NO: 6050
  misc_feature 1..157: note = chr2:11622808-11622965
  misc_feature 1..157: note = hyper
  source 1..157: mol_type = genomic DNA

SEQ ID NO: 17435 - DNA, 12 bp, Homo sapiens
  misc_feature 1..12: note = chr2:12858618-12858630
  misc_feature 1..12: note = hyper
  source 1..12: mol_type = genomic DNA
gaaatacttatt

SEQ ID NO: 17436 - DNA, 30 bp, Homo sapiens; identical to SEQ ID NO: 6052
  misc_feature 1..30: note = chr2:14773957-14773987
  misc_feature 1..30: note = hyper
  source 1..30: mol_type = genomic DNA

SEQ ID NO: 17437 - DNA, 516 bp, Homo sapiens; identical to SEQ ID NO: 6053
  misc_feature 1..516: note = chr2:16082386-16082902
  misc_feature 1..516: note = hyper
  source 1..516: mol_type = genomic DNA

SEQ ID NO: 17438 - DNA, 71 bp, Homo sapiens; identical to SEQ ID NO: 6054
  misc_feature 1..71: note = chr2:17720246-17720317
  misc_feature 1..71: note = hyper
  source 1..71: mol_type = genomic DNA

SEQ ID NO: 17439 - DNA, 56 bp, Homo sapiens; identical to SEQ ID NO: 6055
  misc_feature 1..56: note = chr2:17721623-17721679
  misc_feature 1..56: note = hyper
  source 1..56: mol_type = genomic DNA

SEQ ID NO: 17440 - DNA, 74 bp, Homo sapiens; identical to SEQ ID NO: 6056
  misc_feature 1..74: note = chr2:17721750-17721824
  misc_feature 1..74: note = hyper
  source 1..74: mol_type = genomic DNA

SEQ ID NO: 17441 - DNA, 126 bp, Homo sapiens; identical to SEQ ID NO: 6057
  misc_feature 1..126: note = chr2:18011883-18012009
  misc_feature 1..126: note = hyper
  source 1..126: mol_type = genomic DNA

SEQ ID NO: 17442 - DNA, 86 bp, Homo sapiens
  misc_feature 1..86: note = chr2:18058949-18059035
  misc_feature 1..86: note = hyper
  source 1..86: mol_type = genomic DNA
ccagggaacactgggcgccttagcttggagcagctggctccgaggaattgttccacgtctgcacaacttaaaaatctgcagtttgg

SEQ ID NO: 17443 - DNA, 448 bp, Homo sapiens
  misc_feature 1..448: note = chr2:18059085-18059533
  misc_feature 1..448: note = hyper
  source 1..448: mol_type = genomic DNA
cctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccg

SEQ ID NO: 17444 - DNA, 30 bp, Homo sapiens; identical to SEQ ID NO: 6059
  misc_feature 1..30: note = chr2:18060088-18060118
  misc_feature 1..30: note = hyper
  source 1..30: mol_type = genomic DNA

SEQ ID NO: 17445 - DNA, 43 bp, Homo sapiens; identical to SEQ ID NO: 6060
  misc_feature 1..43: note = chr2:19551406-19551449
  misc_feature 1..43: note = hyper
  source 1..43: mol_type = genomic DNA

SEQ ID NO: 17446 - DNA, 23 bp, Homo sapiens
  misc_feature 1..23: note = chr2:19558809-19558832
  misc_feature 1..23: note = hyper
  source 1..23: mol_type = genomic DNA
cggcttgggtttcaacgcacttt

SEQ ID NO: 17447 - DNA, 72 bp, Homo sapiens
  misc_feature 1..72: note = chr2:19558893-19558965
  misc_feature 1..72: note = hyper
  source 1..72: mol_type = genomic DNA
gtggagcagctcctggctatccaagcgtgctcggggccagggtgttaacccaggcagcgctggttaattcct

SEQ ID NO: 17448 - DNA, 153 bp, Homo sapiens
  misc_feature 1..153: note = chr2:20865927-20866080
  misc_feature 1..153: note = hyper
  source 1..153: mol_type = genomic DNA
gcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttc

SEQ ID NO: 17449 - DNA, 65 bp, Homo sapiens; identical to SEQ ID NO: 6068
  misc_feature 1..65: note = chr2:21022991-21023056
  misc_feature 1..65: note = hyper
  source 1..65: mol_type = genomic DNA

SEQ ID NO: 17450 - DNA, 41 bp, Homo sapiens; identical to SEQ ID NO: 6069
  misc_feature 1..41: note = chr2:23609527-23609568
  misc_feature 1..41: note = hyper
  source 1..41: mol_type = genomic DNA

SEQ ID NO: 17451 - DNA, 16 bp, Homo sapiens
  misc_feature 1..16: note = chr2:24232773-24232789
  misc_feature 1..16: note = hyper
  source 1..16: mol_type = genomic DNA
gtcctgagggcctgcc

SEQ ID NO: 17452 - DNA, 89 bp, Homo sapiens; identical to SEQ ID NO: 6071
  misc_feature 1..89: note = chr2:24233349-24233438
  misc_feature 1..89: note = hyper
  source 1..89: mol_type = genomic DNA

SEQ ID NO: 17453 - DNA, 30 bp, Homo sapiens; identical to SEQ ID NO: 6072
  misc_feature 1..30: note = chr2:24273201-24273231
  misc_feature 1..30: note = hyper
  source 1..30: mol_type = genomic DNA

SEQ ID NO: 17454 - DNA, 42 bp, Homo sapiens; identical to SEQ ID NO: 6073
  misc_feature 1..42: note = chr2:25354748-25354790
  misc_feature 1..42: note = hyper
  source 1..42: mol_type = genomic DNA

SEQ ID NO: 17455 - DNA, 472 bp, Homo sapiens
  misc_feature 1..472: note = chr2:25391212-25391684
  misc_feature 1..472: note = hyper
  source 1..472: mol_type = genomic DNA
cagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaa

SEQ ID NO: 17456 - skipped

SEQ ID NO: 17457 - DNA, 99 bp, Homo sapiens
  misc_feature 1..99: note = chr2:26401931-26402030
  misc_feature 1..99: note = hyper
  source 1..99: mol_type = genomic DNA
gtggagggaggaggacggcgactcgcgccgggtggggctgaaggcactgcggggtgactcggtctccaggctgcggcgctctgctccgggagtcaggga

SEQ ID NO: 17458 - DNA, 120 bp, Homo sapiens
  misc_feature 1..120: note = chr2:26402060-26402180
  misc_feature 1..120: note = hyper
  source 1..120: mol_type = genomic DNA
cccagcccccgcccctggccctgcgggaggggccaggcgtcttccctgagcatggtgccacttccccagtgttggccttgtttcctgctcagcatttggcagatgcgcctctggcccaac

SEQ ID NO: 17459 - DNA, 68 bp, Homo sapiens
  misc_feature 1..68: note = chr2:26915695-26915763
  misc_feature 1..68: note = hyper
  source 1..68: mol_type = genomic DNA
ggcgcgggccgggggcgccggggggccggcggcggcccgggcgggacgatgaagcggcagaacgtgcg

SEQ ID NO: 17460 - DNA, 716 bp, Homo sapiens
  misc_feature 1..716: note = chr2:27070414-27071130
  misc_feature 1..716: note = hyper
  source 1..716: mol_type = genomic DNA
tgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtga

SEQ ID NO: 17461 - DNA, 97 bp, Homo sapiens; identical to SEQ ID NO: 6083
  misc_feature 1..97: note = chr2:27071758-27071855
  misc_feature 1..97: note = hyper
  source 1..97: mol_type = genomic DNA

SEQ ID NO: 17462 - DNA, 26 bp, Homo sapiens
  misc_feature 1..26: note = chr2:27072989-27073015
  misc_feature 1..26: note = hyper
  source 1..26: mol_type = genomic DNA
ttgcggagaagcgggtggaaatgatc

SEQ ID NO: 17463 - DNA, 30 bp, Homo sapiens; identical to SEQ ID NO: 6085
  misc_feature 1..30: note = chr2:27473328-27473358
  misc_feature 1..30: note = hyper
  source 1..30: mol_type = genomic DNA

SEQ ID NO: 17464 - DNA, 159 bp, Homo sapiens; identical to SEQ ID NO: 6086
  misc_feature 1..159: note = chr2:27484899-27485058
  misc_feature 1..159: note = hyper
  source 1..159: mol_type = genomic DNA

SEQ ID NO: 17465 - DNA, 86 bp, Homo sapiens; identical to SEQ ID NO: 6087
  misc_feature 1..86: note = chr2:27938325-27938411
  misc_feature 1..86: note = hyper
  source 1..86: mol_type = genomic DNA

SEQ ID NO: 17466 - DNA, 121 bp, Homo sapiens
  misc_feature 1..121: note = chr2:29338969-29339090
  misc_feature 1..121: note = hyper
  source 1..121: mol_type = genomic DNA
cagtgggtcttcaaagctaaaccaaatggctgtccttgcagtccttggctacctgagatcccttaattctgaaccatccgcacctgggaggggaagttgaaaggagcgctggagctgagcc

SEQ ID NO: 17467 - DNA, 28 bp, Homo sapiens
  misc_feature 1..28: note = chr2:30143276-30143304
  misc_feature 1..28: note = hyper
  source 1..28: mol_type = genomic DNA
gccagccttcagctccgaggaggatggt

SEQ ID NO: 17468 - DNA, 168 bp, Homo sapiens
  misc_feature 1..168: note = chr2:30144411-30144579
  misc_feature 1..168: note = hyper
  source 1..168: mol_type = genomic DNA
gctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctc

SEQ ID NO: 17469 - DNA, 122 bp, Homo sapiens
  misc_feature 1..122: note = chr2:30453941-30454063
  misc_feature 1..122: note = hyper
  source 1..122: mol_type = genomic DNA
acagccagtggatgggaaggagggcgctggcgccgggcggctggggtggaggagtggcgggtgccctaccccggcgcagagcagccgccgagctgtcatgtcccgagcggcccccgcgccct

SEQ ID NO: 17470 - DNA, 97 bp, Homo sapiens
  misc_feature 1..97: note = chr2:31360209-31360306
  misc_feature 1..97: note = hyper
  source 1..97: mol_type = genomic DNA
ccgccaataccaaggcgtctgtttttacaggctctttcgtggtgttctgggcacattcaacttccaatgcagctgagagggtcgggaacagttagag

SEQ ID NO: 17471 - DNA, 148 bp, Homo sapiens
  misc_feature 1..148: note = chr2:31360831-31360979
  misc_feature 1..148: note = hyper
  source 1..148: mol_type = genomic DNA
tctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcg

SEQ ID NO: 17472 - DNA, 73 bp, Homo sapiens; identical to SEQ ID NO: 6099
  misc_feature 1..73: note = chr2:31361425-31361498
  misc_feature 1..73: note = hyper
  source 1..73: mol_type = genomic DNA

SEQ ID NO: 17473 - DNA, 18 bp, Homo sapiens
  misc_feature 1..18: note = chr2:31457039-31457057
  misc_feature 1..18: note = hyper
  source 1..18: mol_type = genomic DNA
ccgcgggctgggcagcgt

SEQ ID NO: 17474 - DNA, 45 bp, Homo sapiens; identical to SEQ ID NO: 6101
  misc_feature 1..45: note = chr2:37571852-37571897
  misc_feature 1..45: note = hyper
  source 1..45: mol_type = genomic DNA

SEQ ID NO: 17475 - DNA, 99 bp, Homo sapiens; identical to SEQ ID NO: 6102
  misc_feature 1..99: note = chr2:38301762-38301861
  misc_feature 1..99: note = hyper
  source 1..99: mol_type = genomic DNA

SEQ ID NO: 17476 - DNA, 47 bp, Homo sapiens; identical to SEQ ID NO: 6104
  misc_feature 1..47: note = chr2:38755384-38755431
  misc_feature 1..47: note = hyper
  source 1..47: mol_type = genomic DNA

SEQ ID NO: 17477 - DNA, 18 bp, Homo sapiens
  misc_feature 1..18: note = chr2:39187200-39187218
  misc_feature 1..18: note = hyper
  source 1..18: mol_type = genomic DNA
ggagccgctgggcaacgt

SEQ ID NO: 17478 - DNA, 30 bp, Homo sapiens
  misc_feature 1..30: note = chr2:39893060-39893090
  misc_feature 1..30: note = hyper
  source 1..30: mol_type = genomic DNA
tgtgtctggcggcggcgcgcgagcccaccg

SEQ ID NO: 17479 - DNA, 340 bp, Homo sapiens
  misc_feature 1..340: note = chr2:39893501-39893841
  misc_feature 1..340: note = hyper
  source 1..340: mol_type = genomic DNA
ctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcct

SEQ ID NO: 17480 - DNA, 106 bp, Homo sapiens
  misc_feature 1..106: note = chr2:40678497-40678603
  misc_feature 1..106: note = hyper
  source 1..106: mol_type = genomic DNA
cacctccctcctctccgcagtccgtggtgaatgagcacccaacgcccgctggaaaacagggggctcggaaatgtggccttggggaaagaccccagggattaccgga

SEQ ID NO: 17481 - DNA, 54 bp, Homo sapiens
  misc_feature 1..54: note = chr2:42329377-42329431
  misc_feature 1..54: note = hyper
  source 1..54: mol_type = genomic DNA
gtctgcagatggggccggccaccacgtgctctctgagttctctttccaagtaca

SEQ ID NO: 17482 - DNA, 86 bp, Homo sapiens; identical to SEQ ID NO: 6114
  misc_feature 1..86: note = chr2:42329751-42329837
  misc_feature 1..86: note = hyper
  source 1..86: mol_type = genomic DNA

SEQ ID NO: 17483 - DNA, 73 bp, Homo sapiens; identical to SEQ ID NO: 6116
  misc_feature 1..73: note = chr2:42720975-42721048
  misc_feature 1..73: note = hyper
  source 1..73: mol_type = genomic DNA

SEQ ID NO: 17484 - DNA, 212 bp, Homo sapiens; identical to SEQ ID NO: 6118
  misc_feature 1..212: note = chr2:43020113-43020325
  misc_feature 1..212: note = hyper
  source 1..212: mol_type = genomic DNA

SEQ ID NO: 17485 - DNA, 30 bp, Homo sapiens; identical to SEQ ID NO: 6119
  misc_feature 1..30: note = chr2:43451091-43451121
  misc_feature 1..30: note = hyper
  source 1..30: mol_type = genomic DNA

SEQ ID NO: 17486 - DNA, 48 bp, Homo sapiens
  misc_feature 1..48: note = chr2:45028940-45028988
  misc_feature 1..48: note = hyper
  source 1..48: mol_type = genomic DNA
tccttttaattgtgacggtgcggccgcttgggcgtgatcccttggctg

SEQ ID NO: 17487 - DNA, 214 bp, Homo sapiens; identical to SEQ ID NO: 6129
  misc_feature 1..214: note = chr2:45159704-45159918
  misc_feature 1..214: note = hyper
  source 1..214: mol_type = genomic DNA

SEQ ID NO: 17488 - DNA, 30 bp, Homo sapiens; identical to SEQ ID NO: 6132
  misc_feature 1..30: note = chr2:45160939-45160969
  misc_feature 1..30: note = hyper
  source 1..30: mol_type = genomic DNA

SEQ ID NO: 17489 - DNA, 34 bp, Homo sapiens; identical to SEQ ID NO: 6133
  misc_feature 1..34: note = chr2:45161221-45161255
  misc_feature 1..34: note = hyper
  source 1..34: mol_type = genomic DNA

SEQ ID NO: 17490 - DNA, 49 bp, Homo sapiens
  misc_feature 1..49: note = chr2:45162112-45162161
  misc_feature 1..49: note = hyper
  source 1..49: mol_type = genomic DNA
tgctgcgcgttctttctccctccccctctcagggcgccagggcccagac

SEQ ID NO: 17491 - DNA, 25 bp, Homo sapiens
  misc_feature 1..25: note = chr2:45162913-45162938
  misc_feature 1..25: note = hyper
  source 1..25: mol_type = genomic DNA
tcctgccagccgtgtggctcttaaa

SEQ ID NO: 17492 - DNA, 205 bp, Homo sapiens; identical to SEQ ID NO: 6137
  misc_feature 1..205: note = chr2:45164939-45165144
  misc_feature 1..205: note = hyper
  source 1..205: mol_type = genomic DNA

SEQ ID NO: 17493 - DNA, 61 bp, Homo sapiens; identical to SEQ ID NO: 6139
  misc_feature 1..61: note = chr2:45168959-45169020
  misc_feature 1..61: note = hyper
  source 1..61: mol_type = genomic DNA

SEQ ID NO: 17494 - DNA, 88 bp, Homo sapiens; identical to SEQ ID NO: 6140
  misc_feature 1..88: note = chr2:45169316-45169404
  misc_feature 1..88: note = hyper
  source 1..88: mol_type = genomic DNA

SEQ ID NO: 17495 - DNA, 94 bp, Homo sapiens
  misc_feature 1..94: note = chr2:45170029-45170123
  misc_feature 1..94: note = hyper
  source 1..94: mol_type = genomic DNA
gccgcggcggccaagaacaggttagtggcggggcccgcggcctggctacagcctcagaggcctgggaaggggagaggggttgagatggggctag

SEQ ID NO: 17496 - DNA, 61 bp, Homo sapiens
  misc_feature 1..61: note = chr2:45171324-45171385
  misc_feature 1..61: note = hyper
  source 1..61: mol_type = genomic DNA
gtatgcagttctacccggagactggccgggcggtggggaacccgcagctcccggtgtgtgt

SEQ ID NO: 17497 - DNA, 17 bp, Homo sapiens
  misc_feature 1..17: note = chr2:45171862-45171879
  misc_feature 1..17: note = hyper
  source 1..17: mol_type = genomic DNA
ctcggtaacctccagcg

SEQ ID NO: 17498 - DNA, 233 bp, Homo sapiens
  misc_feature 1..233: note = chr2:45176768-45177001
  misc_feature 1..233: note = hyper
  source 1..233: mol_type = genomic DNA
attcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacg

SEQ ID NO: 17499 - DNA, 258 bp, Homo sapiens
  misc_feature 1..258: note = chr2:45179362-45179620
  misc_feature 1..258: note = hyper
  source 1..258: mol_type = genomic DNA
tccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccg

SEQ ID NO: 17500 - DNA, 289 bp, Homo sapiens
  misc_feature 1..289: note = chr2:45179650-45179939
  misc_feature 1..289: note = hyper
  source 1..289: mol_type = genomic DNA
ttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgt

SEQ ID NO: 17501 - DNA, 15 bp, Homo sapiens
  misc_feature 1..15: note = chr2:45231136-45231151
  misc_feature 1..15: note = hyper
  source 1..15: mol_type = genomic DNA
attctgattttatcc

SEQ ID NO: 17502 - DNA, 76 bp, Homo sapiens; identical to SEQ ID NO: 6149
  misc_feature 1..76: note = chr2:45231244-45231320
  misc_feature 1..76: note = hyper
  source 1..76: mol_type = genomic DNA

SEQ ID NO: 17503 - DNA, 13 bp, Homo sapiens
  misc_feature 1..13: note = chr2:45233586-45233599
  misc_feature 1..13: note = hyper
  source 1..13: mol_type = genomic DNA
ggttgtggctgtt

SEQ ID NO: 17504 - DNA, 65 bp, Homo sapiens
  misc_feature 1..65: note = chr2:45235529-45235594
  misc_feature 1..65: note = hyper
  source 1..65: mol_type = genomic DNA
gaaaggcctaagcatcgtccaagtcaggccgggctgccgctgggctgtggccgggcctgggggcc

SEQ ID NO: 17505 - DNA, 38 bp, Homo sapiens; identical to SEQ ID NO: 6153
  misc_feature 1..38: note = chr2:45236204-45236242
  misc_feature 1..38: note = hyper
  source 1..38: mol_type = genomic DNA

SEQ ID NO: 17506 - DNA, 64 bp, Homo sapiens; identical to SEQ ID NO: 6154
  misc_feature 1..64: note = chr2:45236460-45236524
  misc_feature 1..64: note = hyper
  source 1..64: mol_type = genomic DNA

SEQ ID NO: 17507 - DNA, 11 bp, Homo sapiens
  misc_feature 1..11: note = chr2:45237662-45237673
  misc_feature 1..11: note = hyper
  source 1..11: mol_type = genomic DNA
gtggtggggct

SEQ ID NO: 17508 - DNA, 352 bp, Homo sapiens
  misc_feature 1..352: note = chr2:45240784-45241136
  misc_feature 1..352: note = hyper
  source 1..352: mol_type = genomic DNA
ggcgctgggctccgggcggtcgcactcttggaaccgcgcgaaccgcggcgtcgcccgcgccgcacgtggctggggcagtcacaggccccgagagctggagcaacggggtcaccgccacccctctgccctccaggccttcaccttgagacccacgcggcagcctggagggcccacaagagcaaacggtttagaggccgcgggctcacgagggatcttgttcaaacgaaaagaacgagcacaggggctcggggccagcctggaggccggcacagaggcgagtcggcccgggtggcgccgggaccaggcgggatttggggcgggtatccgggcccgggcgctggcagcctccctg

SEQ ID NO: 17509 - DNA, 215 bp, Homo sapiens; identical to SEQ ID NO: 1964
  misc_feature 1..215: note = chr2:45241232-45241447
  misc_feature 1..215: note = hyper
  source 1..215: mol_type = genomic DNA

SEQ ID NO: 17510 - DNA, 30 bp, Homo sapiens; identical to SEQ ID NO: 6160
  misc_feature 1..30: note = chr2:45241753-45241783
  misc_feature 1..30: note = hyper
  source 1..30: mol_type = genomic DNA

SEQ ID NO: 17511 - DNA, 155 bp, Homo sapiens
  misc_feature 1..155: note = chr2:45396160-45396315
  misc_feature 1..155: note = hyper
  source 1..155: mol_type = genomic DNA
gctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaa

SEQ ID NO: 17512 - DNA, 16 bp, Homo sapiens
  misc_feature 1..16: note = chr2:45396672-45396688
  misc_feature 1..16: note = hyper
  source 1..16: mol_type = genomic DNA
ccgccaccctctgggc

SEQ ID NO: 17513 - DNA, 33 bp, Homo sapiens; identical to SEQ ID NO: 6164
  misc_feature 1..33: note = chr2:45397223-45397256
  misc_feature 1..33: note = hyper
  source 1..33: mol_type = genomic DNA

SEQ ID NO: 17514 - DNA, 278 bp, Homo sapiens
  misc_feature 1..278: note = chr2:47796765-47797043
  misc_feature 1..278: note = hyper
  source 1..278: mol_type = genomic DNA
cggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggca

SEQ ID NO: 17515 - DNA, 145 bp, Homo sapiens
  misc_feature 1..145: note = chr2:47797818-47797963
  misc_feature 1..145: note = hyper
  source 1..145: mol_type = genomic DNA
gcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatc

SEQ ID NO: 17516 - DNA, 216 bp, Homo sapiens
  misc_feature 1..216: note = chr2:47797964-47798180
  misc_feature 1..216: note = hyper
  source 1..216: mol_type = genomic DNA
gcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtgg

SEQ ID NO: 17517 - DNA, 291 bp, Homo sapiens
  misc_feature 1..291: note = chr2:47798663-47798954
  misc_feature 1..291: note = hyper
  source 1..291: mol_type = genomic DNA
caggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcgggga

SEQ ID NO: 17518 - DNA, 56 bp, Homo sapiens; identical to SEQ ID NO: 1968
  misc_feature 1..56: note = chr2:47799123-47799179
  misc_feature 1..56: note = hyper
  source 1..56: mol_type = genomic DNA

SEQ ID NO: 17519 - DNA, 88 bp, Homo sapiens
  misc_feature 1..88: note = chr2:50573507-50573595
  misc_feature 1..88: note = hyper
  source 1..88: mol_type = genomic DNA
ccttctggcaactgacgcccccttcccgcggggcccagccgcgcgaccagggctggtcctttagtaggtgtccacatctctctcccag

SEQ ID NO: 17520 - DNA, 71 bp, Homo sapiens; identical to SEQ ID NO: 6177
  misc_feature 1..71: note = chr2:56149951-56150022
  misc_feature 1..71: note = hyper
  source 1..71: mol_type = genomic DNA

SEQ ID NO: 17521 - DNA, 128 bp, Homo sapiens; identical to SEQ ID NO: 6178
  misc_feature 1..128: note = chr2:56150227-56150355
  misc_feature 1..128: note = hyper
  source 1..128: mol_type = genomic DNA

SEQ ID NO: 17522 - DNA, 33 bp, Homo sapiens
  misc_feature 1..33: note = chr2:56411733-56411766
  misc_feature 1..33: note = hyper
  source 1..33: mol_type = genomic DNA
cttgcacctgccaccccgcggataccatgtcga

SEQ ID NO: 17523 - DNA, 34 bp, Homo sapiens; identical to SEQ ID NO: 6181
  misc_feature 1..34: note = chr2:58655503-58655537
  misc_feature 1..34: note = hyper
  source 1..34: mol_type = genomic DNA

SEQ ID NO: 17524 - DNA, 51 bp, Homo sapiens
  misc_feature 1..51: note = chr2:58655998-58656049
  misc_feature 1..51: note = hyper
  source 1..51: mol_type = genomic DNA
gcgcgccactcagcccgggaggtggggccgggcagtgaccccgcgcgaagt

SEQ ID NO: 17525 - DNA, 72 bp, Homo sapiens
  misc_feature 1..72: note = chr2:58656125-58656197
  misc_feature 1..72: note = hyper
  source 1..72: mol_type = genomic DNA
gtaccctctctttatcctaccctccattccccgacccttttctccctctcttctccccgttcttttctactc

SEQ ID NO: 17526 - DNA, 59 bp, Homo sapiens
  misc_feature 1..59: note = chr2:60797078-60797137
  misc_feature 1..59: note = hyper
  source 1..59: mol_type = genomic DNA
cttgtgtagagcctccggtgccctccacctaaccctgccccaatgcctcgggtcttttt

SEQ ID NO: 17527 - DNA, 61 bp, Homo sapiens
  misc_feature 1..61: note = chr2:60797281-60797342
  misc_feature 1..61: note = hyper
  source 1..61: mol_type = genomic DNA
ctggagtttttttttttttttttttttagttcggttcagaagcaaacgctacctagtttct

SEQ ID NO: 17528 - DNA, 276 bp, Homo sapiens; identical to SEQ ID NO: 6184
  misc_feature 1..276: note = chr2:60962755-60963031
  misc_feature 1..276: note = hyper
  source 1..276: mol_type = genomic DNA

SEQ ID NO: 17529 - DNA, 26 bp, Homo sapiens
  misc_feature 1..26: note = chr2:62798386-62798412
  misc_feature 1..26: note = hyper
  source 1..26: mol_type = genomic DNA
cgtgactcacccgtgtccctcgctct

SEQ ID NO: 17530 - DNA, 147 bp, Homo sapiens; identical to SEQ ID NO: 165
  misc_feature 1..147: note = chr2:63275877-63276024
  misc_feature 1..147: note = hyper
  source 1..147: mol_type = genomic DNA

SEQ ID NO: 17531 - DNA, 67 bp, Homo sapiens; identical to SEQ ID NO: 6187
  misc_feature 1..67: note = chr2:63276425-63276492
  misc_feature 1..67: note = hyper
  source 1..67: mol_type = genomic DNA

SEQ ID NO: 17532 - DNA, 231 bp, Homo sapiens
  misc_feature 1..231: note = chr2:63278731-63278962
  misc_feature 1..231: note = hyper
  source 1..231: mol_type = genomic DNA
agtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggcccc

SEQ ID NO: 17533 - DNA, 30 bp, Homo sapiens
  misc_feature 1..30: note = chr2:63278992-63279022
  misc_feature 1..30: note = hyper
  source 1..30: mol_type = genomic DNA
cctgagagtggcaccccgggttcccggcag

SEQ ID NO: 17534 - DNA, 25 bp, Homo sapiens
  misc_feature 1..25: note = chr2:63284752-63284777
  misc_feature 1..25: note = hyper
  source 1..25: mol_type = genomic DNA
tttttagtgcaccttcgttctccga

SEQ ID NO: 17535 - DNA, 32 bp, Homo sapiens
  misc_feature 1..32: note = chr2:63284811-63284843
  misc_feature 1..32: note = hyper
  source 1..32: mol_type = genomic DNA
tttggctttggccgcttcgtccagtaggtggg

SEQ ID NO: 17536 - DNA, 163 bp, Homo sapiens; identical to SEQ ID NO: 6195
  misc_feature 1..163: note = chr2:64836470-64836633
  misc_feature 1..163: note = hyper
  source 1..163: mol_type = genomic DNA

SEQ ID NO: 17537 - DNA, 20 bp, Homo sapiens
  misc_feature 1..20: note = chr2:66653914-66653934
  misc_feature 1..20: note = hyper
  source 1..20: mol_type = genomic DNA
atcctgccgggacccccacc

SEQ ID NO: 17538 - DNA, 176 bp, Homo sapiens; identical to SEQ ID NO: 6198
  misc_feature 1..176: note = chr2:66659986-66660162
  misc_feature 1..176: note = hyper
  source 1..176: mol_type = genomic DNA

SEQ ID NO: 17539 - DNA, 47 bp, Homo sapiens
  misc_feature 1..47: note = chr2:66660603-66660650
  misc_feature 1..47: note = hyper
  source 1..47: mol_type = genomic DNA
ataattgattttccccgcagccaatgcgcggcggcctgggcgggggc

SEQ ID NO: 17540 - DNA, 66 bp, Homo sapiens; identical to SEQ ID NO: 6200
  misc_feature 1..66: note = chr2:66802875-66802941
  misc_feature 1..66: note = hyper
  source 1..66: mol_type = genomic DNA

SEQ ID NO: 17541 - DNA, 30 bp, Homo sapiens
  misc_feature 1..30: note = chr2:66809361-66809391
  misc_feature 1..30: note = hyper
  source 1..30: mol_type = genomic DNA
ctgccgcatgtagggcgatcttcattaact

SEQ ID NO: 17542 - DNA, 75 bp, Homo sapiens
  misc_feature 1..75: note = chr2:68546249-68546324
  misc_feature 1..75: note = hyper
  source 1..75: mol_type = genomic DNA
cgcgaggccagaggcccttgagaggctcgggctgtcctgggggcctcagtcctctgcctgtaccccatgggggac

SEQ ID NO: 17543 - DNA, 21 bp, Homo sapiens
  misc_feature 1..21: note = chr2:68546892-68546913
  misc_feature 1..21: note = hyper
  source 1..21: mol_type = genomic DNA
tgtttacgcaccacaatcccc

SEQ ID NO: 17544 - DNA, 67 bp, Homo sapiens; identical to SEQ ID NO: 6205
  misc_feature 1..67: note = chr2:68870366-68870433
  misc_feature 1..67: note = hyper
  source 1..67: mol_type = genomic DNA

SEQ ID NO: 17545 - DNA, 121 bp, Homo sapiens; identical to SEQ ID NO: 6206
  misc_feature 1..121: note = chr2:68870917-68871038
  misc_feature 1..121: note = hyper
  source 1..121: mol_type = genomic DNA

SEQ ID NO: 17546 - DNA, 105 bp, Homo sapiens; identical to SEQ ID NO: 6207
  misc_feature 1..105: note = chr2:69240500-69240605
  misc_feature 1..105: note = hyper
  source 1..105: mol_type = genomic DNA

SEQ ID NO: 17547 - DNA, 64 bp, Homo sapiens; identical to SEQ ID NO: 6208
  misc_feature 1..64: note = chr2:69533671-69533735
  misc_feature 1..64: note = hyper
  source 1..64: mol_type = genomic DNA

SEQ ID NO: 17548 - DNA, 338 bp, Homo sapiens
  misc_feature 1..338: note = chr2:71503452-71503790
  misc_feature 1..338: note = hyper
  source 1..338: mol_type = genomic DNA
ggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctg

SEQ ID NO: 17549 - DNA, 280 bp, Homo sapiens
  misc_feature 1..280: note = chr2:71503823-71504103
  misc_feature 1..280: note = hyper
  source 1..280: mol_type = genomic DNA
ccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagc

SEQ ID NO: 17550 - DNA, 160 bp, Homo sapiens
  misc_feature 1..160: note = chr2:71504148-71504308
  misc_feature 1..160: note = hyper
  source 1..160: mol_type = genomic DNA
ggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtc

SEQ ID NO: 17551 - DNA, 146 bp, Homo sapiens; identical to SEQ ID NO: 6210
  misc_feature 1..146: note = chr2:71681047-71681193
  misc_feature 1..146: note = hyper
  source 1..146: mol_type = genomic DNA

SEQ ID NO: 17552 - DNA, 30 bp, Homo sapiens; identical to SEQ ID NO: 6211
  misc_feature 1..30: note = chr2:71694331-71694361
  misc_feature 1..30: note = hyper
  source 1..30: mol_type = genomic DNA

SEQ ID NO: 17553 - DNA, 127 bp, Homo sapiens; identical to SEQ ID NO: 6212
  misc_feature 1..127: note = chr2:72374563-72374690
  misc_feature 1..127: note = hyper
  source 1..127: mol_type = genomic DNA

SEQ ID NO: 17554 - DNA, 58 bp, Homo sapiens; identical to SEQ ID NO: 6214
  misc_feature 1..58: note = chr2:73142033-73142091
  misc_feature 1..58: note = hyper
  source 1..58: mol_type = genomic DNA

SEQ ID NO: 17555 - DNA, 30 bp, Homo sapiens; identical to SEQ ID NO: 6215
  misc_feature 1..30: note = chr2:73143902-73143932
  misc_feature 1..30: note = hyper
  source 1..30: mol_type = genomic DNA

SEQ ID NO: 17556 - DNA, 85 bp, Homo sapiens
  misc_feature 1..85: note = chr2:73145555-73145640
  misc_feature 1..85: note = hyper
  source 1..85: mol_type = genomic DNA
gatgcgggggaggctcgggggcgcgcggggctgtttagaagttactgccgggaaggctgcaggtccgcggaggtagattcccagg

SEQ ID NO: 17557 - DNA, 30 bp, Homo sapiens; identical to SEQ ID NO: 6217
  misc_feature 1..30: note = chr2:73146224-73146254
  misc_feature 1..30: note = hyper
  source 1..30: mol_type = genomic DNA

SEQ ID NO: 17558 - DNA, 53 bp, Homo sapiens; identical to SEQ ID NO: 6222
  misc_feature 1..53: note = chr2:73152398-73152451
  misc_feature 1..53: note = hyper
  source 1..53: mol_type = genomic DNA

SEQ ID NO: 17559 - DNA, 36 bp, Homo sapiens; identical to SEQ ID NO: 6224
  misc_feature 1..36: note = chr2:73152959-73152995
  misc_feature 1..36: note = hyper
  source 1..36: mol_type = genomic DNA

SEQ ID NO: 17560 - DNA, 13 bp, Homo sapiens
  misc_feature 1..13: note = chr2:73430743-73430756
  misc_feature 1..13: note = hyper
  source 1..13: mol_type = genomic DNA
tgcatgcaatgct

SEQ ID NO: 17561 - DNA, 32 bp, Homo sapiens; identical to SEQ ID NO: 6228
  misc_feature 1..32: note = chr2:73512107-73512139
  misc_feature 1..32: note = hyper
  source 1..32: mol_type = genomic DNA

SEQ ID NO: 17562 - DNA, 187 bp, Homo sapiens
  misc_feature 1..187: note = chr2:73518261-73518448
  misc_feature 1..187: note = hyper
  source 1..187: mol_type = genomic DNA
ggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgctt

SEQ ID NO: 17563 - DNA, 73 bp, Homo sapiens
  misc_feature 1..73: note = chr2:73518919-73518992
  misc_feature 1..73: note = hyper
  source 1..73: mol_type = genomic DNA
gcggccgcgggcagaagcagcgcgtgctgcatttgccgccgcggcgccccttgcgtcgcgccttggcctgggg

SEQ ID NO: 17564 - DNA, 59 bp, Homo sapiens; identical to SEQ ID NO: 6230
  misc_feature 1..59: note = chr2:73519211-73519270
  misc_feature 1..59: note = hyper
  source 1..59: mol_type = genomic DNA

SEQ ID NO: 17565 - DNA, 56 bp, Homo sapiens
  misc_feature 1..56: note = chr2:73519523-73519579
  misc_feature 1..56: note = hyper
  source 1..56: mol_type = genomic DNA
ctcatacaggcactgcgagggggcacccgcgcaaggcgaggcctcccagaacgcct

SEQ ID NO: 17566 - DNA, 151 bp, Homo sapiens; identical to SEQ ID NO: 6232
  misc_feature 1..151: note = chr2:73520242-73520393
  misc_feature 1..151: note = hyper
  source 1..151: mol_type = genomic DNA

SEQ ID NO: 17567 - DNA, 44 bp, Homo sapiens; identical to SEQ ID NO: 6233
  misc_feature 1..44: note = chr2:74726199-74726243
  misc_feature 1..44: note = hyper
  source 1..44: mol_type = genomic DNA

SEQ ID NO: 17568 - DNA, 89 bp, Homo sapiens
  misc_feature 1..89: note = chr2:74741387-74741476
  misc_feature 1..89: note = hyper
  source 1..89: mol_type = genomic DNA
ccatgctcgggcccctcccgcgctgagcctggctcctaacaccctggccccctgtccccctccccgcacatctccgccagccagccttc

SEQ ID NO: 17569 - DNA, 60 bp, Homo sapiens
  misc_feature 1..60: note = chr2:74741775-74741835
  misc_feature 1..60: note = hyper
  source 1..60: mol_type = genomic DNA
gggatgctgctgtttcggggaccccggcgccctgccttggccagccccgcgggcccctga

SEQ ID NO: 17570-17571 - skipped (2 entries)

SEQ ID NO: 17572 - DNA, 67 bp, Homo sapiens; identical to SEQ ID NO: 6243
  misc_feature 1..67: note = chr2:75426808-75426875
  misc_feature 1..67: note = hyper
  source 1..67: mol_type = genomic DNA

SEQ ID NO: 17573 - DNA, 116 bp, Homo sapiens
  misc_feature 1..116: note = chr2:75427814-75427930
  misc_feature 1..116: note = hyper
  source 1..116: mol_type = genomic DNA
ctgcaggcagagttccgcggaaaactgaaccccgggagtcctcaggggcccatctaccccggtgcaccgccccctcctttcactgcggggactcggagctgtgggactggagcgcg

SEQ ID NO: 17574 - DNA, 264 bp, Homo sapiens; identical to SEQ ID NO: 6245
  misc_feature 1..264: note = chr2:75787807-75788071
  misc_feature 1..264: note = hyper
  source 1..264: mol_type = genomic DNA

SEQ ID NO: 17575 - DNA, 136 bp, Homo sapiens; identical to SEQ ID NO: 6246
  misc_feature 1..136: note = chr2:79740169-79740305
  misc_feature 1..136: note = hyper
  source 1..136: mol_type = genomic DNA

SEQ ID NO: 17576 - DNA, 233 bp, Homo sapiens
  misc_feature 1..233: note = chr2:80530022-80530255
  misc_feature 1..233: note = hyper
  source 1..233: mol_type = genomic DNA
ttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgc

SEQ ID NO: 17577 - DNA, 66 bp, Homo sapiens; identical to SEQ ID NO: 2000
  misc_feature 1..66: note = chr2:80530256-80530322
  misc_feature 1..66: note = hyper
  source 1..66: mol_type = genomic DNA

SEQ ID NO: 17578 - DNA, 15 bp, Homo sapiens
  misc_feature 1..15: note = chr2:80530572-80530587
  misc_feature 1..15: note = hyper
  source 1..15: mol_type = genomic DNA
ctggttggaactcag

SEQ ID NO: 17579 - DNA, 39 bp, Homo sapiens; identical to SEQ ID NO: 6250
  misc_feature 1..39: note = chr2:80531574-80531613
  misc_feature 1..39: note = hyper
  source 1..39: mol_type = genomic DNA

SEQ ID NO: 17580 - DNA, 192 bp, Homo sapiens; identical to SEQ ID NO: 6251
  misc_feature 1..192: note = chr2:80531821-80532013
  misc_feature 1..192: note = hyper
  source 1..192: mol_type = genomic DNA

SEQ ID NO: 17581 - DNA, 14 bp, Homo sapiens
  misc_feature 1..14: note = chr2:80549571-80549585
  misc_feature 1..14: note = hyper
  source 1..14: mol_type = genomic DNA
cacaattcgggccc

SEQ ID NO: 17582 - DNA, 15 bp, Homo sapiens
  misc_feature 1..15: note = chr2:85361295-85361310
  misc_feature 1..15: note = hyper
  source 1..15: mol_type = genomic DNA
cgcacccttgccctc

SEQ ID NO: 17583 - DNA, 144 bp, Homo sapiens
  misc_feature 1..144: note = chr2:87016636-87016780
  misc_feature 1..144: note = hyper
  source 1..144: mol_type = genomic DNA
gcctcagatctcggtttcccaccacttggacagcccttgactctacctacagtatcagggctgtccctggcatgggctctccccgcggtgcgtgccgcccccgccccgggcccccgcacgcctcacctgcgccccccgccgctg

SEQ ID NO: 17584 - DNA, 67 bp, Homo sapiens
  misc_feature 1..67: note = chr2:87017729-87017796
  misc_feature 1..67: note = hyper
  source 1..67: mol_type = genomic DNA
tcagctccactgtctcgcccaggttccaggtccgatccagcggcgacacccggaactggctcggcct

SEQ ID NO: 17585 - DNA, 302 bp, Homo sapiens; identical to SEQ ID NO: 6258
  misc_feature 1..302: note = chr2:87088727-87089029
  misc_feature 1..302: note = hyper
  source 1..302: mol_type = genomic DNA

SEQ ID NO: 17586 - DNA, 16 bp, Homo sapiens
  misc_feature 1..16: note = chr2:88751800-88751816
  misc_feature 1..16: note = hyper
  source 1..16: mol_type = genomic DNA
ggggcggcggcggcgg

SEQ ID NO: 17587 - DNA, 113 bp, Homo sapiens
  misc_feature 1..113: note = chr2:88751942-88752055
  misc_feature 1..113: note = hyper
  source 1..113: mol_type = genomic DNA
gtaaggcgccctggctgccgggggggcgcccggggcggcggcggtggcggcgggcgggggcaggccgggctgcgaatacactccgaagttgtcgccgcagtagagggccatgt

SEQ ID NO: 17588 - DNA, 155 bp, Homo sapiens
  misc_feature 1..155: note = chr2:88752285-88752440
  misc_feature 1..155: note = hyper
  source 1..155: mol_type = genomic DNA
ggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagc

SEQ ID NO: 17589 - DNA, 200 bp, Homo sapiens
  misc_feature 1..200: note = chr2:89065278-89065478
  misc_feature 1..200: note = hyper
  source 1..200: mol_type = genomic DNA
gctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacgg

SEQ ID NO: 17590 - DNA, 146 bp, Homo sapiens; identical to SEQ ID NO: 6265
  misc_feature 1..146: note = chr2:91635198-91635344
  misc_feature 1..146: note = hyper
  source 1..146: mol_type = genomic DNA

SEQ ID NO: 17591 - DNA, 30 bp, Homo sapiens; identical to SEQ ID NO: 6266
  misc_feature 1..30: note = chr2:95664061-95664091
  misc_feature 1..30: note = hyper
  source 1..30: mol_type = genomic DNA

SEQ ID NO: 17592 - DNA, 10 bp, Homo sapiens
  misc_feature 1..10: note = chr2:95691026-95691036
  misc_feature 1..10: note = hyper
  source 1..10: mol_type = genomic DNA
ggtcgcgcac

SEQ ID NO: 17593 - DNA, 231 bp, Homo sapiens
  misc_feature 1..231: note = chr2:95691269-95691500
  misc_feature 1..231: note = hyper
  source 1..231: mol_type = genomic DNA
cacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggc

SEQ ID NO: 17594 - DNA, 29 bp, Homo sapiens
  misc_feature 1..29: note = chr2:95691501-95691530
  misc_feature 1..29: note = hyper
  source 1..29: mol_type = genomic DNA
ctcgtcccgtcccaaggccgacgccagca

SEQ ID NO: 17595 - DNA, 59 bp, Homo sapiens; identical to SEQ ID NO: 6271
  misc_feature 1..59: note = chr2:96012452-96012511
  misc_feature 1..59: note = hyper
  source 1..59: mol_type = genomic DNA

SEQ ID NO: 17596 - DNA, 44 bp, Homo sapiens; identical to SEQ ID NO: 6272
  misc_feature 1..44: note = chr2:96781940-96781984
  misc_feature 1..44: note = hyper
  source 1..44: mol_type = genomic DNA

SEQ ID NO: 17597 - DNA, 137 bp, Homo sapiens; identical to SEQ ID NO: 6273
  misc_feature 1..137: note = chr2:96782022-96782159
  misc_feature 1..137: note = hyper
  source 1..137: mol_type = genomic DNA

SEQ ID NO: 17598 - DNA, 15 bp, Homo sapiens
  misc_feature 1..15: note = chr2:97193049-97193064
  misc_feature 1..15: note = hyper
  source 1..15: mol_type = genomic DNA
cggcagcagagcctg

SEQ ID NO: 17599 - DNA, 11 bp, Homo sapiens
  misc_feature 1..11: note = chr2:97193626-97193637
  misc_feature 1..11: note = hyper
  source 1..11: mol_type = genomic DNA
aatcgccgtta

SEQ ID NO: 17600 - DNA, 227 bp, Homo sapiens
  misc_feature 1..227: note = chr2:98963599-98963826
  misc_feature 1..227: note = hyper
  source 1..227: mol_type = genomic DNA
caacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagc

SEQ ID NO: 17601 - DNA, 73 bp, Homo sapiens
  misc_feature 1..73: note = chr2:98964645-98964718
  misc_feature 1..73: note = hyper
  source 1..73: mol_type = genomic DNA
gcctcggttcagccacagagaggggcctcctcctgtgtagatgcccggaggggaggagcggtggttcttgggg

SEQ ID NO: 17602 - DNA, 136 bp, Homo sapiens; identical to SEQ ID NO: 6283
  misc_feature 1..136: note = chr2:100720916-100721052
  misc_feature 1..136: note = hyper
  source 1..136: mol_type = genomic DNA

SEQ ID NO: 17603 - skipped

SEQ ID NO: 17604 - DNA, 170 bp, Homo sapiens; identical to SEQ ID NO: 6289
  misc_feature 1..170: note = chr2:101034025-101034195
  misc_feature 1..170: note = hyper
  source 1..170: mol_type = genomic DNA

SEQ ID NO: 17605 - DNA, 30 bp, Homo sapiens; identical to SEQ ID NO: 6290
  misc_feature 1..30: note = chr2:102090404-102090434
  misc_feature 1..30: note = hyper
  source 1..30: mol_type = genomic DNA

SEQ ID NO: 17606 - DNA, 53 bp, Homo sapiens; identical to SEQ ID NO: 6291
  misc_feature 1..53: note = chr2:102090961-102091014
  misc_feature 1..53: note = hyper
  source 1..53: mol_type = genomic DNA

SEQ ID NO: 17607 - DNA, 107 bp, Homo sapiens
  misc_feature 1..107: note = chr2:105458974-105459081
  misc_feature 1..107: note = hyper
  source 1..107: mol_type = genomic DNA
aaagagggagatgcccgtgtagagaaccgaggaggggggctggggtagaataatcagctctaaggttgcagatttagatctcaaggctgaaaaggataagcttccac

SEQ ID NO: 17608 - skipped

SEQ ID NO: 17609 - DNA, 21 bp, Homo sapiens
  misc_feature 1..21: note = chr2:105461166-105461187
  misc_feature 1..21: note = hyper
  source 1..21: mol_type = genomic DNA
ccggtgggcagccctcgaccc

SEQ ID NO: 17610 - DNA, 31 bp, Homo sapiens
  misc_feature 1..31: note = chr2:105461243-105461274
  misc_feature 1..31: note = hyper
  source 1..31: mol_type = genomic DNA
ggggttaaccaggcaccgacctgaggcgccc

SEQ ID NO: 17611 - skipped

SEQ ID NO: 17612 - DNA, 30 bp, Homo sapiens; identical to SEQ ID NO: 6299
  misc_feature 1..30: note = chr2:105468569-105468599
  misc_feature 1..30: note = hyper
  source 1..30: mol_type = genomic DNA

SEQ ID NO: 17613 - DNA, 123 bp, Homo sapiens
  misc_feature 1..123: note = chr2:105468908-105469031
  misc_feature 1..123: note = hyper
  source 1..123: mol_type = genomic DNA
cggagcgcaccggcggccgctcctcggctgcgtcctgggctgccgctcgggctcgggactgccagatgcaggctctggctgggggcggcgggcgcaagcgggcgcacccgcagctaggggtgc

SEQ ID NO: 17614 - DNA, 259 bp, Homo sapiens
  misc_feature 1..259: note = chr2:105470091-105470350
  misc_feature 1..259: note = hyper
  source 1..259: mol_type = genomic DNA
ggggtgagcaacccgacgcgtactaggtggggtgggcaggttgctatttttcatgtttcccccttcgttttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgaggggg

SEQ ID NO: 17615 - DNA, 167 bp, Homo sapiens; identical to SEQ ID NO: 6304
  misc_feature 1..167: note = chr2:105471573-105471740
  misc_feature 1..167: note = hyper
  source 1..167: mol_type = genomic DNA

SEQ ID NO: 17616 - DNA, 174 bp, Homo sapiens
  misc_feature 1..174: note = chr2:105472057-105472231
  misc_feature 1..174: note = hyper
  source 1..174: mol_type = genomic DNA
cggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcgg

SEQ ID NO: 17617 - DNA, 403 bp, Homo sapiens
  misc_feature 1..403: note = chr2:105472845-105473248
  misc_feature 1..403: note = hyper
  source 1..403: mol_type = genomic DNA
accacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaa

SEQ ID NO: 17618 - DNA, 215 bp, Homo sapiens; identical to SEQ ID NO: 6307
  misc_feature 1..215: note = chr2:105473599-105473814
  misc_feature 1..215: note = hyper
  source 1..215: mol_type = genomic DNA

SEQ ID NO: 17619 - DNA, 13 bp, Homo sapiens
  misc_feature 1..13: note = chr2:105479089-105479102
  misc_feature 1..13: note = hyper
  source 1..13: mol_type = genomic DNA
gccagactgtggc

SEQ ID NO: 17620 - DNA, 156 bp, Homo sapiens
  misc_feature 1..156: note = chr2:105488281-105488437
  misc_feature 1..156: note = hyper
  source 1..156: mol_type = genomic DNA
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacc

SEQ ID NO: 17621 - DNA, 736 bp, Homo sapiens
  misc_feature 1..736: note = chr2:105488496-105489232
  misc_feature 1..736: note = hyper
  source 1..736: mol_type = genomic DNA
catcgcgctccccacccccgaacacacacacacagacacacacacacacacactcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaa

SEQ ID NO: 17622 - DNA, 36 bp, Homo sapiens
  misc_feature 1..36: note = chr2:105760945-105760981
  misc_feature 1..36: note = hyper
  source 1..36: mol_type = genomic DNA
gaggccacgcggggacggaggaggcagagaggacgg

SEQ ID NO: 17623 - DNA, 47 bp, Homo sapiens
  misc_feature 1..47: note = chr2:105761037-105761084
  misc_feature 1..47: note = hyper
  source 1..47: mol_type = genomic DNA
caaccaccaccaccatcaccatcactgactgtcgcccatcccagctc

SEQ ID NO: 17624 - DNA, 95 bp, Homo sapiens; identical to SEQ ID NO: 6312
  misc_feature 1..95: note = chr2:106014945-106015040
  misc_feature 1..95: note = hyper
  source 1..95: mol_type = genomic DNA

SEQ ID NO: 17625 - DNA, 11 bp, Homo sapiens
  misc_feature 1..11: note = chr2:107103854-107103865
  misc_feature 1..11: note = hyper
  source 1..11: mol_type = genomic DNA
cggggccaggt

SEQ ID NO: 17626 - DNA, 138 bp, Homo sapiens
  misc_feature 1..138: note = chr2:107103928-107104066
  misc_feature 1..138: note = hyper
  source 1..138: mol_type = genomic DNA
aggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttgg

SEQ ID NO: 17627 - DNA, 43 bp, Homo sapiens; identical to SEQ ID NO: 2030
  misc_feature 1..43: note = chr2:107502865-107502908
  misc_feature 1..43: note = hyper
  source 1..43: mol_type = genomic DNA

SEQ ID NO: 17628 - DNA, 214 bp, Homo sapiens
  misc_feature 1..214: note = chr2:107503670-107503884
  misc_feature 1..214: note = hyper
  source 1..214: mol_type = genomic DNA
gcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccc

SEQ ID NO: 17629 - DNA, 73 bp, Homo sapiens; identical to SEQ ID NO: 6317
  misc_feature 1..73: note = chr2:108603211-108603284
  misc_feature 1..73: note = hyper
  source 1..73: mol_type = genomic DNA

SEQ ID NO: 17630 - DNA, 51 bp, Homo sapiens
  misc_feature 1..51: note = chr2:109648222-109648273
  misc_feature 1..51: note = hyper
  source 1..51: mol_type = genomic DNA
cacaggcgggataaagctgccccactttgcccccagcgaagagaaccctcc

SEQ ID NO: 17631 - DNA, 30 bp, Homo sapiens; identical to SEQ ID NO: 6319
  misc_feature 1..30: note = chr2:109744973-109745003
  misc_feature 1..30: note = hyper
  source 1..30: mol_type = genomic DNA

SEQ ID NO: 17632 - DNA, 45 bp, Homo sapiens; identical to SEQ ID NO: 6320
  misc_feature 1..45: note = chr2:109745234-109745279
  misc_feature 1..45: note = hyper
  source 1..45: mol_type = genomic DNA

SEQ ID NO: 17633 - DNA, 300 bp, Homo sapiens; identical to SEQ ID NO: 6321
  misc_feature 1..300: note = chr2:109745500-109745800
  misc_feature 1..300: note = hyper
  source 1..300: mol_type = genomic DNA

SEQ ID NO: 17634 - DNA, 96 bp, Homo sapiens; identical to SEQ ID NO: 6324
  misc_feature 1..96: note = chr2:111490570-111490666
  misc_feature 1..96: note = hyper
  source 1..96: mol_type = genomic DNA

SEQ ID NO: 17635 - DNA, 77 bp, Homo sapiens; identical to SEQ ID NO: 6326
  misc_feature 1..77: note = chr2:112656725-112656802
  misc_feature 1..77: note = hyper
  source 1..77: mol_type = genomic DNA

SEQ ID NO: 17636 - DNA, 24 bp, Homo sapiens
  misc_feature 1..24: note = chr2:114256954-114256978
  misc_feature 1..24: note = hyper
  source 1..24: mol_type = genomic DNA
acgaggaggaggaggcgagccaga

SEQ ID NO: 17637 - DNA, 51 bp, Homo sapiens
  misc_feature 1..51: note = chr2:114257137-114257188
  misc_feature 1..51: note = hyper
  source 1..51: mol_type = genomic DNA
cccggcagccggcaaagcccccctactcgtacatcgcgctcatcaccatgg

SEQ ID NO: 17638 - DNA, 54 bp, Homo sapiens; identical to SEQ ID NO: 6329
  misc_feature 1..54: note = chr2:114260999-114261053
  misc_feature 1..54: note = hyper
  source 1..54: mol_type = genomic DNA

SEQ ID NO: 17639 - DNA, 20 bp, Homo sapiens
  misc_feature 1..20: note = chr2:114261280-114261300
  misc_feature 1..20: note = hyper
  source 1..20: mol_type = genomic DNA
agcccaggcacccctcgact

SEQ ID NO: 17640 - skipped

SEQ ID NO: 17641 - DNA, 48 bp, Homo sapiens
  misc_feature 1..48: note = chr2:119068049-119068097
  misc_feature 1..48: note = hyper
  source 1..48: mol_type = genomic DNA
ccccccaccggccccctcccgggctcccctccccggtaaacagaaaag

SEQ ID NO: 17642 - skipped

SEQ ID NO: 17643 - DNA, 93 bp, Homo sapiens; identical to SEQ ID NO: 6342
  misc_feature 1..93: note = chr2:119593865-119593958
  misc_feature 1..93: note = hyper
  source 1..93: mol_type = genomic DNA

SEQ ID NO: 17644 - DNA, 15 bp, Homo sapiens
  misc_feature 1..15: note = chr2:119600555-119600570
  misc_feature 1..15: note = hyper
  source 1..15: mol_type = genomic DNA
gttgtacagtccctg

SEQ ID NO: 17645 - DNA, 91 bp, Homo sapiens
  misc_feature 1..91: note = chr2:119600747-119600838
  misc_feature 1..91: note = hyper
  source 1..91: mol_type = genomic DNA
cagctgctcggccgtgaacgcggtccgcggccgcttgtcctccttctcgttcttcttcttcttcagcttcctggtgcgcggacctgcagcg

SEQ ID NO: 17646 - DNA, 25 bp, Homo sapiens
  misc_feature 1..25: note = chr2:119603086-119603111
  misc_feature 1..25: note = hyper
  source 1..25: mol_type = genomic DNA
aagcgccgcgcggggaggatgcggg

SEQ ID NO: 17647 - DNA, 38 bp, Homo sapiens
  misc_feature 1..38: note = chr2:119604158-119604196
  misc_feature 1..38: note = hyper
  source 1..38: mol_type = genomic DNA
agctttagacgcgcccgcgccggcggcggctggctggg

SEQ ID NO: 17648 - DNA, 254 bp, Homo sapiens; identical to SEQ ID NO: 6348
  misc_feature 1..254: note = chr2:119604426-119604680
  misc_feature 1..254: note = hyper
  source 1..254: mol_type = genomic DNA

SEQ ID NO: 17649 - DNA, 120 bp, Homo sapiens
  misc_feature 1..120: note = chr2:119604689-119604809
  misc_feature 1..120: note = hyper
  source 1..120: mol_type = genomic DNA
cgcgccgagggccgagtcgcgctgacttttaggttccggctgctgttcttccatgctcggccgccccgccgccccggccgccgcgccggcccccgcccccaccgcctcgctccccacccc

SEQ ID NO: 17650 - DNA, 182 bp, Homo sapiens; identical to SEQ ID NO: 2039
  misc_feature 1..182: note = chr2:119607442-119607624
  misc_feature 1..182: note = hyper
  source 1..182: mol_type = genomic DNA

SEQ ID NO: 17651 - skipped

SEQ ID NO: 17652 - DNA, 71 bp, Homo sapiens; identical to SEQ ID NO: 6353
  misc_feature 1..71: note = chr2:119610540-119610611
  misc_feature 1..71: note = hyper
  source 1..71: mol_type = genomic DNA

SEQ ID NO: 17653 - DNA, 44 bp, Homo sapiens; identical to SEQ ID NO: 6354
  misc_feature 1..44: note = chr2:119611687-119611731
  misc_feature 1..44: note = hyper
  source 1..44: mol_type = genomic DNA

SEQ ID NO: 17654 - DNA, 30 bp, Homo sapiens; identical to SEQ ID NO: 6355
  misc_feature 1..30: note = chr2:119613184-119613214
  misc_feature 1..30: note = hyper
  source 1..30: mol_type = genomic DNA

SEQ ID NO: 17655 - DNA, 158 bp, Homo sapiens
  misc_feature 1..158: note = chr2:119614622-119614780
  misc_feature 1..158: note = hyper
  source 1..158: mol_type = genomic DNA
ctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactg

SEQ ID NO: 17656 - DNA, 203 bp, Homo sapiens
  misc_feature 1..203: note = chr2:119614852-119615055
  misc_feature 1..203: note = hyper
  source 1..203: mol_type = genomic DNA
gccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccg

SEQ ID NO: 17657 - DNA, 14 bp, Homo sapiens
  misc_feature 1..14: note = chr2:119616141-119616155
  misc_feature 1..14: note = hyper
  source 1..14: mol_type = genomic DNA
ctcagcgctcccag

SEQ ID NO: 17658 - DNA, 150 bp, Homo sapiens; identical to SEQ ID NO: 6359
  misc_feature 1..150: note = chr2:119769161-119769311
  misc_feature 1..150: note = hyper
  source 1..150: mol_type = genomic DNA

SEQ ID NO: 17659 - DNA, 167 bp, Homo sapiens
  misc_feature 1..167: note = chr2:119914553-119914720
  misc_feature 1..167: note = hyper
  source 1..167: mol_type = genomic DNA
ggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccag

SEQ ID NO: 17660 - skipped

SEQ ID NO: 17661 - DNA, 440 bp, Homo sapiens; identical to SEQ ID NO: 6361
  misc_feature 1..440: note = chr2:119915167-119915607
  misc_feature 1..440: note = hyper
  source 1..440: mol_type = genomic DNA

SEQ ID NO: 17662 - DNA, 39 bp, Homo sapiens; identical to SEQ ID NO: 6363
  misc_feature 1..39: note = chr2:120190272-120190311
  misc_feature 1..39: note = hyper
  source 1..39: mol_type = genomic DNA

SEQ ID NO: 17663 - DNA, 178 bp, Homo sapiens; identical to SEQ ID NO: 6364
  misc_feature 1..178: note = chr2:121104414-121104592
  misc_feature 1..178: note = hyper
  source 1..178: mol_type = genomic DNA

SEQ ID NO: 17664 - DNA, 155 bp, Homo sapiens; identical to SEQ ID NO: 6365
  misc_feature 1..155: note = chr2:121104793-121104948
  misc_feature 1..155: note = hyper
  source 1..155: mol_type = genomic DNA

SEQ ID NO: 17665 - DNA, 75 bp, Homo sapiens; identical to SEQ ID NO: 6366
  misc_feature 1..75: note = chr2:121344942-121345017
  misc_feature 1..75: note = hyper
  source 1..75: mol_type = genomic DNA

SEQ ID NO: 17666 - DNA, 40 bp, Homo sapiens; identical to SEQ ID NO: 6367
  misc_feature 1..40: note = chr2:121493902-121493942
  misc_feature 1..40: note = hyper
  source 1..40: mol_type = genomic DNA

SEQ ID NO: 17667 - DNA, 76 bp, Homo sapiens
  misc_feature 1..76: note = chr2:124783097-124783173
  misc_feature 1..76: note = hyper
  source 1..76: mol_type = genomic DNA
gagcgagtgcctctccaagcgggggtgggagggggtcaggctgtgcagaggagagagacagcgagaagaagccgcg

SEQ ID NO: 17668 - DNA, 30 bp, Homo sapiens; identical to SEQ ID NO: 6370
  misc_feature 1..30: note = chr2:124783375-124783405
  misc_feature 1..30: note = hyper
  source 1..30: mol_type = genomic DNA

SEQ ID NO: 17669 - DNA, 324 bp, Homo sapiens
  misc_feature 1..324: note = chr2:127783257-127783581
  misc_feature 1..324: note = hyper
  source 1..324: mol_type = genomic DNA
actctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactg

SEQ ID NO: 17670 - DNA, 75 bp, Homo sapiens
  misc_feature 1..75: note = chr2:127976392-127976467
  misc_feature 1..75: note = hyper
  source 1..75: mol_type = genomic DNA
gctgggccgggcacccggggaggcggacgatgggcgaaggcatcggagggcgccgccgcggctcgggtgcagtgc

SEQ ID NO: 17671 - DNA, 86 bp, Homo sapiens
  misc_feature 1..86: note = chr2:127976672-127976758
  misc_feature 1..86: note = hyper
  source 1..86: mol_type = genomic DNA
ccgagcctccgtcccctcttcccccgccattacaaaatacaaaaaggactagaaatgaatacacacggtctcggccacctaaggac

SEQ ID NO: 17672 - DNA, 28 bp, Homo sapiens
  misc_feature 1..28: note = chr2:128421822-128421850
  misc_feature 1..28: note = hyper
  source 1..28: mol_type = genomic DNA
gccgccgcagctttccggccattgtccc

SEQ ID NO: 17673 - DNA, 91 bp, Homo sapiens; identical to SEQ ID NO: 6377
  misc_feature 1..91: note = chr2:128433386-128433477
  misc_feature 1..91: note = hyper
  source 1..91: mol_type = genomic DNA

SEQ ID NO: 17674 - DNA, 15 bp, Homo sapiens
  misc_feature 1..15: note = chr2:130737190-130737205
  misc_feature 1..15: note = hyper
  source 1..15: mol_type = genomic DNA
aaaactgtgttgagg

SEQ ID NO: 17675 - DNA, 162 bp, Homo sapiens; identical to SEQ ID NO: 2046
  misc_feature 1..162: note = chr2:130737475-130737637
  misc_feature 1..162: note = hyper
  source 1..162: mol_type = genomic DNA

SEQ ID NO: 17676 - DNA, 33 bp, Homo sapiens
  misc_feature 1..33: note = chr2:130763551-130763584
  misc_feature 1..33: note = hyper
  source 1..33: mol_type = genomic DNA
cctccgccaggcctgcgctgcctcgccccggga

SEQ ID NO: 17677 - DNA, 19 bp, Homo sapiens
  misc_feature 1..19: note = chr2:130763623-130763642
  misc_feature 1..19: note = hyper
  source 1..19: mol_type = genomic DNA
ggcccgtttcctttcagcg

SEQ ID NO: 17678 - DNA, 198 bp, Homo sapiens; identical to SEQ ID NO: 6382
  misc_feature 1..198: note = chr2:131484889-131485087
  misc_feature 1..198: note = hyper
  source 1..198: mol_type = genomic DNA

SEQ ID NO: 17679 - DNA, 89 bp, Homo sapiens; identical to SEQ ID NO: 6383
  misc_feature 1..89: note = chr2:131485343-131485432
  misc_feature 1..89: note = hyper
  source 1..89: mol_type = genomic DNA

SEQ ID NO: 17680 - DNA, 301 bp, Homo sapiens; identical to SEQ ID NO: 6384
  misc_feature 1..301: note = chr2:131513559-131513860
  misc_feature 1..301: note = hyper
  source 1..301: mol_type = genomic DNA

SEQ ID NO: 17681 - DNA, 54 bp, Homo sapiens; identical to SEQ ID NO: 6385
  misc_feature 1..54: note = chr2:131595112-131595166
  misc_feature 1..54: note = hyper
  source 1..54: mol_type = genomic DNA

SEQ ID NO: 17682 - DNA, 25 bp, Homo sapiens
  misc_feature 1..25: note = chr2:131720827-131720852
  misc_feature 1..25: note = hyper
  source 1..25: mol_type = genomic DNA
caggagggtcgcaggcgcccggtgg

SEQ ID NO: 17683 - DNA, 35 bp, Homo sapiens
  misc_feature 1..35: note = chr2:131792225-131792260
  misc_feature 1..35: note = hyper
  source 1..35: mol_type = genomic DNA
ccctccccaaagcgccggtgccaggcgttttggcc

SEQ ID NO: 17684 - DNA, 35 bp, Homo sapiens; identical to SEQ ID NO: 6392
  misc_feature 1..35: note = chr2:132088604-132088639
  misc_feature 1..35: note = hyper
  source 1..35: mol_type = genomic DNA

SEQ ID NO: 17685 - DNA, 187 bp, Homo sapiens; identical to SEQ ID NO: 6393
  misc_feature 1..187: note = chr2:132121342-132121529
  misc_feature 1..187: note = hyper
  source 1..187: mol_type = genomic DNA

SEQ ID NO: 17686 - DNA, 50 bp, Homo sapiens
  misc_feature 1..50: note = chr2:132152311-132152361
  misc_feature 1..50: note = hyper
  source 1..50: mol_type = genomic DNA
tgctgagccgaagctcggcggggctgagctccagctgggggcgggtagct

SEQ ID NO: 17687 - DNA, 26 bp, Homo sapiens
  misc_feature 1..26: note = chr2:132182764-132182790
  misc_feature 1..26: note = hyper
  source 1..26: mol_type = genomic DNA
ggcgggcgcgggaggcgggcgcggga

SEQ ID NO: 17688 - DNA, 43 bp, Homo sapiens
  misc_feature 1..43: note = chr2:132767414-132767457
  misc_feature 1..43: note = hyper
  source 1..43: mol_type = genomic DNA
aaccccacaaaaacccgcggcgacggggggaaaaaaccgcggc

SEQ ID NO: 17689 - DNA, 140 bp, Homo sapiens; identical to SEQ ID NO: 6397
  misc_feature 1..140: note = chr2:132767735-132767875
  misc_feature 1..140: note = hyper
  source 1..140: mol_type = genomic DNA

SEQ ID NO: 17690 - DNA, 79 bp, Homo sapiens; identical to SEQ ID NO: 6398
  misc_feature 1..79: note = chr2:132796105-132796184
  misc_feature 1..79: note = hyper
  source 1..79: mol_type = genomic DNA

SEQ ID NO: 17691 - DNA, 101 bp, Homo sapiens
  misc_feature 1..101: note = chr2:133015323-133015424
  misc_feature 1..101: note = hyper
  source 1..101: mol_type = genomic DNA
gggggcctgcggtaccaggaaaaatctgcgtgcggcaaccttgagccttcgcggtctgggcagggggcctggccgctgcgcgtgcgcgcaatccccgaagg

SEQ ID NO: 17692 - DNA, 30 bp, Homo sapiens; identical to SEQ ID NO: 6400
  misc_feature 1..30: note = chr2:133015649-133015679
  misc_feature 1..30: note = hyper
  source 1..30: mol_type = genomic DNA

SEQ ID NO: 17693 - DNA, 26 bp, Homo sapiens
  misc_feature 1..26: note = chr2:133426223-133426249
  misc_feature 1..26: note = hyper
  source 1..26: mol_type = genomic DNA
ccactcctgggtctccgggtagggct

SEQ ID NO: 17694 - DNA, 79 bp, Homo sapiens; identical to SEQ ID NO: 6402
  misc_feature 1..79: note = chr2:133427558-133427637
  misc_feature 1..79: note = hyper
  source 1..79: mol_type = genomic DNA

SEQ ID NO: 17695 - DNA, 321 bp, Homo sapiens; identical to SEQ ID NO: 6403
  misc_feature 1..321: note = chr2:135475874-135476195
  misc_feature 1..321: note = hyper
  source 1..321: mol_type = genomic DNA

SEQ ID NO: 17696 - DNA, 49 bp, Homo sapiens; identical to SEQ ID NO: 6404
  misc_feature 1..49: note = chr2:135476941-135476990
  misc_feature 1..49: note = hyper
  source 1..49: mol_type = genomic DNA

SEQ ID NO: 17697 - DNA, 75 bp, Homo sapiens; identical to SEQ ID NO: 6405
  misc_feature 1..75: note = chr2:136876531-136876606
  misc_feature 1..75: note = hyper
  source 1..75: mol_type = genomic DNA

SEQ ID NO: 17698 - DNA, 11 bp, Homo sapiens
  misc_feature 1..11: note = chr2:137522475-137522486
  misc_feature 1..11: note = hyper
  source 1..11: mol_type = genomic DNA
cccggggactg

SEQ ID NO: 17699 - DNA, 32 bp, Homo sapiens; identical to SEQ ID NO: 6407
  misc_feature 1..32: note = chr2:137522850-137522882
  misc_feature 1..32: note = hyper
  source 1..32: mol_type = genomic DNA

SEQ ID NO: 17700 - DNA, 30 bp, Homo sapiens; identical to SEQ ID NO: 6408
  misc_feature 1..30: note = chr2:137523564-137523594
  misc_feature 1..30: note = hyper
  source 1..30: mol_type = genomic DNA

SEQ ID NO: 17701 - DNA, 163 bp, Homo sapiens
  misc_feature 1..163: note = chr2:139537145-139537308
  misc_feature 1..163: note = hyper
  source 1..163: mol_type = genomic DNA
aagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcac

SEQ ID NO: 17702 - DNA, 149 bp, Homo sapiens; identical to SEQ ID NO: 6411
  misc_feature 1..149: note = chr2:142888097-142888246
  misc_feature 1..149: note = hyper
  source 1..149: mol_type = genomic DNA

SEQ ID NO: 17703 - DNA, 34 bp, Homo sapiens; identical to SEQ ID NO: 6412
  misc_feature 1..34: note = chr2:142888484-142888518
  misc_feature 1..34: note = hyper
  source 1..34: mol_type = genomic DNA

SEQ ID NO: 17704 - DNA, 52 bp, Homo sapiens
  misc_feature 1..52: note = chr2:144694315-144694367
  misc_feature 1..52: note = hyper
  source 1..52: mol_type = genomic DNA
tggttttgcttagtgcgtcttcatcgtattccctcgctgaggactgagcctg

SEQ ID NO: 17705 - DNA, 122 bp, Homo sapiens
  misc_feature 1..122: note = chr2:144695135-144695257
  misc_feature 1..122: note = hyper
  source 1..122: mol_type = genomic DNA
gcggtgcgccaggccagacctgaccgagggcggaagacccgagcggcagggaggcagaaagaaaagaggtagcaagccccagacaagggatccttaattacagataaaaggcaaacaaaacc

SEQ ID NO: 17706 - DNA, 31 bp, Homo sapiens; identical to SEQ ID NO: 2057
  misc_feature 1..31: note = chr2:144695258-144695289
  misc_feature 1..31: note = hyper
  source 1..31: mol_type = genomic DNA

SEQ ID NO: 17707 - DNA, 77 bp, Homo sapiens
  misc_feature 1..77: note = chr2:145273327-145273404
  misc_feature 1..77: note = hyper
  source 1..77: mol_type = genomic DNA
acacacgcacacacacgcgtacacacacacaaaacctagagagagagagagagagagagaaaagcatcatttgtctc

SEQ ID NO: 17708 - DNA, 39 bp, Homo sapiens
  misc_feature 1..39: note = chr2:145273751-145273790
  misc_feature 1..39: note = hyper
  source 1..39: mol_type = genomic DNA
ttctttttaaactcagttatcctccgtcagctcccccac

SEQ ID NO: 17709 - DNA, 106 bp, Homo sapiens
  misc_feature 1..106: note = chr2:145274080-145274186
  misc_feature 1..106: note = hyper
  source 1..106: mol_type = genomic DNA
actcagcctggataacgggctcctccagaccatgtagaaactgccgggaaaagtctcgctgcgccctgcgactccttcagtccccggcctgggggcagagcctgct

SEQ ID NO: 17710 - DNA, 56 bp, Homo sapiens
  misc_feature 1..56: note = chr2:145274455-145274511
  misc_feature 1..56: note = hyper
  source 1..56: mol_type = genomic DNA
gcccccgccctgccccaggcggacgctcccgaagcccggccggagacccggcgggc

SEQ ID NO: 17711 - DNA, 238 bp, Homo sapiens
  misc_feature 1..238: note = chr2:145274576-145274814
  misc_feature 1..238: note = hyper
  source 1..238: mol_type = genomic DNA
cggggctgggggcgcggggccccggccggacccccgcgctcggacccccgggtgcctgacgctcactttgcccggcacttccccaacaccccccggtccagccgccgcgcgcgccgggctccggcgccggccgcggagggaggctcgccctagagccctgggcgccgccgccgccgccgcctcggttccttttccctttccccctccttctccctgggtctcgagccgcgtagtggcc

SEQ ID NO: 17712 - DNA, 242 bp, Homo sapiens
  misc_feature 1..242: note = chr2:145275213-145275455
  misc_feature 1..242: note = hyper
  source 1..242: mol_type = genomic DNA
gacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctgg

SEQ ID NO: 17713 - DNA, 132 bp, Homo sapiens; identical to SEQ ID NO: 6420
  misc_feature 1..132: note = chr2:145277493-145277625
  misc_feature 1..132: note = hyper
  source 1..132: mol_type = genomic DNA

SEQ ID NO: 17714 - DNA, 92 bp, Homo sapiens; identical to SEQ ID NO: 2062
  misc_feature 1..92: note = chr2:145281307-145281399
  misc_feature 1..92: note = hyper
  source 1..92: mol_type = genomic DNA

SEQ ID NO: 17715 - DNA, 188 bp, Homo sapiens; identical to SEQ ID NO: 6422
  misc_feature 1..188: note = chr2:145281754-145281942
  misc_feature 1..188: note = hyper
  source 1..188: mol_type = genomic DNA

SEQ ID NO: 17716 - DNA, 36 bp, Homo sapiens; identical to SEQ ID NO: 6423
  misc_feature 1..36: note = chr2:145281943-145281979
  misc_feature 1..36: note = hyper
  source 1..36: mol_type = genomic DNA

SEQ ID NO: 17717 - DNA, 78 bp, Homo sapiens; identical to SEQ ID NO: 6424
  misc_feature 1..78: note = chr2:145282041-145282119
  misc_feature 1..78: note = hyper
  source 1..78: mol_type = genomic DNA

SEQ ID NO: 17718 - DNA, 345 bp, Homo sapiens
  misc_feature 1..345: note = chr2:149633399-149633744
  misc_feature 1..345: note = hyper
  source 1..345: mol_type = genomic DNA
cgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgcct

SEQ ID NO: 17719 - DNA, 92 bp, Homo sapiens
  misc_feature 1..92: note = chr2:149633965-149634057
  misc_feature 1..92: note = hyper
  source 1..92: mol_type = genomic DNA
gatgtggagtcccggcttgatccctcccctctgggatgacctccctcccatgtctgcagaccctctgatgcgcctcacgctgggtggagagg

SEQ ID NO: 17720 - DNA, 198 bp, Homo sapiens; identical to SEQ ID NO: 6428
  misc_feature 1..198: note = chr2:152954698-152954896
  misc_feature 1..198: note = hyper
  source 1..198: mol_type = genomic DNA

SEQ ID NO: 17721 - DNA, 161 bp, Homo sapiens
  misc_feature 1..161: note = chr2:154333374-154333535
  misc_feature 1..161: note = hyper
  source 1..161: mol_type = genomic DNA
aattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacg

SEQ ID NO: 17722 - DNA, 164 bp, Homo sapiens
  misc_feature 1..164: note = chr2:154333567-154333731
  misc_feature 1..164: note = hyper
  source 1..164: mol_type = genomic DNA
cgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccagggga

SEQ ID NO: 17723 - DNA, 73 bp, Homo sapiens
  misc_feature 1..73: note = chr2:154334199-154334272
  misc_feature 1..73: note = hyper
  source 1..73: mol_type = genomic DNA
caaaacctcttaaaacggcacgttacaatcaaaggtatttatcgcccctcccctccagggcagggggggagca

SEQ ID NO: 17724 - DNA, 179 bp, Homo sapiens
  misc_feature 1..179: note = chr2:154335271-154335450
  misc_feature 1..179: note = hyper
  source 1..179: mol_type = genomic DNA
cttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgc

SEQ ID NO: 17725 - DNA, 30 bp, Homo sapiens; identical to SEQ ID NO: 6433
  misc_feature 1..30: note = chr2:154729766-154729796
  misc_feature 1..30: note = hyper
  source 1..30: mol_type = genomic DNA

SEQ ID NO: 17726 - DNA, 103 bp, Homo sapiens
  misc_feature 1..103: note = chr2:157176900-157177003
  misc_feature 1..103: note = hyper
  source 1..103: mol_type = genomic DNA
gaaagggagggacaccgaggaaacaaagttcacccaagtgaatgcgtcctaattgctccaaggctctctccgcaaagtctacgactgcaagccgcaaagtcaa

SEQ ID NO: 17727 - DNA, 30 bp, Homo sapiens; identical to SEQ ID NO: 6437
  misc_feature 1..30: note = chr2:160760685-160760715
  misc_feature 1..30: note = hyper
  source 1..30: mol_type = genomic DNA

SEQ ID NO: 17728 - skipped

SEQ ID NO: 17729 - DNA, 43 bp, Homo sapiens; identical to SEQ ID NO: 6439
  misc_feature 1..43: note = chr2:162095596-162095639
  misc_feature 1..43: note = hyper
  source 1..43: mol_type = genomic DNA

SEQ ID NO: 17730 - DNA, 30 bp, Homo sapiens; identical to SEQ ID NO: 6441
  misc_feature 1..30: note = chr2:162274914-162274944
  misc_feature 1..30: note = hyper
  source 1..30: mol_type = genomic DNA

SEQ ID NO: 17731 - DNA, 38 bp, Homo sapiens; identical to SEQ ID NO: 6449
  misc_feature 1..38: note = chr2:162284338-162284376
  misc_feature 1..38: note = hyper
  source 1..38: mol_type = genomic DNA

SEQ ID NO: 17732 - DNA, 34 bp, Homo sapiens; identical to SEQ ID NO: 6450
  misc_feature 1..34: note = chr2:162930251-162930285
  misc_feature 1..34: note = hyper
  source 1..34: mol_type = genomic DNA

SEQ ID NO: 17733 - DNA, 52 bp, Homo sapiens; identical to SEQ ID NO: 6451
  misc_feature 1..52: note = chr2:162930338-162930390
  misc_feature 1..52: note = hyper
  source 1..52: mol_type = genomic DNA

SEQ ID NO: 17734 - DNA, 25 bp, Homo sapiens
  misc_feature 1..25: note = chr2:163695246-163695271
  misc_feature 1..25: note = hyper
  source 1..25: mol_type = genomic DNA
cggactgccgcgggtgagagggttt

SEQ ID NO: 17735 - DNA, 30 bp, Homo sapiens; identical to SEQ ID NO: 6453
  misc_feature 1..30: note = chr2:163695477-163695507
  misc_feature 1..30: note = hyper
  source 1..30: mol_type = genomic DNA

SEQ ID NO: 17736 - DNA, 141 bp, Homo sapiens; identical to SEQ ID NO: 6454
  misc_feature 1..141: note = chr2:164592629-164592770
  misc_feature 1..141: note = hyper
  source 1..141: mol_type = genomic DNA

SEQ ID NO: 17737 - DNA, 30 bp, Homo sapiens; identical to SEQ ID NO: 6455
  misc_feature 1..30: note = chr2:164593340-164593370
  misc_feature 1..30: note = hyper
  source 1..30: mol_type = genomic DNA

SEQ ID NO: 17738 - DNA, 31 bp, Homo sapiens; identical to SEQ ID NO: 6456
  misc_feature 1..31: note = chr2:167233063-167233094
  misc_feature 1..31: note = hyper
  source 1..31: mol_type = genomic DNA

SEQ ID NO: 17739 - DNA, 36 bp, Homo sapiens
  misc_feature 1..36: note = chr2:168150033-168150069
  misc_feature 1..36: note = hyper
  source 1..36: mol_type = genomic DNA
cacagactttgacagcgcggggatggcattgtgtga

SEQ ID NO: 17740 - DNA, 185 bp, Homo sapiens
  misc_feature 1..185: note = chr2:168150566-168150751
  misc_feature 1..185: note = hyper
  source 1..185: mol_type = genomic DNA
ctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcag

SEQ ID NO: 17741 - DNA, 42 bp, Homo sapiens; identical to SEQ ID NO: 6459
  misc_feature 1..42: note = chr2:170218695-170218737
  misc_feature 1..42: note = hyper
  source 1..42: mol_type = genomic DNA

SEQ ID NO: 17742 - DNA, 175 bp, Homo sapiens; identical to SEQ ID NO: 6460
  misc_feature 1..175: note = chr2:170219365-170219540
  misc_feature 1..175: note = hyper
  source 1..175: mol_type = genomic DNA

SEQ ID NO: 17743 - DNA, 51 bp, Homo sapiens; identical to SEQ ID NO: 6461
  misc_feature 1..51: note = chr2:170219958-170220009
  misc_feature 1..51: note = hyper
  source 1..51: mol_type = genomic DNA

SEQ ID NO: 17744 - DNA, 358 bp, Homo sapiens; identical to SEQ ID NO: 6462
  misc_feature 1..358: note = chr2:171568345-171568703
  misc_feature 1..358: note = hyper
  source 1..358: mol_type = genomic DNA

SEQ ID NO: 17745 - DNA, 214 bp, Homo sapiens
  misc_feature 1..214: note = chr2:171570470-171570684
  misc_feature 1..214: note = hyper
  source 1..214: mol_type = genomic DNA
gggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctg

SEQ ID NO: 17746 - DNA, 168 bp, Homo sapiens
  misc_feature 1..168: note = chr2:171570733-171570901
  misc_feature 1..168: note = hyper
  source 1..168: mol_type = genomic DNA
ttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtg

SEQ ID NO: 17747 - DNA, 35 bp, Homo sapiens; identical to SEQ ID NO: 6464
  misc_feature 1..35: note = chr2:171669891-171669926
  misc_feature 1..35: note = hyper
  source 1..35: mol_type = genomic DNA

SEQ ID NO: 17748 - DNA, 107 bp, Homo sapiens
  misc_feature 1..107: note = chr2:171670242-171670349
  misc_feature 1..107: note = hyper
  source 1..107: mol_type = genomic DNA
tcccccacccacccacgacggggaaaggaataaagggcattgtgggcggagggtcgtgttcccaagtcccagcggtggttgacctaaggaaacgttatcctcggcag

SEQ ID NO: 17749 - DNA, 98 bp, Homo sapiens
  misc_feature 1..98: note = chr2:171671389-171671487
  misc_feature 1..98: note = hyper
  source 1..98: mol_type = genomic DNA
gaaatgtctcaatctcgtgccacaggtgaagtaaacgaatcttcctttccagggaatcacgggttttgggaaaaggttgaggcgagcgggcgtctatg

SEQ ID NO: 17750 - DNA, 79 bp, Homo sapiens; identical to SEQ ID NO: 6468
  misc_feature 1..79: note = chr2:171674129-171674208
  misc_feature 1..79: note = hyper
  source 1..79: mol_type = genomic DNA

SEQ ID NO: 17751 - DNA, 61 bp, Homo sapiens
  misc_feature 1..61: note = chr2:171675592-171675653
  misc_feature 1..61: note = hyper
  source 1..61: mol_type = genomic DNA
tgacctcctcctttccccctgggctgtgttcaaagtctataatcagcggaaatttcgacgt

SEQ ID NO: 17752 - DNA, 36 bp, Homo sapiens; identical to SEQ ID NO: 6472
  misc_feature 1..36: note = chr2:171678013-171678049
  misc_feature 1..36: note = hyper
  source 1..36: mol_type = genomic DNA

SEQ ID NO: 17753 - DNA, 14 bp, Homo sapiens
  misc_feature 1..14: note = chr2:172946211-172946225
  misc_feature 1..14: note = hyper
  source 1..14: mol_type = genomic DNA
gcttcaggaacagg

SEQ ID NO: 17754 - DNA, 136 bp, Homo sapiens
  misc_feature 1..136: note = chr2:172949711-172949847
  misc_feature 1..136: note = hyper
  source 1..136: mol_type = genomic DNA
tcttaggagaacctctgtctgttggccgcctcgggcgcccccagtgcgcgactccgcgctccagaggcagaggtcagtctcctcctgagccgccctagctctgcgccgaactgagtggcagcgacgagaagcggtc

SEQ ID NO: 17755 - DNA, 141 bp, Homo sapiens; identical to SEQ ID NO: 6479
  misc_feature 1..141: note = chr2:172950071-172950212
  misc_feature 1..141: note = hyper
  source 1..141: mol_type = genomic DNA

SEQ ID NO: 17756 - DNA, 292 bp, Homo sapiens; identical to SEQ ID NO: 6480
  misc_feature 1..292: note = chr2:172951251-172951543
  misc_feature 1..292: note = hyper
  source 1..292: mol_type = genomic DNA

SEQ ID NO: 17757 - DNA, 128 bp, Homo sapiens
  misc_feature 1..128: note = chr2:172952393-172952521
  misc_feature 1..128: note = hyper
  source 1..128: mol_type = genomic DNA
aggcgctgtatcttccgcaggcggtagccacggtcggactgagcccctggcaggctaaggcctggatcccggttctcccctcatcacaactcctccctggctctctgagagctgcccccgtgggctga

SEQ ID NO: 17758 - DNA, 249 bp, Homo sapiens
  misc_feature 1..249: note = chr2:172955545-172955794
  misc_feature 1..249: note = hyper
  source 1..249: mol_type = genomic DNA
tgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagaga

SEQ ID NO: 17759 - DNA, 73 bp, Homo sapiens
  misc_feature 1..73: note = chr2:172961325-172961398
  misc_feature 1..73: note = hyper
  source 1..73: mol_type = genomic DNA
gcgggagtacctgggcggcaggcagttggccctggagctcagtgcccgcgttctgcctgagttgggagagccc

SEQ ID NO: 17760 - DNA, 62 bp, Homo sapiens
  misc_feature 1..62: note = chr2:172961598-172961660
  misc_feature 1..62: note = hyper
  source 1..62: mol_type = genomic DNA
ccatttttcattcgcgctttggggagctcagtagagcacggggggagcgtgtctgcgcggcg

SEQ ID NO: 17761 - DNA, 26 bp, Homo sapiens
  misc_feature 1..26: note = chr2:172964795-172964821
  misc_feature 1..26: note = hyper
  source 1..26: mol_type = genomic DNA
gggagggcgggcaggcgggaccggga

SEQ ID NO: 17762 - DNA, 14 bp, Homo sapiens
  misc_feature 1..14: note = chr2:172966250-172966264
  misc_feature 1..14: note = hyper
  source 1..14: mol_type = genomic DNA
tgagtcttttggaa

SEQ ID NO: 17763 - DNA, 610 bp, Homo sapiens
  misc_feature 1..610: note = chr2:172966442-172967052
  misc_feature 1..610: note = hyper
  source 1..610: mol_type = genomic DNA
cccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggt

SEQ ID NO: 17764 - DNA, 395 bp, Homo sapiens; identical to SEQ ID NO: 6489
  misc_feature 1..395: note = chr2:172970975-172971370
  misc_feature 1..395: note = hyper
  source 1..395: mol_type = genomic DNA

SEQ ID NO: 17765 - DNA, 32 bp, Homo sapiens
  misc_feature 1..32: note = chr2:172973218-172973250
  misc_feature 1..32: note = hyper
  source 1..32: mol_type = genomic DNA
tccagccgtggcctttccgcggcgctgggctt

SEQ ID NO: 17766 - DNA, 43 bp, Homo sapiens
  misc_feature 1..43: note = chr2:173099741-173099784
  misc_feature 1..43: note = hyper
  source 1..43: mol_type = genomic DNA
cagcatcggcagcatcgagaaaggtgacgagttctgcaaataa

SEQ ID NO: 17767 - DNA, 283 bp, Homo sapiens
  misc_feature 1..283: note = chr2:173099814-173100097
  misc_feature 1..283: note = hyper
  source 1..283: mol_type = genomic DNA
acgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 17768 - DNA, 164 bp, Homo sapiens
  misc_feature 1..164: note = chr2:173100098-173100262
  misc_feature 1..164: note = hyper
  source 1..164: mol_type = genomic DNA
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagc

SEQ ID NO: 17769 - DNA, 90 bp, Homo sapiens; identical to SEQ ID NO: 6493
  misc_feature 1..90: note = chr2:173600600-173600690
  misc_feature 1..90: note = hyper
  source 1..90: mol_type = genomic DNA

SEQ ID NO: 17770 - DNA, 66 bp, Homo sapiens
  misc_feature 1..66: note = chr2:175190805-175190871
  misc_feature 1..66: note = hyper
  source 1..66: mol_type = genomic DNA
aaagagaagtgttggcgcctcaaacttgaggatcagcttcttgggccccactccagggtgtcgcgg

SEQ ID NO: 17771 - DNA, 20 bp, Homo sapiens
  misc_feature 1..20: note = chr2:175193823-175193843
  misc_feature 1..20: note = hyper
  source 1..20: mol_type = genomic DNA
tatgacgaactagaggctgg

SEQ ID NO: 17772 - DNA, 56 bp, Homo sapiens
  misc_feature 1..56: note = chr2:175197119-175197175
  misc_feature 1..56: note = hyper
  source 1..56: mol_type = genomic DNA
atatgcgagtgcccacgtctagagtctgacagctggaactacggggaaaacggcgg

SEQ ID NO: 17773 - DNA, 62 bp, Homo sapiens
  misc_feature 1..62: note = chr2:175199465-175199527
  misc_feature 1..62: note = hyper
  source 1..62: mol_type = genomic DNA
ccctcgccccccccccgcaagtatcccccactactcccccccacccccgcggccctagctag

SEQ ID NO: 17774 - DNA, 59 bp, Homo sapiens
  misc_feature 1..59: note = chr2:175202652-175202711
  misc_feature 1..59: note = hyper
  source 1..59: mol_type = genomic DNA
agaaaggctccctctttgcccactctccacctccctccaacacccgtctctttcctttt

SEQ ID NO: 17775 - DNA, 30 bp, Homo sapiens; identical to SEQ ID NO: 6510
  misc_feature 1..30: note = chr2:175203142-175203172
  misc_feature 1..30: note = hyper
  source 1..30: mol_type = genomic DNA

SEQ ID NO: 17776 - DNA, 200 bp, Homo sapiens
  misc_feature 1..200: note = chr2:175207028-175207228
  misc_feature 1..200: note = hyper
  source 1..200: mol_type = genomic DNA
gggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttct

SEQ ID NO: 17777 - DNA, 278 bp, Homo sapiens
  misc_feature 1..278: note = chr2:175207258-175207536
  misc_feature 1..278: note = hyper
  source 1..278: mol_type = genomic DNA
gcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacct

SEQ ID NO: 17778 - DNA, 15 bp, Homo sapiens
  misc_feature 1..15: note = chr2:175547140-175547155
  misc_feature 1..15: note = hyper
  source 1..15: mol_type = genomic DNA
cgagacctacggaga

SEQ ID NO: 17779 - DNA, 201 bp, Homo sapiens; identical to SEQ ID NO: 6517
  misc_feature 1..201: note = chr2:175547440-175547641
  misc_feature 1..201: note = hyper
  source 1..201: mol_type = genomic DNA

SEQ ID NO: 17780 - DNA, 43 bp, Homo sapiens; identical to SEQ ID NO: 6519
  misc_feature 1..43: note = chr2:176943640-176943683
  misc_feature 1..43: note = hyper
  source 1..43: mol_type = genomic DNA

SEQ ID NO: 17781 - DNA, 59 bp, Homo sapiens; identical to SEQ ID NO: 240
  misc_feature 1..59: note = chr2:176944346-176944405
  misc_feature 1..59: note = hyper
  source 1..59: mol_type = genomic DNA

SEQ ID NO: 17782 - DNA, 197 bp, Homo sapiens
  misc_feature 1..197: note = chr2:176948848-176949045
  misc_feature 1..197: note = hyper
  source 1..197: mol_type = genomic DNA
gatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttag

SEQ ID NO: 17783 - DNA, 43 bp, Homo sapiens; identical to SEQ ID NO: 2112
  misc_feature 1..43: note = chr2:176949959-176950002
  misc_feature 1..43: note = hyper
  source 1..43: mol_type = genomic DNA

SEQ ID NO: 17784 - DNA, 68 bp, Homo sapiens
  misc_feature 1..68: note = chr2:176950074-176950142
  misc_feature 1..68: note = hyper
  source 1..68: mol_type = genomic DNA
cgacaactttgatagtcataatgacgccggtggcaaccattttaacgaagatcaatcttcactccagg

SEQ ID NO: 17785 - DNA, 30 bp, Homo sapiens; identical to SEQ ID NO: 6529
  misc_feature 1..30: note = chr2:176952943-176952973
  misc_feature 1..30: note = hyper
  source 1..30: mol_type = genomic DNA

SEQ ID NO: 17786 - DNA, 68 bp, Homo sapiens; identical to SEQ ID NO: 244
  misc_feature 1..68: note = chr2:176957347-176957415
  misc_feature 1..68: note = hyper
  source 1..68: mol_type = genomic DNA

SEQ ID NO: 17787 - DNA, 202 bp, Homo sapiens
  misc_feature 1..202: note = chr2:176957919-176958121
  misc_feature 1..202: note = hyper
  source 1..202: mol_type = genomic DNA
ctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacat

SEQ ID NO: 17788 - DNA, 76 bp, Homo sapiens
  misc_feature 1..76: note = chr2:176959213-176959289
  misc_feature 1..76: note = hyper
  source 1..76: mol_type = genomic DNA
tggctctaaatcagccggacatgtgcgtctaccgaagagggaggaagaagagagtgccttacaccaaactgcagct

SEQ ID NO: 17789 - DNA, 18 bp, Homo sapiens
  misc_feature 1..18: note = chr2:176965492-176965510
  misc_feature 1..18: note = hyper
  source 1..18: mol_type = genomic DNA
gcgcgtggccagggccgg

SEQ ID NO: 17790 - DNA, 48 bp, Homo sapiens; identical to SEQ ID NO: 6539
  misc_feature 1..48: note = chr2:176969256-176969304
  misc_feature 1..48: note = hyper
  source 1..48: mol_type = genomic DNA

SEQ ID NO: 17791 - DNA, 30 bp, Homo sapiens; identical to SEQ ID NO: 6542
  misc_feature 1..30: note = chr2:176971402-176971432
  misc_feature 1..30: note = hyper
  source 1..30: mol_type = genomic DNA

SEQ ID NO: 17792 - DNA, 30 bp, Homo sapiens; identical to SEQ ID NO: 6543
  misc_feature 1..30: note = chr2:176972908-176972938
  misc_feature 1..30: note = hyper
  source 1..30: mol_type = genomic DNA

SEQ ID NO: 17793 - DNA, 30 bp, Homo sapiens; identical to SEQ ID NO: 6548
  misc_feature 1..30: note = chr2:176983753-176983783
  misc_feature 1..30: note = hyper
  source 1..30: mol_type = genomic DNA

SEQ ID NO: 17794 - skipped

SEQ ID NO: 17795 - DNA, 209 bp, Homo sapiens
  misc_feature 1..209: note = chr2:176986848-176987057
  misc_feature 1..209: note = hyper
  source 1..209: mol_type = genomic DNA
acattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcc

SEQ ID NO: 17796 - DNA, 33 bp, Homo sapiens
  misc_feature 1..33: note = chr2:176993514-176993547
  misc_feature 1..33: note = hyper
  source 1..33: mol_type = genomic DNA
atttcacaggcttggcggaggaagtaggatcgt

SEQ ID NO: 17797 - DNA, 38 bp, Homo sapiens; identical to SEQ ID NO: 6554
  misc_feature 1..38: note = chr2:176996261-176996299
  misc_feature 1..38: note = hyper
  source 1..38: mol_type = genomic DNA

SEQ ID NO: 17798 - DNA, 101 bp, Homo sapiens; identical to SEQ ID NO: 6558
  misc_feature 1..101: note = chr2:177004982-177005083
  misc_feature 1..101: note = hyper
  source 1..101: mol_type = genomic DNA

SEQ ID NO: 17799 - DNA, 35 bp, Homo sapiens; identical to SEQ ID NO: 6559
  misc_feature 1..35: note = chr2:177005582-177005617
  misc_feature 1..35: note = hyper
  source 1..35: mol_type = genomic DNA

SEQ ID NO: 17800 - DNA, 55 bp, Homo sapiens; identical to SEQ ID NO: 6560
  misc_feature 1..55: note = chr2:177042646-177042701
  misc_feature 1..55: note = hyper
  source 1..55: mol_type = genomic DNA

SEQ ID NO: 17801 - DNA, 58 bp, Homo sapiens
  misc_feature 1..58: note = chr2:177042926-177042984
  misc_feature 1..58: note = hyper
  source 1..58: mol_type = genomic DNA
ggcggggtgggctggcgctcctgatccacctggaacacttttgcaaagacagacggtg

SEQ ID NO: 17802 - DNA, 19 bp, Homo sapiens
  misc_feature 1..19: note = chr2:177053935-177053954
  misc_feature 1..19: note = hyper
  source 1..19: mol_type = genomic DNA
cctcggccgtcttctcggg

SEQ ID NO: 17803 - DNA, 114 bp, Homo sapiens
  misc_feature 1..114: note = chr2:177053999-177054113
  misc_feature 1..114: note = hyper
  source 1..114: mol_type = genomic DNA
cggcgaacccggcccttttccggcttgtctcaaagcgtcagccgacggccaccctggtgctttccagaccgcatccccggccccaggcacctaccccaagtccgtctctcccgc

SEQ ID NO: 17804 - DNA, 12 bp, Homo sapiens
  misc_feature 1..12: note = chr2:177054351-177054363
  misc_feature 1..12: note = hyper
  source 1..12: mol_type = genomic DNA
aaaatgtgccag

SEQ ID NO: 17805 - DNA, 60 bp, Homo sapiens; identical to SEQ ID NO: 6567
  misc_feature 1..60: note = chr2:177502788-177502848
  misc_feature 1..60: note = hyper
  source 1..60: mol_type = genomic DNA

SEQ ID NO: 17806 - DNA, 30 bp, Homo sapiens; identical to SEQ ID NO: 6568
  misc_feature 1..30: note = chr2:179278479-179278509
  misc_feature 1..30: note = hyper
  source 1..30: mol_type = genomic DNA

SEQ ID NO: 17807 - DNA, 51 bp, Homo sapiens; identical to SEQ ID NO: 6569
  misc_feature 1..51: note = chr2:179278710-179278761
  misc_feature 1..51: note = hyper
  source 1..51: mol_type = genomic DNA

SEQ ID NO: 17808 - DNA, 487 bp, Homo sapiens; identical to SEQ ID NO: 6570
  misc_feature 1..487: note = chr2:180725172-180725659
  misc_feature 1..487: note = hyper
  source 1..487: mol_type = genomic DNA

SEQ ID NO: 17809 - DNA, 35 bp, Homo sapiens; identical to SEQ ID NO: 6571
  misc_feature 1..35: note = chr2:180726046-180726081
  misc_feature 1..35: note = hyper
  source 1..35: mol_type = genomic DNA

SEQ ID NO: 17810 - DNA, 27 bp, Homo sapiens
  misc_feature 1..27: note = chr2:182321811-182321838
  misc_feature 1..27: note = hyper
  source 1..27: mol_type = genomic DNA
ctggcatttgggccacgccgggctggg

SEQ ID NO: 17811 - DNA, 22 bp, Homo sapiens
  misc_feature 1..22: note = chr2:182322170-182322192
  misc_feature 1..22: note = hyper
  source 1..22: mol_type = genomic DNA
gcgagtgcgcggcatcccaggc

SEQ ID NO: 17812 - DNA, 25 bp, Homo sapiens
  misc_feature 1..25: note = chr2:182542878-182542903
  misc_feature 1..25: note = hyper
  source 1..25: mol_type = genomic DNA
agctgtccatggtaccgtaaggcgg

SEQ ID NO: 17813 - DNA, 385 bp, Homo sapiens
  misc_feature 1..385: note = chr2:182542933-182543318
  misc_feature 1..385: note = hyper
  source 1..385: mol_type = genomic DNA
ggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 17814 - DNA, 151 bp, Homo sapiens
  misc_feature 1..151: note = chr2:182545388-182545539
  misc_feature 1..151: note = hyper
  source 1..151: mol_type = genomic DNA
ccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacc

SEQ ID NO: 17815 - DNA, 91 bp, Homo sapiens
  misc_feature 1..91: note = chr2:182545694-182545785
  misc_feature 1..91: note = hyper
  source 1..91: mol_type = genomic DNA
gaggggatttgagggaaggaagggaaaagctaatgttaactaggtctagatcagagcgagtggcctgctttcgcgccggaagtaggacaga

SEQ ID NO: 17816 - DNA, 47 bp, Homo sapiens; identical to SEQ ID NO: 6579
  misc_feature 1..47: note = chr2:182546488-182546535
  misc_feature 1..47: note = hyper
  source 1..47: mol_type = genomic DNA

SEQ ID NO: 17817 - DNA, 319 bp, Homo sapiens
  misc_feature 1..319: note = chr2:182547613-182547932
  misc_feature 1..319: note = hyper
  source 1..319: mol_type = genomic DNA
tacaggagaattatggtggagtcagatgttcttgagcaagagggacgcccgagtgttttgccagacggagactcaaatgcgtaaagtgcgggaattactagtctgtttcctccctctacccttgataaattcatctctaatcccactgcgcgttgttcgctcaggcctggagatttgtacaaaggaaaggccactccaggatgtttcagagacagggctgaggttgggtctcacggtagctgtccttgggcttcccatcccgcagcgctccgatgtgaccctcctctgcgcggaaaatttcgacccggggcgccggcat

SEQ ID NO: 17818 - DNA, 30 bp, Homo sapiens; identical to SEQ ID NO: 6582
  misc_feature 1..30: note = chr2:182548451-182548481
  misc_feature 1..30: note = hyper
  source 1..30: mol_type = genomic DNA

SEQ ID NO: 17819 - DNA, 55 bp, Homo sapiens; identical to SEQ ID NO: 6583
  misc_feature 1..55: note = chr2:182548734-182548789
  misc_feature 1..55: note = hyper
  source 1..55: mol_type = genomic DNA

SEQ ID NO: 17820 - DNA, 15 bp, Homo sapiens
  misc_feature 1..15: note = chr2:182548819-182548834
  misc_feature 1..15: note = hyper
  source 1..15: mol_type = genomic DNA
cgccctgcctaggag

SEQ ID NO: 17821 - DNA, 203 bp, Homo sapiens
  misc_feature 1..203: note = chr2:182549134-182549337
  misc_feature 1..203: note = hyper
  source 1..203: mol_type = genomic DNA
caacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttag

SEQ ID NO: 17822 - DNA, 133 bp, Homo sapiens
  misc_feature 1..133: note = chr2:182819216-182819349
  misc_feature 1..133: note = hyper
  source 1..133: mol_type = genomic DNA
ttgaactgctaggtactccttttggcctaaggacacagtgaaaaatgtaccgagaccttggagagccacgaaccaagaaacttcagaaacctctgatatctgatcaagagttaagagacgtcagaatcatcac

SEQ ID NO: 17823 - DNA, 72 bp, Homo sapiens
  misc_feature 1..72: note = chr2:183731222-183731294
  misc_feature 1..72: note = hyper
  source 1..72: mol_type = genomic DNA
ccagggcaagcagcccggcccgcagcagcagcatccctcccgggctgccgcagaccatgatcccggcaggat

SEQ ID NO: 17824 - DNA, 285 bp, Homo sapiens
  misc_feature 1..285: note = chr2:183731524-183731809
  misc_feature 1..285: note = hyper
  source 1..285: mol_type = genomic DNA
ctatttattcctctccctctggcagaagcatcagacttcgcagatcagtcagataagagggacacgagaggaggcgaggaagacataaaaacaaaagtagaattcagctgagagctagttggagctctggggtgtctcctcccctagatcacgcacacaaaaagatgctaaagaaagcattaaattccccaaagtgaggaggacagaggggttggggggaaggagggaggaaaagctcctaatgggagagaagggtgcagtaagagtttacaagtcctgtgtggg

SEQ ID NO: 17825 - DNA, 30 bp, Homo sapiens
  misc_feature 1..30: note = chr2:183732076-183732106
  misc_feature 1..30: note = hyper
  source 1..30: mol_type = genomic DNA
gcgccgagtcgagcgcgccctcacactagg

SEQ ID NO: 17826 - DNA, 38 bp, Homo sapiens
  misc_feature 1..38: note = chr2:185462831-185462869
  misc_feature 1..38: note = hyper
  source 1..38: mol_type = genomic DNA
tcttgagaaagaagccgctgctggcaccggcctggatt

SEQ ID NO: 17827 - skipped

SEQ ID NO: 17828 - DNA, 31 bp, Homo sapiens
  misc_feature 1..31: note = chr2:186603457-186603488
  misc_feature 1..31: note = hyper
  source 1..31: mol_type = genomic DNA
ccgcccttctggggccgctaccattggaagc

SEQ ID NO: 17829 - DNA, 318 bp, Homo sapiens
  misc_feature 1..318: note = chr2:193060067-193060385
  misc_feature 1..318: note = hyper
  source 1..318: mol_type = genomic DNA
agcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctc

SEQ ID NO: 17830 - skipped

SEQ ID NO: 17831 - DNA, 55 bp, Homo sapiens
  misc_feature 1..55: note = chr2:193060891-193060946
  misc_feature 1..55: note = hyper
  source 1..55: mol_type = genomic DNA
tcggggacaagggtggagaggaacatctttcttccatgaccggggtcactattgc

SEQ ID NO: 17832 - DNA, 423 bp, Homo sapiens; identical to SEQ ID NO: 6597
  misc_feature 1..423: note = chr2:197457404-197457827
  misc_feature 1..423: note = hyper
  source 1..423: mol_type = genomic DNA

SEQ ID NO: 17833 - DNA, 66 bp, Homo sapiens; identical to SEQ ID NO: 6598
  misc_feature 1..66: note = chr2:197458195-197458261
  misc_feature 1..66: note = hyper
  source 1..66: mol_type = genomic DNA

SEQ ID NO: 17834 - DNA, 30 bp, Homo sapiens; identical to SEQ ID NO: 6599
  misc_feature 1..30: note = chr2:198651504-198651534
  misc_feature 1..30: note = hyper
  source 1..30: mol_type = genomic DNA

SEQ ID NO: 17835 - DNA, 46 bp, Homo sapiens; identical to SEQ ID NO: 6601
  misc_feature 1..46: note = chr2:200328258-200328304
  misc_feature 1..46: note = hyper
  source 1..46: mol_type = genomic DNA

SEQ ID NO: 17836 - DNA, 26 bp, Homo sapiens
  misc_feature 1..26: note = chr2:200329668-200329694
  misc_feature 1..26: note = hyper
  source 1..26: mol_type = genomic DNA
tcggcgtcacgcgtccaaccctgggg

SEQ ID NO: 17837 - DNA, 30 bp, Homo sapiens; identical to SEQ ID NO: 6604
  misc_feature 1..30: note = chr2:200334190-200334220
  misc_feature 1..30: note = hyper
  source 1..30: mol_type = genomic DNA

SEQ ID NO: 17838 - DNA, 82 bp, Homo sapiens; identical to SEQ ID NO: 6607
  misc_feature 1..82: note = chr2:200336264-200336346
  misc_feature 1..82: note = hyper
  source 1..82: mol_type = genomic DNA

SEQ ID NO: 17839 - DNA, 66 bp, Homo sapiens
  misc_feature 1..66: note = chr2:201450490-201450556
  misc_feature 1..66: note = hyper
  source 1..66: mol_type = genomic DNA
caatgtttgctaagacgcaagagggtgtgacacagacgctaagcgccactggcgaggagatgaagg

SEQ ID NO: 17840 - DNA, 67 bp, Homo sapiens; identical to SEQ ID NO: 6609
  misc_feature 1..67: note = chr2:202899715-202899782
  misc_feature 1..67: note = hyper
  source 1..67: mol_type = genomic DNA

SEQ ID NO: 17841 - DNA, 74 bp, Homo sapiens; identical to SEQ ID NO: 6610
  misc_feature 1..74: note = chr2:206550451-206550525
  misc_feature 1..74: note = hyper
  source 1..74: mol_type = genomic DNA

SEQ ID NO: 17842 - DNA, 40 bp, Homo sapiens; identical to SEQ ID NO: 2157
  misc_feature 1..40: note = chr2:207139115-207139155
  misc_feature 1..40: note = hyper
  source 1..40: mol_type = genomic DNA

SEQ ID NO: 17843 - DNA, 130 bp, Homo sapiens
  misc_feature 1..130: note = chr2:207139217-207139347
  misc_feature 1..130: note = hyper
  source 1..130: mol_type = genomic DNA
cggagtggggccctgaccagggaggaagtgtccgctttaagagcttctggaggggaggaaggggctcctccgcccgggtgggagagtgagtgagtgggtgggcgggcagggggcggtcccgccgctcctg

SEQ ID NO: 17844 - DNA, 218 bp, Homo sapiens
  misc_feature 1..218: note = chr2:207139605-207139823
  misc_feature 1..218: note = hyper
  source 1..218: mol_type = genomic DNA
gagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccacc

SEQ ID NO: 17845 - DNA, 30 bp, Homo sapiens; identical to SEQ ID NO: 6614
  misc_feature 1..30: note = chr2:207140134-207140164
  misc_feature 1..30: note = hyper
  source 1..30: mol_type = genomic DNA

SEQ ID NO: 17846 - DNA, 15 bp, Homo sapiens
  misc_feature 1..15: note = chr2:207307463-207307478
  misc_feature 1..15: note = hyper
  source 1..15: mol_type = genomic DNA
tctgtattgcttccc

SEQ ID NO: 17847 - DNA, 167 bp, Homo sapiens
  misc_feature 1..167: note = chr2:207307562-207307729
  misc_feature 1..167: note = hyper
  source 1..167: mol_type = genomic DNA
tcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctc

SEQ ID NO: 17848 - DNA, 169 bp, Homo sapiens; identical to SEQ ID NO: 6617
  misc_feature 1..169: note = chr2:207308045-207308214
  misc_feature 1..169: note = hyper
  source 1..169: mol_type = genomic DNA

SEQ ID NO: 17849 - DNA, 300 bp, Homo sapiens
  misc_feature 1..300: note = chr2:207308502-207308802
  misc_feature 1..300: note = hyper
  source 1..300: mol_type = genomic DNA
cggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccag

SEQ ID NO: 17850 - DNA, 63 bp, Homo sapiens
  misc_feature 1..63: note = chr2:207308857-207308920
  misc_feature 1..63: note = hyper
  source 1..63: mol_type = genomic DNA
gaaagcgaagggcgcgcgggtccgtgtgctccgggcttgtccccggctcggcctttccttccc

SEQ ID NO: 17851 - DNA, 75 bp, Homo sapiens; identical to SEQ ID NO: 6620
  misc_feature 1..75: note = chr2:208546197-208546272
  misc_feature 1..75: note = hyper
  source 1..75: mol_type = genomic DNA

SEQ ID NO: 17852 - DNA, 124 bp, Homo sapiens; identical to SEQ ID NO: 6624
  misc_feature 1..124: note = chr2:211089565-211089689
  misc_feature 1..124: note = hyper
  source 1..124: mol_type = genomic DNA

SEQ ID NO: 17853 - DNA, 423 bp, Homo sapiens
  misc_feature 1..423: note = chr2:213402687-213403110
  misc_feature 1..423: note = hyper
  source 1..423: mol_type = genomic DNA
cacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagc

SEQ ID NO: 17854 - DNA, 45 bp, Homo sapiens
  misc_feature 1..45: note = chr2:213403337-213403382
  misc_feature 1..45: note = hyper
  source 1..45: mol_type = genomic DNA
agccgggcgcgcgtgggggtgcgaggggggcgggcgcggcgcgcg

SEQ ID NO: 17855 - DNA, 88 bp, Homo sapiens; identical to SEQ ID NO: 6628
  misc_feature 1..88: note = chr2:213403913-213404001
  misc_feature 1..88: note = hyper
  source 1..88: mol_type = genomic DNA

SEQ ID NO: 17856 - DNA, 32 bp, Homo sapiens; identical to SEQ ID NO: 6629
  misc_feature 1..32: note = chr2:216300252-216300284
  misc_feature 1..32: note = hyper
  source 1..32: mol_type = genomic DNA

SEQ ID NO: 17857 - DNA, 30 bp, Homo sapiens; identical to SEQ ID NO: 6630
  misc_feature 1..30: note = chr2:216301757-216301787
  misc_feature 1..30: note = hyper
  source 1..30: mol_type = genomic DNA

SEQ ID NO: 17858 - DNA, 230 bp, Homo sapiens
  misc_feature 1..230: note = chr2:217559066-217559296
  misc_feature 1..230: note = hyper
  source 1..230: mol_type = genomic DNA
cgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgc

SEQ ID NO: 17859 - DNA, 96 bp, Homo sapiens
  misc_feature 1..96: note = chr2:217559326-217559422
  misc_feature 1..96: note = hyper
  source 1..96: mol_type = genomic DNA
tcatgcagcagccgcagcccggctccttgaccagctcgcagcccagggggctgggggggcacatggagagggctttctcgtcgcagggctcgcagt

SEQ ID NO: 17860 - DNA, 45 bp, Homo sapiens; identical to SEQ ID NO: 6633
  misc_feature 1..45: note = chr2:219735785-219735830
  misc_feature 1..45: note = hyper
  source 1..45: mol_type = genomic DNA

SEQ ID NO: 17861 - DNA, 30 bp, Homo sapiens; identical to SEQ ID NO: 6635
  misc_feature 1..30: note = chr2:219773737-219773767
  misc_feature 1..30: note = hyper
  source 1..30: mol_type = genomic DNA

SEQ ID NO: 17862 - DNA, 304 bp, Homo sapiens; identical to SEQ ID NO: 6636
  misc_feature 1..304: note = chr2:219824786-219825090
  misc_feature 1..304: note = hyper
  source 1..304: mol_type = genomic DNA

SEQ ID NO: 17863 - DNA, 36 bp, Homo sapiens; identical to SEQ ID NO: 6637
  misc_feature 1..36: note = chr2:219825513-219825549
  misc_feature 1..36: note = hyper
  source 1..36: mol_type = genomic DNA

SEQ ID NO: 17864 - DNA, 92 bp, Homo sapiens; identical to SEQ ID NO: 6638
  misc_feature 1..92: note = chr2:219846666-219846758
  misc_feature 1..92: note = hyper
  source 1..92: mol_type = genomic DNA

SEQ ID NO: 17865 - DNA, 103 bp, Homo sapiens; identical to SEQ ID NO: 6639
  misc_feature 1..103: note = chr2:219847047-219847150
  misc_feature 1..103: note = hyper
  source 1..103: mol_type = genomic DNA

SEQ ID NO: 17866 - DNA, 476 bp, Homo sapiens
  misc_feature 1..476: note = chr2:219849001-219849477
  misc_feature 1..476: note = hyper
  source 1..476: mol_type = genomic DNA
cttgaagagaccgtctccgacgggatctgcaagcagcagaagaaaagaatcaggagaaccccgggcggaagttgtgggcttgacaaaagggccccgggccaaggcttaaggggggtgctgtggtccccaggcgcgaggctgggggcccgggccacccggctcctcctcccggagcctggtccaggcgcgctgcgcggagcccctccatagagcccaagtcaggaaacgcgtccaggaaaaaggaaatccgctttccgaaggggccggctggagccttataaagccgagcggggaactgcgccagccgagctggagcgcgaagagaagaggagggtgcctggagggccggcctgaagctcgtagcaggaaggtgaggagccgtgagagcgcaggggagacgcccgcggaccacagccttctggtacggctcggccacagagtactccaccacgccagagacccgtgcttcccctctc

SEQ ID NO: 17867 - DNA, 61 bp, Homo sapiens; identical to SEQ ID NO: 6642
  misc_feature 1..61: note = chr2:219850168-219850229
  misc_feature 1..61: note = hyper
  source 1..61: mol_type = genomic DNA

SEQ ID NO: 17868 - DNA, 58 bp, Homo sapiens; identical to SEQ ID NO: 6643
  misc_feature 1..58: note = chr2:219857911-219857969
  misc_feature 1..58: note = hyper
  source 1..58: mol_type = genomic DNA

SEQ ID NO: 17869 - DNA, 40 bp, Homo sapiens; identical to SEQ ID NO: 6644
  misc_feature 1..40: note = chr2:219867872-219867912
  misc_feature 1..40: note = hyper
  source 1..40: mol_type = genomic DNA

SEQ ID NO: 17870 - DNA, 67 bp, Homo sapiens
  misc_feature 1..67: note = chr2:220196567-220196634
  misc_feature 1..67: note = hyper
  source 1..67: mol_type = genomic DNA
gccctcatcctctcattgccaccaggcctcctcccacagctgttcctgaatccgctgcattggcctc

SEQ ID NO: 17871 - DNA, 50 bp, Homo sapiens; identical to SEQ ID NO: 6647
  misc_feature 1..50: note = chr2:220197440-220197490
  misc_feature 1..50: note = hyper
  source 1..50: mol_type = genomic DNA

SEQ ID NO: 17872 - DNA, 151 bp, Homo sapiens
  misc_feature 1..151: note = chr2:220222947-220223098
  misc_feature 1..151: note = hyper
  source 1..151: mol_type = genomic DNA
ggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgc

SEQ ID NO: 17873 - DNA, 87 bp, Homo sapiens
  misc_feature 1..87: note = chr2:220223128-220223215
  misc_feature 1..87: note = hyper
  source 1..87: mol_type = genomic DNA
ggaacccgtggccatcgggtgtggggtgtgcagggtgcggagaaggctaggattcctcccaatcctctgctgcgccctcccccagcc

SEQ ID NO: 17874 - DNA, 30 bp, Homo sapiens; identical to SEQ ID NO: 6649
  misc_feature 1..30: note = chr2:220223590-220223620
  misc_feature 1..30: note = hyper
  source 1..30: mol_type = genomic DNA

SEQ ID NO: 17875 - DNA, 36 bp, Homo sapiens; identical to SEQ ID NO: 6650
  misc_feature 1..36: note = chr2:220283254-220283290
  misc_feature 1..36: note = hyper
  source 1..36: mol_type = genomic DNA

SEQ ID NO: 17876 - DNA, 21 bp, Homo sapiens
  misc_feature 1..21: note = chr2:220283711-220283732
  misc_feature 1..21: note = hyper
  source 1..21: mol_type = genomic DNA
cgacgtcgagcgcgacaacct

SEQ ID NO: 17877 - DNA, 55 bp, Homo sapiens
  misc_feature 1..55: note = chr2:220299533-220299588
  misc_feature 1..55: note = hyper
  source 1..55: mol_type = genomic DNA
aatcgccggccgccccggtgaccttctgggtagcacaggccgaaggcgggcgggc

SEQ ID NO: 17878 - DNA, 13 bp, Homo sapiens
  misc_feature 1..13: note = chr2:220349706-220349719
  misc_feature 1..13: note = hyper
  source 1..13: mol_type = genomic DNA
cacaaccagttgg

SEQ ID NO: 17879 - DNA, 30 bp, Homo sapiens; identical to SEQ ID NO: 6657
  misc_feature 1..30: note = chr2:220379221-220379251
  misc_feature 1..30: note = hyper
  source 1..30: mol_type = genomic DNA

SEQ ID NO: 17880 - DNA, 335 bp, Homo sapiens
  misc_feature 1..335: note = chr2:220416513-220416848
  misc_feature 1..335: note = hyper
  source 1..335: mol_type = genomic DNA
ggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagta

SEQ ID NO: 17881 - DNA, 38 bp, Homo sapiens
  misc_feature 1..38: note = chr2:220417649-220417687
  misc_feature 1..38: note = hyper
  source 1..38: mol_type = genomic DNA
cggcgtccgaggggccgcagcgtcgcagctggagaagg

SEQ ID NO: 17882 - DNA, 26 bp, Homo sapiens
  misc_feature 1..26: note = chr2:223159453-223159479
  misc_feature 1..26: note = hyper
  source 1..26: mol_type = genomic DNA
agaaccaaagccgacttgtccgcgcc

SEQ ID NO: 17883 - DNA, 51 bp, Homo sapiens; identical to SEQ ID NO: 6662
  misc_feature 1..51: note = chr2:223159710-223159761
  misc_feature 1..51: note = hyper
  source 1..51: mol_type = genomic DNA

SEQ ID NO: 17884 - DNA, 51 bp, Homo sapiens
  misc_feature 1..51: note = chr2:223160065-223160116
  misc_feature 1..51: note = hyper
  source 1..51: mol_type = genomic DNA
cagctcacccctccctccataaagtgccaagaacaccgggttggcaaatat

SEQ ID NO: 17885 - DNA, 233 bp, Homo sapiens
  misc_feature 1..233: note = chr2:223163535-223163768
  misc_feature 1..233: note = hyper
  source 1..233: mol_type = genomic DNA
cggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtc

SEQ ID NO: 17886 - DNA, 49 bp, Homo sapiens
  misc_feature 1..49: note = chr2:223163954-223164003
  misc_feature 1..49: note = hyper
  source 1..49: mol_type = genomic DNA
gagacagccccagggagatggcagttgctgagggcggagaagttcctgt

SEQ ID NO: 17887 - DNA, 117 bp, Homo sapiens
  misc_feature 1..117: note = chr2:223164417-223164534
  misc_feature 1..117: note = hyper
  source 1..117: mol_type = genomic DNA
ttctccgtccgcaagcggggctaatgtgaagcacaggcagccgtcgctaggcccaagcactcgttagttgaaggctgggggtatgggggagggtgcagaaaaaaacctggctcctct

SEQ ID NO: 17888 - DNA, 15 bp, Homo sapiens
  misc_feature 1..15: note = chr2:223166211-223166226
  misc_feature 1..15: note = hyper
  source 1..15: mol_type = genomic DNA
tgtggcctgtgtccc

SEQ ID NO: 17889 - DNA, 99 bp, Homo sapiens
  misc_feature 1..99: note = chr2:223166721-223166820
  misc_feature 1..99: note = hyper
  source 1..99: mol_type = genomic DNA
ctcacgctctgtgcacgttcgaaatgaaacgggagccttgaagacgatatttggataatttgacaaaaaaaaaaaaaaggtgggcgggggagatagctt

SEQ ID NO: 17890 - DNA, 139 bp, Homo sapiens
  misc_feature 1..139: note = chr2:223167250-223167389
  misc_feature 1..139: note = hyper
  source 1..139: mol_type = genomic DNA
aagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgat

SEQ ID NO: 17891 - DNA, 450 bp, Homo sapiens; identical to SEQ ID NO: 6675
  misc_feature 1..450: note = chr2:223168916-223169366
  misc_feature 1..450: note = hyper
  source 1..450: mol_type = genomic DNA

SEQ ID NO: 17892 - DNA, 21 bp, Homo sapiens
  misc_feature 1..21: note = chr2:223170354-223170375
  misc_feature 1..21: note = hyper
  source 1..21: mol_type = genomic DNA
cttctttccatccctcggccc

SEQ ID NO: 17893 - DNA, 318 bp, Homo sapiens
  misc_feature 1..318: note = chr2:223170434-223170752
  misc_feature 1..318: note = hyper
  source 1..318: mol_type = genomic DNA
ctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttcca

SEQ ID NO: 17894 - DNA, 35 bp, Homo sapiens; identical to SEQ ID NO: 6678
  misc_feature 1..35: note = chr2:223171277-223171312
  misc_feature 1..35: note = hyper
  source 1..35: mol_type = genomic DNA

SEQ ID NO: 17895 - DNA, 275 bp, Homo sapiens
  misc_feature 1..275: note = chr2:223176181-223176456
  misc_feature 1..275: note = hyper
  source 1..275: mol_type = genomic DNA
ctactccgctgcaagccccgcagagaacctcgccttcttcccgaccgccaagtctgattgtacagacttcatagaaggtctggaataaggactgtgttgctgcagaggccgggtcttgggcccctgggcgtgaggacgcaggctcggcccctgggaagaaatgtactaacgcacctcaagactcctaaggtgtttccaagtcccccctccaactttcgtgtccaggtcacgctgccccgccctcggacaatgagagggtgtgtcaagatgctctt

SEQ ID NO: 17896 - DNA, 43 bp, Homo sapiens
  misc_feature 1..43: note = chr2:223176983-223177026
  misc_feature 1..43: note = hyper
  source 1..43: mol_type = genomic DNA
ccgtaatggagctggcaagtgggacgaacgggacagcctaaag

SEQ ID NO: 17897 - DNA, 28 bp, Homo sapiens
  misc_feature 1..28: note = chr2:223177610-223177638
  misc_feature 1..28: note = hyper
  source 1..28: mol_type = genomic DNA
tatccgcataatccgtcctcaaatcccc

SEQ ID NO: 17898 - DNA, 375 bp, Homo sapiens; identical to SEQ ID NO: 6682
  misc_feature 1..375: note = chr2:225906404-225906779
  misc_feature 1..375: note = hyper
  source 1..375: mol_type = genomic DNA

SEQ ID NO: 17899 - DNA, 352 bp, Homo sapiens; identical to SEQ ID NO: 6683
  misc_feature 1..352: note = chr2:225906790-225907142
  misc_feature 1..352: note = hyper
  source 1..352: mol_type = genomic DNA

SEQ ID NO: 17900 - DNA, 15 bp, Homo sapiens
  misc_feature 1..15: note = chr2:229046730-229046745
  misc_feature 1..15: note = hyper
  source 1..15: mol_type = genomic DNA
ccctgaagttgttca

SEQ ID NO: 17901 - DNA, 232 bp, Homo sapiens; identical to SEQ ID NO: 2179
  misc_feature 1..232: note = chr2:230578195-230578427
  misc_feature 1..232: note = hyper
  source 1..232: mol_type = genomic DNA

SEQ ID NO: 17902 - DNA, 123 bp, Homo sapiens; identical to SEQ ID NO: 6688
  misc_feature 1..123: note = chr2:231903049-231903172
  misc_feature 1..123: note = hyper
  source 1..123: mol_type = genomic DNA

SEQ ID NO: 17903 - DNA, 18 bp, Homo sapiens
  misc_feature 1..18: note = chr2:232394952-232394970
  misc_feature 1..18: note = hyper
  source 1..18: mol_type = genomic DNA
ggacggggggcaccccga

SEQ ID NO: 17904 - DNA, 70 bp, Homo sapiens
  misc_feature 1..70: note = chr2:232395061-232395131
  misc_feature 1..70: note = hyper
  source 1..70: mol_type = genomic DNA
gcacctaccatgcggcccgcggcccgcgagaccccggcttccaccctccgagcgacggacacagacgcgg

SEQ ID NO: 17905 - DNA, 27 bp, Homo sapiens
  misc_feature 1..27: note = chr2:232791677-232791704
  misc_feature 1..27: note = hyper
  source 1..27: mol_type = genomic DNA
gactggggtgggaggcgcagggagagc

SEQ ID NO: 17906 - DNA, 17 bp, Homo sapiens
  misc_feature 1..17: note = chr2:232792012-232792029
  misc_feature 1..17: note = hyper
  source 1..17: mol_type = genomic DNA
cccgctccagtatcctg

SEQ ID NO: 17907 - DNA, 30 bp, Homo sapiens; identical to SEQ ID NO: 6692
  misc_feature 1..30: note = chr2:233283450-233283480
  misc_feature 1..30: note = hyper
  source 1..30: mol_type = genomic DNA

SEQ ID NO: 17908 - DNA, 30 bp, Homo sapiens; identical to SEQ ID NO: 6693
  misc_feature 1..30: note = chr2:233283737-233283767
  misc_feature 1..30: note = hyper
  source 1..30: mol_type = genomic DNA

SEQ ID NO: 17909 - DNA, 66 bp, Homo sapiens; identical to SEQ ID NO: 6694
  misc_feature 1..66: note = chr2:233285777-233285843
  misc_feature 1..66: note = hyper
  source 1..66: mol_type = genomic DNA

SEQ ID NO: 17910 - DNA, 181 bp, Homo sapiens; identical to SEQ ID NO: 277
  misc_feature 1..181: note = chr2:233351415-233351596
  misc_feature 1..181: note = hyper
  source 1..181: mol_type = genomic DNA

SEQ ID NO: 17911 - DNA, 58 bp, Homo sapiens
  misc_feature 1..58: note = chr2:233352853-233352911
  misc_feature 1..58: note = hyper
  source 1..58: mol_type = genomic DNA
tggaaaggggctggagctggagatgaggagccgaggactcctccgaagggctgggggc

SEQ ID NO: 17912 - DNA, 98 bp, Homo sapiens; identical to SEQ ID NO: 6701
  misc_feature 1..98: note = chr2:233368141-233368239
  misc_feature 1..98: note = hyper
  source 1..98: mol_type = genomic DNA

SEQ ID NO: 17913 - DNA, 85 bp, Homo sapiens; identical to SEQ ID NO: 6702
  misc_feature 1..85: note = chr2:233388723-233388808
  misc_feature 1..85: note = hyper
  source 1..85: mol_type = genomic DNA

SEQ ID NO: 17914 - DNA, 30 bp, Homo sapiens; identical to SEQ ID NO: 6703
  misc_feature 1..30: note = chr2:233389121-233389151
  misc_feature 1..30: note = hyper
  source 1..30: mol_type = genomic DNA

SEQ ID NO: 17915 - DNA, 131 bp, Homo sapiens; identical to SEQ ID NO: 6704
  misc_feature 1..131: note = chr2:233498345-233498476
  misc_feature 1..131: note = hyper
  source 1..131: mol_type = genomic DNA

SEQ ID NO: 17916 - DNA, 51 bp, Homo sapiens; identical to SEQ ID NO: 6708
  misc_feature 1..51: note = chr2:233740999-233741050
  misc_feature 1..51: note = hyper
  source 1..51: mol_type = genomic DNA

SEQ ID NO: 17917 - DNA, 100 bp, Homo sapiens; identical to SEQ ID NO: 6709
  misc_feature 1..100: note = chr2:233741381-233741481
  misc_feature 1..100: note = hyper
  source 1..100: mol_type = genomic DNA

SEQ ID NO: 17918 - DNA, 117 bp, Homo sapiens; identical to SEQ ID NO: 6710
  misc_feature 1..117: note = chr2:235404416-235404533
  misc_feature 1..117: note = hyper
  source 1..117: mol_type = genomic DNA

SEQ ID NO: 17919 - DNA, 26 bp, Homo sapiens
  misc_feature 1..26: note = chr2:235404623-235404649
  misc_feature 1..26: note = hyper
  source 1..26: mol_type = genomic DNA
cgctcgctccccggtcgctccgggcg

SEQ ID NO: 17920 - skipped

SEQ ID NO: 17921 - DNA, 16 bp, Homo sapiens
  misc_feature 1..16: note = chr2:237068925-237068941
  misc_feature 1..16: note = hyper
  source 1..16: mol_type = genomic DNA
gcggtggaggctaggg

SEQ ID NO: 17922 - DNA, 298 bp, Homo sapiens
  misc_feature 1..298: note = chr2:237073056-237073354
  misc_feature 1..298: note = hyper
  source 1..298: mol_type = genomic DNA
cgcgcttcggggtccggcagcgagcggacagggctctgagcgcagggccggggttgggacaggagtgggcttggggaccaggcacgccccaccgagatggggaggcgcgcagctccccgtcccttgcagaccgactcccagctcccctgcgtagcctctcccgttttccccctttgtggtgcggactaccggggcgtccttggggtggggcggtgcccgggtcccgccccctcgaccccgcccggagggggaggtgccggggccgggggcgctccagccagcctccgcctccgactga

SEQ ID NO: 17923 - DNA, 82 bp, Homo sapiens
  misc_feature 1..82: note = chr2:237073414-237073496
  misc_feature 1..82: note = hyper
  source 1..82: mol_type = genomic DNA
ggagcctgatttatggaccctccactctgccggcaggcgagcaccgcttcttttcgggccggagatatttgtaaaggaaaga

SEQ ID NO: 17924 - skipped

SEQ ID NO: 17925 - DNA, 39 bp, Homo sapiens; identical to SEQ ID NO: 6719
  misc_feature 1..39: note = chr2:237075146-237075185
  misc_feature 1..39: note = hyper
  source 1..39: mol_type = genomic DNA

SEQ ID NO: 17926 - DNA, 34 bp, Homo sapiens; identical to SEQ ID NO: 6720
  misc_feature 1..34: note = chr2:237076602-237076636
  misc_feature 1..34: note = hyper
  source 1..34: mol_type = genomic DNA

SEQ ID NO: 17927 - DNA, 69 bp, Homo sapiens; identical to SEQ ID NO: 6721
  misc_feature 1..69: note = chr2:237076656-237076725
  misc_feature 1..69: note = hyper
  source 1..69: mol_type = genomic DNA

SEQ ID NO: 17928 - DNA, 28 bp, Homo sapiens
  misc_feature 1..28: note = chr2:237078348-237078376
  misc_feature 1..28: note = hyper
  source 1..28: mol_type = genomic DNA
tggggagttggcccgtgttggacgtgtg

SEQ ID NO: 17929 - DNA, 54 bp, Homo sapiens
  misc_feature 1..54: note = chr2:237080210-237080264
  misc_feature 1..54: note = hyper
  source 1..54: mol_type = genomic DNA
ggcgcgcttcgctgccgccgccagagtcgaggtaacgggtggtcgtggagaggg

SEQ ID NO: 17930 - DNA, 64 bp, Homo sapiens
  misc_feature 1..64: note = chr2:237081277-237081341
  misc_feature 1..64: note = hyper
  source 1..64: mol_type = genomic DNA
ctgaaggctgggaaacgtgacccttcacacctgcgccgccctctccactccagcgacgaggaac

SEQ ID NO: 17931 - skipped

SEQ ID NO: 17932 - DNA, 177 bp, Homo sapiens; identical to SEQ ID NO: 6727
  misc_feature 1..177: note = chr2:237086712-237086889
  misc_feature 1..177: note = hyper
  source 1..177: mol_type = genomic DNA

SEQ ID NO: 17933 - DNA, 22 bp, Homo sapiens
  misc_feature 1..22: note = chr2:237145988-237146010
  misc_feature 1..22: note = hyper
  source 1..22: mol_type = genomic DNA
ggccggggcgcggggcgggggc

SEQ ID NO: 17934 - DNA, 50 bp, Homo sapiens; identical to SEQ ID NO: 6729
  misc_feature 1..50: note = chr2:237146264-237146314
  misc_feature 1..50: note = hyper
  source 1..50: mol_type = genomic DNA

SEQ ID NO: 17935 - DNA, 52 bp, Homo sapiens
  misc_feature 1..52: note = chr2:237416164-237416216
  misc_feature 1..52: note = hyper
  source 1..52: mol_type = genomic DNA
tcgcgaacctcacttcggccactcaggtgggcgcgacgcggccctagcaacg

SEQ ID NO: 17936 - DNA, 75 bp, Homo sapiens
  misc_feature 1..75: note = chr2:238395216-238395291
  misc_feature 1..75: note = hyper
  source 1..75: mol_type = genomic DNA
cggtcctggaaccaccgcgccgcgcgtcctggcttccacatctgccccatttgcccgcggatcttgactttttct

SEQ ID NO: 17937 - DNA, 420 bp, Homo sapiens; identical to SEQ ID NO: 6732
  misc_feature 1..420: note = chr2:238536266-238536686
  misc_feature 1..420: note = hyper
  source 1..420: mol_type = genomic DNA

SEQ ID NO: 17938 - DNA, 43 bp, Homo sapiens; identical to SEQ ID NO: 2193
  misc_feature 1..43: note = chr2:238864588-238864631
  misc_feature 1..43: note = hyper
  source 1..43: mol_type = genomic DNA

SEQ ID NO: 17939 - DNA, 143 bp, Homo sapiens
  misc_feature 1..143: note = chr2:238864913-238865056
  misc_feature 1..143: note = hyper
  source 1..143: mol_type = genomic DNA
aagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactca

SEQ ID NO: 17940 - DNA, 30 bp, Homo sapiens; identical to SEQ ID NO: 6735
  misc_feature 1..30: note = chr2:238865269-238865299
  misc_feature 1..30: note = hyper
  source 1..30: mol_type = genomic DNA

SEQ ID NO: 17941 - DNA, 62 bp, Homo sapiens; identical to SEQ ID NO: 6736
  misc_feature 1..62: note = chr2:239072210-239072272
  misc_feature 1..62: note = hyper
  source 1..62: mol_type = genomic DNA

SEQ ID NO: 17942 - DNA, 27 bp, Homo sapiens
  misc_feature 1..27: note = chr2:239755137-239755164
  misc_feature 1..27: note = hyper
  source 1..27: mol_type = genomic DNA
gggtggggctgggtgcggtggctctgc

SEQ ID NO: 17943 - DNA, 40 bp, Homo sapiens; identical to SEQ ID NO: 6739
  misc_feature 1..40: note = chr2:239757929-239757969
  misc_feature 1..40: note = hyper
  source 1..40: mol_type = genomic DNA

SEQ ID NO: 17944 - DNA, 30 bp, Homo sapiens; identical to SEQ ID NO: 6740
  misc_feature 1..30: note = chr2:239758179-239758209
  misc_feature 1..30: note = hyper
  source 1..30: mol_type = genomic DNA

SEQ ID NO: 17945 - DNA, 37 bp, Homo sapiens; identical to SEQ ID NO: 6741
  misc_feature 1..37: note = chr2:239758409-239758446
  misc_feature 1..37: note = hyper
  source 1..37: mol_type = genomic DNA

SEQ ID NO: 17946 - DNA, 386 bp, Homo sapiens
  misc_feature 1..386: note = chr2:241759211-241759597
  misc_feature 1..386: note = hyper
  source 1..386: mol_type = genomic DNA
ccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcga

SEQ ID NO: 17947 - DNA, 42 bp, Homo sapiens; identical to SEQ ID NO: 6745
  misc_feature 1..42: note = chr2:241760366-241760408
  misc_feature 1..42: note = hyper
  source 1..42: mol_type = genomic DNA

SEQ ID NO: 17948 - DNA, 30 bp, Homo sapiens; identical to SEQ ID NO: 6746
  misc_feature 1..30: note = chr2:241760679-241760709
  misc_feature 1..30: note = hyper
  source 1..30: mol_type = genomic DNA

SEQ ID NO: 17949 - DNA, 71 bp, Homo sapiens
  misc_feature 1..71: note = chr2:241771257-241771328
  misc_feature 1..71: note = hyper
  source 1..71: mol_type = genomic DNA
tggaaggtcagggcctggaggggagctgggtccaggcagggaactcacagcagagacgccccgagggtggg

SEQ ID NO: 17950 - DNA, 30 bp, Homo sapiens; identical to SEQ ID NO: 6748
  misc_feature 1..30: note = chr2:241771696-241771726
  misc_feature 1..30: note = hyper
  source 1..30: mol_type = genomic DNA

SEQ ID NO: 17951 - DNA, 278 bp, Homo sapiens
  misc_feature 1..278: note = chr3:238258-238536
  misc_feature 1..278: note = hyper
  source 1..278: mol_type = genomic DNA
gcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccg

SEQ ID NO: 17952 - DNA, 15 bp, Homo sapiens
  misc_feature 1..15: note = chr3:239094-239109
  misc_feature 1..15: note = hyper
  source 1..15: mol_type = genomic DNA
cgctgctctctgagg

SEQ ID NO: 17953 - DNA, 275 bp, Homo sapiens
  misc_feature 1..275: note = chr3:239347-239622
  misc_feature 1..275: note = hyper
  source 1..275: mol_type = genomic DNA
ggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttgggg

SEQ ID NO: 17954 - DNA, 29 bp, Homo sapiens
  misc_feature 1..29: note = chr3:240223-240252
  misc_feature 1..29: note = hyper
  source 1..29: mol_type = genomic DNA
ctttctcaataatacggagattatcgata

SEQ ID NO: 17955 - DNA, 32 bp, Homo sapiens; identical to SEQ ID NO: 6753
  misc_feature 1..32: note = chr3:2139944-2139976
  misc_feature 1..32: note = hyper
  source 1..32: mol_type = genomic DNA

SEQ ID NO: 17956 - DNA, 37 bp, Homo sapiens
  misc_feature 1..37: note = chr3:2140398-2140435
  misc_feature 1..37: note = hyper
  source 1..37: mol_type = genomic DNA
cgttcccacccgcccgcgcctctccccttccccgagc

SEQ ID NO: 17957 - DNA, 36 bp, Homo sapiens; identical to SEQ ID NO: 6755
  misc_feature 1..36: note = chr3:2140827-2140863
  misc_feature 1..36: note = hyper
  source 1..36: mol_type = genomic DNA

SEQ ID NO: 17958 - DNA, 69 bp, Homo sapiens; identical to SEQ ID NO: 6757
  misc_feature 1..69: note = chr3:3840887-3840956
  misc_feature 1..69: note = hyper
  source 1..69: mol_type = genomic DNA

SEQ ID NO: 17959 - DNA, 148 bp, Homo sapiens; identical to SEQ ID NO: 6758
  misc_feature 1..148: note = chr3:3841494-3841642
  misc_feature 1..148: note = hyper
  source 1..148: mol_type = genomic DNA

SEQ ID NO: 17960 - DNA, 422 bp, Homo sapiens; identical to SEQ ID NO: 6759
  misc_feature 1..422: note = chr3:3842186-3842608
  misc_feature 1..422: note = hyper
  source 1..422: mol_type = genomic DNA

SEQ ID NO: 17961 - DNA, 196 bp, Homo sapiens; identical to SEQ ID NO: 6760
  misc_feature 1..196: note = chr3:4910354-4910550
  misc_feature 1..196: note = hyper
  source 1..196: mol_type = genomic DNA

SEQ ID NO: 17962 - DNA, 30 bp, Homo sapiens; identical to SEQ ID NO: 6761
  misc_feature 1..30: note = chr3:5019001-5019031
  misc_feature 1..30: note = hyper
  source 1..30: mol_type = genomic DNA

SEQ ID NO: 17963 - DNA, 23 bp, Homo sapiens
  misc_feature 1..23: note = chr3:5137937-5137960
  misc_feature 1..23: note = hyper
  source 1..23: mol_type = genomic DNA
gggtggggggtggtgcggggagt

SEQ ID NO: 17964 - DNA, 246 bp, Homo sapiens
  misc_feature 1..246: note = chr3:6902353-6902599
  misc_feature 1..246: note = hyper
  source 1..246: mol_type = genomic DNA
ggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctcccc

SEQ ID NO: 17965 - DNA, 15 bp, Homo sapiens
  misc_feature 1..15: note = chr3:6903084-6903099
  misc_feature 1..15: note = hyper
  source 1..15: mol_type = genomic DNA
ctgaggaagctgctc

SEQ ID NO: 17966 - DNA, 47 bp, Homo sapiens; identical to SEQ ID NO: 6765
  misc_feature 1..47: note = chr3:6904160-6904207
  misc_feature 1..47: note = hyper
  source 1..47: mol_type = genomic DNA

SEQ ID NO: 17967 - DNA, 306 bp, Homo sapiens; identical to SEQ ID NO: 6766
  misc_feature 1..306: note = chr3:8809409-8809715
  misc_feature 1..306: note = hyper
  source 1..306: mol_type = genomic DNA

SEQ ID NO: 17968 - DNA, 30 bp, Homo sapiens; identical to SEQ ID NO: 6767
  misc_feature 1..30: note = chr3:8810241-8810271
  misc_feature 1..30: note = hyper
  source 1..30: mol_type = genomic DNA

SEQ ID NO: 17969 - DNA, 68 bp, Homo sapiens; identical to SEQ ID NO: 6768
  misc_feature 1..68: note = chr3:8811111-8811179
  misc_feature 1..68: note = hyper
  source 1..68: mol_type = genomic DNA

SEQ ID NO: 17970 - DNA, 258 bp, Homo sapiens; identical to SEQ ID NO: 6769
  misc_feature 1..258: note = chr3:9541746-9542004
  misc_feature 1..258: note = hyper
  source 1..258: mol_type = genomic DNA

SEQ ID NO: 17971 - DNA, 21 bp, Homo sapiens
  misc_feature 1..21: note = chr3:9594015-9594036
  misc_feature 1..21: note = hyper
  source 1..21: mol_type = genomic DNA
gaaaagcgaaaagcaggtgat

SEQ ID NO: 17972 - DNA, 41 bp, Homo sapiens; identical to SEQ ID NO: 6772
  misc_feature 1..41: note = chr3:9745437-9745478
  misc_feature 1..41: note = hyper
  source 1..41: mol_type = genomic DNA

SEQ ID NO: 17973 - DNA, 71 bp, Homo sapiens
  misc_feature 1..71: note = chr3:9904554-9904625
  misc_feature 1..71: note = hyper
  source 1..71: mol_type = genomic DNA
gccgatggccattaaagccccgccccccgcggctcaccgccgcctggccccgtccccgaggccagaaaaga

SEQ ID NO: 17974 - DNA, 154 bp, Homo sapiens
  misc_feature 1..154: note = chr3:9956910-9957064
  misc_feature 1..154: note = hyper
  source 1..154: mol_type = genomic DNA
tcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacct

SEQ ID NO: 17975 - DNA, 309 bp, Homo sapiens
  misc_feature 1..309: note = chr3:9957142-9957451
  misc_feature 1..309: note = hyper
  source 1..309: mol_type = genomic DNA
gggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccg

SEQ ID NO: 17976 - DNA, 35 bp, Homo sapiens; identical to SEQ ID NO: 6775
  misc_feature 1..35: note = chr3:9993993-9994028
  misc_feature 1..35: note = hyper
  source 1..35: mol_type = genomic DNA

SEQ ID NO: 17977 - DNA, 55 bp, Homo sapiens; identical to SEQ ID NO: 6776
  misc_feature 1..55: note = chr3:10207053-10207108
  misc_feature 1..55: note = hyper
  source 1..55: mol_type = genomic DNA

SEQ ID NO: 17978 - DNA, 112 bp, Homo sapiens; identical to SEQ ID NO: 6777
  misc_feature 1..112: note = chr3:10749325-10749437
  misc_feature 1..112: note = hyper
  source 1..112: mol_type = genomic DNA

SEQ ID NO: 17979 - DNA, 267 bp, Homo sapiens; identical to SEQ ID NO: 6778
  misc_feature 1..267: note = chr3:10749637-10749904
  misc_feature 1..267: note = hyper
  source 1..267: mol_type = genomic DNA

SEQ ID NO: 17980 - DNA, 43 bp, Homo sapiens; identical to SEQ ID NO: 6779
  misc_feature 1..43: note = chr3:10857674-10857717
  misc_feature 1..43: note = hyper
  source 1..43: mol_type = genomic DNA

SEQ ID NO: 17981 - DNA, 50 bp, Homo sapiens; identical to SEQ ID NO: 6780
  misc_feature 1..50: note = chr3:11034716-11034766
  misc_feature 1..50: note = hyper
  source 1..50: mol_type = genomic DNA

SEQ ID NO: 17982 - DNA, 23 bp, Homo sapiens
  misc_feature 1..23: note = chr3:11035330-11035353
  misc_feature 1..23: note = hyper
  source 1..23: mol_type = genomic DNA
ttttggtctctgcgtgtactccc

SEQ ID NO: 17983 - skipped

SEQ ID NO: 17984 - DNA, 144 bp, Homo sapiens; identical to SEQ ID NO: 6783
  misc_feature 1..144: note = chr3:12046209-12046353
  misc_feature 1..144: note = hyper
  source 1..144: mol_type = genomic DNA

SEQ ID NO: 17985 - DNA, 28 bp, Homo sapiens
  misc_feature 1..28: note = chr3:12046377-12046405
  misc_feature 1..28: note = hyper
  source 1..28: mol_type = genomic DNA
cgccaggaaggccaaggtgctgctggtg

SEQ ID NO: 17986 - DNA, 14 bp, Homo sapiens
  misc_feature 1..14: note = chr3:12917655-12917669
  misc_feature 1..14: note = hyper
  source 1..14: mol_type = genomic DNA
gtctggagggaggt

SEQ ID NO: 17987 - DNA, 56 bp, Homo sapiens
  misc_feature 1..56: note = chr3:13323973-13324029
  misc_feature 1..56: note = hyper
  source 1..56: mol_type = genomic DNA
tggagcccttttccagggaacccagtccccacccgagatcgagctccggatctggg

SEQ ID NO: 17988 - DNA, 114 bp, Homo sapiens; identical to SEQ ID NO: 2205
  misc_feature 1..114: note = chr3:13324234-13324348
  misc_feature 1..114: note = hyper
  source 1..114: mol_type = genomic DNA

SEQ ID NO: 17989 - skipped

SEQ ID NO: 17990 - DNA, 29 bp, Homo sapiens
  misc_feature 1..29: note = chr3:13324645-13324674
  misc_feature 1..29: note = hyper
  source 1..29: mol_type = genomic DNA
gcctcctgctccccgcgccgccgcgctcc

SEQ ID NO: 17991 - DNA, 107 bp, Homo sapiens
  misc_feature 1..107: note = chr3:13324740-13324847
  misc_feature 1..107: note = hyper
  source 1..107: mol_type = genomic DNA
gaggagttttgcaaagtgccggccgcggcgcgggaagagggcggggagggcgccgcctgctgggaccgcccctgggtcccgcgcccccgcaccaggcgtcgggggac

SEQ ID NO: 17992 - DNA, 48 bp, Homo sapiens; identical to SEQ ID NO: 291
  misc_feature 1..48: note = chr3:13590973-13591021
  misc_feature 1..48: note = hyper
  source 1..48: mol_type = genomic DNA

SEQ ID NO: 17993 - DNA, 57 bp, Homo sapiens; identical to SEQ ID NO: 6793
  misc_feature 1..57: note = chr3:13920328-13920385
  misc_feature 1..57: note = hyper
  source 1..57: mol_type = genomic DNA

SEQ ID NO: 17994 - DNA, 58 bp, Homo sapiens; identical to SEQ ID NO: 6794
  misc_feature 1..58: note = chr3:13921080-13921138
  misc_feature 1..58: note = hyper
  source 1..58: mol_type = genomic DNA

SEQ ID NO: 17995 - DNA, 131 bp, Homo sapiens; identical to SEQ ID NO: 6795
  misc_feature 1..131: note = chr3:13921475-13921606
  misc_feature 1..131: note = hyper
  source 1..131: mol_type = genomic DNA

SEQ ID NO: 17996 - DNA, 278 bp, Homo sapiens; identical to SEQ ID NO: 6796
  misc_feature 1..278: note = chr3:14643752-14644030
  misc_feature 1..278: note = hyper
  source 1..278: mol_type = genomic DNA

SEQ ID NO: 17997 - DNA, 18 bp, Homo sapiens
  misc_feature 1..18: note = chr3:14851832-14851850
  misc_feature 1..18: note = hyper
  source 1..18: mol_type = genomic DNA
tgagttctcgtccttcga

SEQ ID NO: 17998 - DNA, 30 bp, Homo sapiens
  misc_feature 1..30: note = chr3:14851897-14851927
  misc_feature 1..30: note = hyper
  source 1..30: mol_type = genomic DNA
tgcgcagggacgccccggccctcgcctccc

SEQ ID NO: 17999 - DNA, 23 bp, Homo sapiens
  misc_feature 1..23: note = chr3:16554633-16554656
  misc_feature 1..23: note = hyper
  source 1..23: mol_type = genomic DNA
agagcctacgacccccaacaggc

SEQ ID NO: 18000 - DNA, 466 bp, Homo sapiens; identical to SEQ ID NO: 6802
  misc_feature 1..466: note = chr3:18485186-18485652
  misc_feature 1..466: note = hyper
  source 1..466: mol_type = genomic DNA

SEQ ID NO: 18001 - DNA, 22 bp, Homo sapiens
  misc_feature 1..22: note = chr3:19189419-19189441
  misc_feature 1..22: note = hyper
  source 1..22: mol_type = genomic DNA
gcctcacaactaactcgggctg

SEQ ID NO: 18002 - DNA, 25 bp, Homo sapiens
  misc_feature 1..25: note = chr3:19189470-19189495
  misc_feature 1..25: note = hyper
  source 1..25: mol_type = genomic DNA
gcaagtgctccggaagggggccgcc

SEQ ID NO: 18003 - DNA, 56 bp, Homo sapiens; identical to SEQ ID NO: 6804
  misc_feature 1..56: note = chr3:19190075-19190131
  misc_feature 1..56: note = hyper
  source 1..56: mol_type = genomic DNA

SEQ ID NO: 18004 - DNA, 15 bp, Homo sapiens
  misc_feature 1..15: note = chr3:22413896-22413911
  misc_feature 1..15: note = hyper
  source 1..15: mol_type = genomic DNA
ctccgccacctgaac

SEQ ID NO: 18005 - DNA, 104 bp, Homo sapiens
  misc_feature 1..104: note = chr3:22413974-22414078
  misc_feature 1..104: note = hyper
  source 1..104: mol_type = genomic DNA
cttttctctccttcctcccaccgagctcttcattctcctgctggcggccgcccggcgccctggccctggcatccgggaggagcagccgccggggctggctgtcc

SEQ ID NO: 18006 - DNA, 75 bp, Homo sapiens; identical to SEQ ID NO: 6807
  misc_feature 1..75: note = chr3:24870769-24870844
  misc_feature 1..75: note = hyper
  source 1..75: mol_type = genomic DNA

SEQ ID NO: 18007 - DNA, 32 bp, Homo sapiens; identical to SEQ ID NO: 6808
  misc_feature 1..32: note = chr3:24872010-24872042
  misc_feature 1..32: note = hyper
  source 1..32: mol_type = genomic DNA

SEQ ID NO: 18008 - DNA, 45 bp, Homo sapiens; identical to SEQ ID NO: 2211
  misc_feature 1..45: note = chr3:26665077-26665122
  misc_feature 1..45: note = hyper
  source 1..45: mol_type = genomic DNA

SEQ ID NO: 18009 - DNA, 63 bp, Homo sapiens; identical to SEQ ID NO: 6810
  misc_feature 1..63: note = chr3:26665569-26665632
  misc_feature 1..63: note = hyper
  source 1..63: mol_type = genomic DNA

SEQ ID NO: 18010 - DNA, 47 bp, Homo sapiens; identical to SEQ ID NO: 6811
  misc_feature 1..47: note = chr3:27754174-27754221
  misc_feature 1..47: note = hyper
  source 1..47: mol_type = genomic DNA

SEQ ID NO: 18011 - DNA, 13 bp, Homo sapiens
  misc_feature 1..13: note = chr3:27754465-27754478
  misc_feature 1..13: note = hyper
  source 1..13: mol_type = genomic DNA
attcttttcaaga

SEQ ID NO: 18012 - DNA, 24 bp, Homo sapiens
  misc_feature 1..24: note = chr3:27754508-27754532
  misc_feature 1..24: note = hyper
  source 1..24: mol_type = genomic DNA
gcttactcccgggctggaccttgg

SEQ ID NO: 18013 - DNA, 114 bp, Homo sapiens; identical to SEQ ID NO: 6813
  misc_feature 1..114: note = chr3:27754814-27754928
  misc_feature 1..114: note = hyper
  source 1..114: mol_type = genomic DNA

SEQ ID NO: 18014 - DNA, 66 bp, Homo sapiens; identical to SEQ ID NO: 6814
  misc_feature 1..66: note = chr3:27756087-27756153
  misc_feature 1..66: note = hyper
  source 1..66: mol_type = genomic DNA

SEQ ID NO: 18015 - DNA, 679 bp, Homo sapiens
  misc_feature 1..679: note = chr3:27762887-27763566
  misc_feature 1..679: note = hyper
  source 1..679: mol_type = genomic DNA
ctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccc

SEQ ID NO: 18016 - DNA, 247 bp, Homo sapiens
  misc_feature 1..247: note = chr3:27763595-27763842
  misc_feature 1..247: note = hyper
  source 1..247: mol_type = genomic DNA
ccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattat

SEQ ID NO: 18017 - DNA, 32 bp, Homo sapiens; identical to SEQ ID NO: 6816
  misc_feature 1..32: note = chr3:27764130-27764162
  misc_feature 1..32: note = hyper
  source 1..32: mol_type = genomic DNA

SEQ ID NO: 18018 - DNA, 15 bp, Homo sapiens
  misc_feature 1..15: note = chr3:27765347-27765362
  misc_feature 1..15: note = hyper
  source 1..15: mol_type = genomic DNA
cgggagcgcattttc

SEQ ID NO: 18019 - DNA, 68 bp, Homo sapiens
  misc_feature 1..68: note = chr3:28616764-28616832
  misc_feature 1..68: note = hyper
  source 1..68: mol_type = genomic DNA
ctttacgccaaactccggcgcgccgcgagactcgcgtcctcgctgtccccgaggggccccaccccttc

SEQ ID NO: 18020 - DNA, 45 bp, Homo sapiens; identical to SEQ ID NO: 6822
  misc_feature 1..45: note = chr3:28617899-28617944
  misc_feature 1..45: note = hyper
  source 1..45: mol_type = genomic DNA

SEQ ID NO: 18021 - DNA, 40 bp, Homo sapiens; identical to SEQ ID NO: 6823
  misc_feature 1..40: note = chr3:32857752-32857792
  misc_feature 1..40: note = hyper
  source 1..40: mol_type = genomic DNA

SEQ ID NO: 18022 - DNA, 33 bp, Homo sapiens; identical to SEQ ID NO: 6824
  misc_feature 1..33: note = chr3:32858114-32858147
  misc_feature 1..33: note = hyper
  source 1..33: mol_type = genomic DNA

SEQ ID NO: 18023 - DNA, 375 bp, Homo sapiens
  misc_feature 1..375: note = chr3:32859693-32860068
  misc_feature 1..375: note = hyper
  source 1..375: mol_type = genomic DNA
cgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgc

SEQ ID NO: 18024 - DNA, 57 bp, Homo sapiens; identical to SEQ ID NO: 6828
  misc_feature 1..57: note = chr3:33259719-33259776
  misc_feature 1..57: note = hyper
  source 1..57: mol_type = genomic DNA

SEQ ID NO: 18025 - DNA, 20 bp, Homo sapiens
  misc_feature 1..20: note = chr3:33260776-33260796
  misc_feature 1..20: note = hyper
  source 1..20: mol_type = genomic DNA
gtcctcggcctctacttttc

SEQ ID NO: 18026 - DNA, 131 bp, Homo sapiens; identical to SEQ ID NO: 6830
  misc_feature 1..131: note = chr3:35680984-35681115
  misc_feature 1..131: note = hyper
  source 1..131: mol_type = genomic DNA

SEQ ID NO: 18027 - DNA, 59 bp, Homo sapiens; identical to SEQ ID NO: 6831
  misc_feature 1..59: note = chr3:35681483-35681542
  misc_feature 1..59: note = hyper
  source 1..59: mol_type = genomic DNA

SEQ ID NO: 18028 - DNA, 149 bp, Homo sapiens; identical to SEQ ID NO: 6832
  misc_feature 1..149: note = chr3:36805921-36806070
  misc_feature 1..149: note = hyper
  source 1..149: mol_type = genomic DNA

SEQ ID NO: 18029 - DNA, 24 bp, Homo sapiens
  misc_feature 1..24: note = chr3:38035989-38036013
  misc_feature 1..24: note = hyper
  source 1..24: mol_type = genomic DNA
ccgtggaggcggtgccttggctgg

SEQ ID NO: 18030 - DNA, 32 bp, Homo sapiens; identical to SEQ ID NO: 6834
  misc_feature 1..32: note = chr3:38071358-38071390
  misc_feature 1..32: note = hyper
  source 1..32: mol_type = genomic DNA

SEQ ID NO: 18031 - DNA, 84 bp, Homo sapiens
  misc_feature 1..84: note = chr3:38080925-38081009
  misc_feature 1..84: note = hyper
  source 1..84: mol_type = genomic DNA
gctggcgcagcgtcccgagcctcagctgcttcgtctgcgcccctcctcgctgcgcacccaagatatctcgcacttgctcaccgg

SEQ ID NO: 18032 - DNA, 15 bp, Homo sapiens
  misc_feature 1..15: note = chr3:38081271-38081286
  misc_feature 1..15: note = hyper
  source 1..15: mol_type = genomic DNA
attctagtggaagga

SEQ ID NO: 18033 - DNA, 32 bp, Homo sapiens
  misc_feature 1..32: note = chr3:38690668-38690700
  misc_feature 1..32: note = hyper
  source 1..32: mol_type = genomic DNA
gaccctccccgagcctgcgccagggatggccg

SEQ ID NO: 18034 - DNA, 66 bp, Homo sapiens; identical to SEQ ID NO: 6838
  misc_feature 1..66: note = chr3:42543514-42543580
  misc_feature 1..66: note = hyper
  source 1..66: mol_type = genomic DNA

SEQ ID NO: 18035 - DNA, 123 bp, Homo sapiens
  misc_feature 1..123: note = chr3:42814446-42814569
  misc_feature 1..123: note = hyper
  source 1..123: mol_type = genomic DNA
tgcatggaaaataagcgtctgcctgggttagaagagggctgtgtgtgaagattcaaaggacgaaggggaagagtcctcgctgggcgcccagcacgcggtgagcgcccggccagtggcagcgcg

SEQ ID NO: 18036 - DNA, 515 bp, Homo sapiens
  misc_feature 1..515: note = chr3:42814603-42815118
  misc_feature 1..515: note = hyper
  source 1..515: mol_type = genomic DNA
gcccccggcagctgcgggctttcccagctccggcccgggcccttccgctctccccggcacttacagcggtctctctccacttctcccttctaggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttgaaaaatgtaaaacagtgtggggaaaggccatgttatgatggtgagtgaaggaagcaggacgcaatatagcaatg

SEQ ID NO: 18037 - DNA, 65 bp, Homo sapiens; identical to SEQ ID NO: 6841
  misc_feature 1..65: note = chr3:43020926-43020991
  misc_feature 1..65: note = hyper
  source 1..65: mol_type = genomic DNA

SEQ ID NO: 18038 - DNA, 111 bp, Homo sapiens; identical to SEQ ID NO: 6842
  misc_feature 1..111: note = chr3:43021302-43021413
  misc_feature 1..111: note = hyper
  source 1..111: mol_type = genomic DNA

SEQ ID NO: 18039 - DNA, 272 bp, Homo sapiens; identical to SEQ ID NO: 6843
  misc_feature 1..272: note = chr3:43935870-43936142
  misc_feature 1..272: note = hyper
  source 1..272: mol_type = genomic DNA

SEQ ID NO: 18040 - DNA, 240 bp, Homo sapiens
  misc_feature 1..240: note = chr3:44036330-44036570
  misc_feature 1..240: note = hyper
  source 1..240: mol_type = genomic DNA
ccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcag

SEQ ID NO: 18041 - DNA, 220 bp, Homo sapiens
  misc_feature 1..220: note = chr3:44036600-44036820
  misc_feature 1..220: note = hyper
  source 1..220: mol_type = genomic DNA
gatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcga

SEQ ID NO: 18042 - DNA, 422 bp, Homo sapiens
  misc_feature 1..422: note = chr3:44037203-44037625
  misc_feature 1..422: note = hyper
  source 1..422: mol_type = genomic DNA
tcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttggg

SEQ ID NO: 18043 - DNA, 212 bp, Homo sapiens
  misc_feature 1..212: note = chr3:44037662-44037874
  misc_feature 1..212: note = hyper
  source 1..212: mol_type = genomic DNA
ccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtc

SEQ ID NO: 18044 - DNA, 248 bp, Homo sapiens
  misc_feature 1..248: note = chr3:44038646-44038894
  misc_feature 1..248: note = hyper
  source 1..248: mol_type = genomic DNA
tggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagac

SEQ ID NO: 18045 - DNA, 20 bp, Homo sapiens
  misc_feature 1..20: note = chr3:44040006-44040026
  misc_feature 1..20: note = hyper
  source 1..20: mol_type = genomic DNA
tgcgagttggattcgcacca

SEQ ID NO: 18046 - DNA, 455 bp, Homo sapiens
  misc_feature 1..455: note = chr3:44040056-44040511
  misc_feature 1..455: note = hyper
  source 1..455: mol_type = genomic DNA
cggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggta

SEQ ID NO: 18047 - DNA, 243 bp, Homo sapiens
  misc_feature 1..243: note = chr3:44040553-44040796
  misc_feature 1..243: note = hyper
  source 1..243: mol_type = genomic DNA
ccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggtta

SEQ ID NO: 18048 - DNA, 56 bp, Homo sapiens
  misc_feature 1..56: note = chr3:44041039-44041095
  misc_feature 1..56: note = hyper
  source 1..56: mol_type = genomic DNA
tgggatgctgtggggacagtgcgggggacgtgtggggtcttcggatgcgaacgcga

SEQ ID NO: 18049 - DNA, 15 bp, Homo sapiens
  misc_feature 1..15: note = chr3:44596464-44596479
  misc_feature 1..15: note = hyper
  source 1..15: mol_type = genomic DNA
ggtgtagagctggga

SEQ ID NO: 18050 - DNA, 207 bp, Homo sapiens
  misc_feature 1..207: note = chr3:44596509-44596716
  misc_feature 1..207: note = hyper
  source 1..207: mol_type = genomic DNA
agcgggatgtgagtggcctgggccctcgcgagaccccgaccccgcccgcggcaggtggccgggcacagccgagaagtaagccctgccagctctcccgggtgcggggacgcgcgcgcccaccttcgcaaacgagacttccgggatcccggagggggcggaagtcgaggcctctctcgcttccggctcggccattgtttttggtctaac

SEQ ID NO: 18051 - DNA, 210 bp, Homo sapiens
  misc_feature 1..210: note = chr3:44596809-44597019
  misc_feature 1..210: note = hyper
  source 1..210: mol_type = genomic DNA
ggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgc

SEQ ID NO: 18052 - DNA, 24 bp, Homo sapiens
  misc_feature 1..24: note = chr3:44726825-44726849
  misc_feature 1..24: note = hyper
  source 1..24: mol_type = genomic DNA
atctgcatgcgattaaaaatgggt

SEQ ID NO: 18053 - DNA, 66 bp, Homo sapiens; identical to SEQ ID NO: 6855
  misc_feature 1..66: note = chr3:44771010-44771076
  misc_feature 1..66: note = hyper
  source 1..66: mol_type = genomic DNA

SEQ ID NO: 18054 - DNA, 118 bp, Homo sapiens; identical to SEQ ID NO: 6856
  misc_feature 1..118: note = chr3:45837583-45837701
  misc_feature 1..118: note = hyper
  source 1..118: mol_type = genomic DNA

SEQ ID NO: 18055 - DNA, 265 bp, Homo sapiens; identical to SEQ ID NO: 6857
  misc_feature 1..265: note = chr3:45837907-45838172
  misc_feature 1..265: note = hyper
  source 1..265: mol_type = genomic DNA

SEQ ID NO: 18056 - DNA, 12 bp, Homo sapiens
  misc_feature 1..12: note = chr3:48693292-48693304
  misc_feature 1..12: note = hyper
  source 1..12: mol_type = genomic DNA
ggtgggaggggg

SEQ ID NO: 18057 - DNA, 30 bp, Homo sapiens; identical to SEQ ID NO: 6863
  misc_feature 1..30: note = chr3:48699943-48699973
  misc_feature 1..30: note = hyper
  source 1..30: mol_type = genomic DNA

SEQ ID NO: 18058 - DNA, 30 bp, Homo sapiens; identical to SEQ ID NO: 6864
  misc_feature 1..30: note = chr3:48700359-48700389
  misc_feature 1..30: note = hyper
  source 1..30: mol_type = genomic DNA

SEQ ID NO: 18059 - DNA, 41 bp, Homo sapiens; identical to SEQ ID NO: 6865
  misc_feature 1..41: note = chr3:49851326-49851367
  misc_feature 1..41: note = hyper
  source 1..41: mol_type = genomic DNA

SEQ ID NO: 18060 - DNA, 78 bp, Homo sapiens; identical to SEQ ID NO: 6866
  misc_feature 1..78: note = chr3:49907209-49907287
  misc_feature 1..78: note = hyper
  source 1..78: mol_type = genomic DNA

SEQ ID NO: 18061 - DNA, 33 bp, Homo sapiens
  misc_feature 1..33: note = chr3:50243350-50243383
  misc_feature 1..33: note = hyper
  source 1..33: mol_type = genomic DNA
tgctggtcccagagccggtgccatttgcagagg

SEQ ID NO: 18062 - DNA, 40 bp, Homo sapiens
  misc_feature 1..40: note = chr3:50243480-50243520
  misc_feature 1..40: note = hyper
  source 1..40: mol_type = genomic DNA
aagttagagcccgcgcagcgcacggcggagagaaggaacc

SEQ ID NO: 18063 - DNA, 269 bp, Homo sapiens; identical to SEQ ID NO: 6870
  misc_feature 1..269: note = chr3:54155224-54155493
  misc_feature 1..269: note = hyper
  source 1..269: mol_type = genomic DNA

SEQ ID NO: 18064 - DNA, 23 bp, Homo sapiens
  misc_feature 1..23: note = chr3:54155524-54155547
  misc_feature 1..23: note = hyper
  source 1..23: mol_type = genomic DNA
cgagaaggcgcctcctccggcgc

SEQ ID NO: 18065 - DNA, 110 bp, Homo sapiens; identical to SEQ ID NO: 6872
  misc_feature 1..110: note = chr3:54155775-54155885
  misc_feature 1..110: note = hyper
  source 1..110: mol_type = genomic DNA

SEQ ID NO: 18066 - DNA, 77 bp, Homo sapiens; identical to SEQ ID NO: 6873
  misc_feature 1..77: note = chr3:54156663-54156740
  misc_feature 1..77: note = hyper
  source 1..77: mol_type = genomic DNA

SEQ ID NO: 18067 - DNA, 40 bp, Homo sapiens; identical to SEQ ID NO: 6874
  misc_feature 1..40: note = chr3:54157034-54157074
  misc_feature 1..40: note = hyper
  source 1..40: mol_type = genomic DNA

SEQ ID NO: 18068 - DNA, 66 bp, Homo sapiens
  misc_feature 1..66: note = chr3:54157315-54157381
  misc_feature 1..66: note = hyper
  source 1..66: mol_type = genomic DNA
gcattcttaactccgcgacccccctcgggccccctcccgcgctgcgctttgcagttttggtgctgg

SEQ ID NO: 18069 - DNA, 223 bp, Homo sapiens
  misc_feature 1..223: note = chr3:54157450-54157673
  misc_feature 1..223: note = hyper
  source 1..223: mol_type = genomic DNA
gccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatgg

SEQ ID NO: 18070 - DNA, 146 bp, Homo sapiens; identical to SEQ ID NO: 6876
  misc_feature 1..146: note = chr3:55521121-55521267
  misc_feature 1..146: note = hyper
  source 1..146: mol_type = genomic DNA

SEQ ID NO: 18071 - DNA, 114 bp, Homo sapiens; identical to SEQ ID NO: 6877
  misc_feature 1..114: note = chr3:55522622-55522736
  misc_feature 1..114: note = hyper
  source 1..114: mol_type = genomic DNA

SEQ ID NO: 18072 - DNA, 97 bp, Homo sapiens
  misc_feature 1..97: note = chr3:55523009-55523106
  misc_feature 1..97: note = hyper
  source 1..97: mol_type = genomic DNA
ttgctcatctggctccggcccagagcatgaggcgcgatgcgtggtcctgccacggagatcttggcgggtgccctcaggtgaggagattgcgaagttt

SEQ ID NO: 18073 - DNA, 50 bp, Homo sapiens; identical to SEQ ID NO: 6879
  misc_feature 1..50: note = chr3:56502716-56502766
  misc_feature 1..50: note = hyper
  source 1..50: mol_type = genomic DNA

SEQ ID NO: 18074 - DNA, 30 bp, Homo sapiens; identical to SEQ ID NO: 6880
  misc_feature 1..30: note = chr3:62305019-62305049
  misc_feature 1..30: note = hyper
  source 1..30: mol_type = genomic DNA

SEQ ID NO: 18075 - DNA, 25 bp, Homo sapiens
  misc_feature 1..25: note = chr3:62354914-62354939
  misc_feature 1..25: note = hyper
  source 1..25: mol_type = genomic DNA
ttaggtctcccggagaaggggacgc

SEQ ID NO: 18076 - DNA, 129 bp, Homo sapiens
  misc_feature 1..129: note = chr3:62357495-62357624
  misc_feature 1..129: note = hyper
  source 1..129: mol_type = genomic DNA
ccaatactgtgtggccgctgacaagggcatccccattttacagaataggaaactgaggcccaacgaggctcccagtttgggtagtcaactactggggagctcctcagcttgaaaaaggggcattccagg

SEQ ID NO: 18077 - skipped

SEQ ID NO: 18078 - DNA, 15 bp, Homo sapiens
  misc_feature 1..15: note = chr3:62357735-62357750
  misc_feature 1..15: note = hyper
  source 1..15: mol_type = genomic DNA
cggagcctcctggca

SEQ ID NO: 18079 - DNA, 194 bp, Homo sapiens
  misc_feature 1..194: note = chr3:62358336-62358530
  misc_feature 1..194: note = hyper
  source 1..194: mol_type = genomic DNA
cggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaag

SEQ ID NO: 18080 - DNA, 409 bp, Homo sapiens
  misc_feature 1..409: note = chr3:62359893-62360302
  misc_feature 1..409: note = hyper
  source 1..409: mol_type = genomic DNA
aagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagaca

SEQ ID NO: 18081 - DNA, 51 bp, Homo sapiens
  misc_feature 1..51: note = chr3:62362851-62362902
  misc_feature 1..51: note = hyper
  source 1..51: mol_type = genomic DNA
gcctcagcctagagccggacgctttggcttcttcgccatctggccctaggt

SEQ ID NO: 18082 - DNA, 30 bp, Homo sapiens
  misc_feature 1..30: note = chr3:62363596-62363626
  misc_feature 1..30: note = hyper
  source 1..30: mol_type = genomic DNA
caatacataacacagcgccctatgtatgcc

SEQ ID NO: 18083 - DNA, 213 bp, Homo sapiens
  misc_feature 1..213: note = chr3:62363693-62363906
  misc_feature 1..213: note = hyper
  source 1..213: mol_type = genomic DNA
acgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatc

SEQ ID NO: 18084 - DNA, 54 bp, Homo sapiens; identical to SEQ ID NO: 6897
  misc_feature 1..54: note = chr3:62861840-62861894
  misc_feature 1..54: note = hyper
  source 1..54: mol_type = genomic DNA

SEQ ID NO: 18085 - DNA, 200 bp, Homo sapiens; identical to SEQ ID NO: 6898
  misc_feature 1..200: note = chr3:63264640-63264840
  misc_feature 1..200: note = hyper
  source 1..200: mol_type = genomic DNA

SEQ ID NO: 18086 - DNA, 30 bp, Homo sapiens; identical to SEQ ID NO: 6899
  misc_feature 1..30: note = chr3:64672193-64672223
  misc_feature 1..30: note = hyper
  source 1..30: mol_type = genomic DNA

SEQ ID NO: 18087 - DNA, 35 bp, Homo sapiens
  misc_feature 1..35: note = chr3:68057145-68057180
  misc_feature 1..35: note = hyper
  source 1..35: mol_type = genomic DNA
tgctggagctcgggccgccccgggagaaggggtgg

SEQ ID NO: 18088 - DNA, 15 bp, Homo sapiens
  misc_feature 1..15: note = chr3:68980916-68980931
  misc_feature 1..15: note = hyper
  source 1..15: mol_type = genomic DNA
gggtgggggtggggg

SEQ ID NO: 18089 - DNA, 105 bp, Homo sapiens
  misc_feature 1..105: note = chr3:68981113-68981218
  misc_feature 1..105: note = hyper
  source 1..105: mol_type = genomic DNA
acatgaaccccgaaactggaagcggccgctgcctctctccagccacacatccttacttcggagtgccccttccaacttcgggttgcacgccgacctcagcacagg

SEQ ID NO: 18090 - DNA, 398 bp, Homo sapiens; identical to SEQ ID NO: 6903
  misc_feature 1..398: note = chr3:69435163-69435561
  misc_feature 1..398: note = hyper
  source 1..398: mol_type = genomic DNA

SEQ ID NO: 18091 - DNA, 37 bp, Homo sapiens; identical to SEQ ID NO: 6904
  misc_feature 1..37: note = chr3:69435621-69435658
  misc_feature 1..37: note = hyper
  source 1..37: mol_type = genomic DNA

SEQ ID NO: 18092 - DNA, 30 bp, Homo sapiens; identical to SEQ ID NO: 6905
  misc_feature 1..30: note = chr3:69590888-69590918
  misc_feature 1..30: note = hyper
  source 1..30: mol_type = genomic DNA

SEQ ID NO: 18093 - DNA, 70 bp, Homo sapiens; identical to SEQ ID NO: 6908
  misc_feature 1..70: note = chr3:71179297-71179367
  misc_feature 1..70: note = hyper
  source 1..70: mol_type = genomic DNA

SEQ ID NO: 18094 - DNA, 268 bp, Homo sapiens
  misc_feature 1..268: note = chr3:71802858-71803126
  misc_feature 1..268: note = hyper
  source 1..268: mol_type = genomic DNA
agagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctc

SEQ ID NO: 18095 - DNA, 119 bp, Homo sapiens; identical to SEQ ID NO: 6911
  misc_feature 1..119: note = chr3:71803826-71803945
  misc_feature 1..119: note = hyper
  source 1..119: mol_type = genomic DNA

SEQ ID NO: 18096 - DNA, 469 bp, Homo sapiens; identical to SEQ ID NO: 6912
  misc_feature 1..469: note = chr3:71834256-71834725
  misc_feature 1..469: note = hyper
  source 1..469: mol_type = genomic DNA

SEQ ID NO: 18097 - DNA, 15 bp, Homo sapiens
  misc_feature 1..15: note = chr3:75955872-75955887
  misc_feature 1..15: note = hyper
  source 1..15: mol_type = genomic DNA
cgctgcgccaccacc

SEQ ID NO: 18098 - DNA, 32 bp, Homo sapiens; identical to SEQ ID NO: 6915
  misc_feature 1..32: note = chr3:77089150-77089182
  misc_feature 1..32: note = hyper
  source 1..32: mol_type = genomic DNA

SEQ ID NO: 18099 - DNA, 325 bp, Homo sapiens
  misc_feature 1..325: note = chr3:79815557-79815882
  misc_feature 1..325: note = hyper
  source 1..325: mol_type = genomic DNA
atgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaac

SEQ ID NO: 18100 - DNA, 103 bp, Homo sapiens; identical to SEQ ID NO: 6918
  misc_feature 1..103: note = chr3:85007801-85007904
  misc_feature 1..103: note = hyper
  source 1..103: mol_type = genomic DNA

SEQ ID NO: 18101 - skipped

SEQ ID NO: 18102 - DNA, 30 bp, Homo sapiens; identical to SEQ ID NO: 6920
  misc_feature 1..30: note = chr3:85009273-85009303
  misc_feature 1..30: note = hyper
  source 1..30: mol_type = genomic DNA

SEQ ID NO: 18103 - DNA, 30 bp, Homo sapiens; identical to SEQ ID NO: 6921
  misc_feature 1..30: note = chr3:85009835-85009865
  misc_feature 1..30: note = hyper
  source 1..30: mol_type = genomic DNA

SEQ ID NO: 18104 - DNA, 30 bp, Homo sapiens; identical to SEQ ID NO: 6922
  misc_feature 1..30: note = chr3:87040188-87040218
  misc_feature 1..30: note = hyper
  source 1..30: mol_type = genomic DNA

SEQ ID NO: 18105 - DNA, 30 bp, Homo sapiens; identical to SEQ ID NO: 6923
  misc_feature 1..30: note = chr3:87841652-87841682
  misc_feature 1..30: note = hyper
  source 1..30: mol_type = genomic DNA

SEQ ID NO: 18106 - DNA, 36 bp, Homo sapiens; identical to SEQ ID NO: 6924
  misc_feature 1..36: note = chr3:87842210-87842246
  misc_feature 1..36: note = hyper
  source 1..36: mol_type = genomic DNA

SEQ ID NO: 18107 - DNA, 13 bp, Homo sapiens
  misc_feature 1..13: note = chr3:87842247-87842260
  misc_feature 1..13: note = hyper
  source 1..13: mol_type = genomic DNA
gagatagtggtca

SEQ ID NO: 18108 - DNA, 75 bp, Homo sapiens; identical to SEQ ID NO: 6926
  misc_feature 1..75: note = chr3:96532177-96532252
  misc_feature 1..75: note = hyper
  source 1..75: mol_type = genomic DNA

SEQ ID NO: 18109 - DNA, 65 bp, Homo sapiens
  misc_feature 1..65: note = chr3:96532873-96532938
  misc_feature 1..65: note = hyper
  source 1..65: mol_type = genomic DNA
ctcaccccctccagcggtggaaatgtggagaagtaagtgggaggcggtgtcgggaactgactcct

SEQ ID NO: 18110 - DNA, 141 bp, Homo sapiens
  misc_feature 1..141: note = chr3:96533242-96533383
  misc_feature 1..141: note = hyper
  source 1..141: mol_type = genomic DNA
ccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaa

SEQ ID NO: 18111 - skipped

SEQ ID NO: 18112 - DNA, 205 bp, Homo sapiens; identical to SEQ ID NO: 6929
  misc_feature 1..205: note = chr3:98452166-98452371
  misc_feature 1..205: note = hyper
  source 1..205: mol_type = genomic DNA

SEQ ID NO: 18113 - DNA, 51 bp, Homo sapiens; identical to SEQ ID NO: 6930
  misc_feature 1..51: note = chr3:98620538-98620589
  misc_feature 1..51: note = hyper
  source 1..51: mol_type = genomic DNA

SEQ ID NO: 18114 - DNA, 54 bp, Homo sapiens
  misc_feature 1..54: note = chr3:99595105-99595159
  misc_feature 1..54: note = hyper
  source 1..54: mol_type = genomic DNA
gggcgccggtgaccgcgggaccctcggccgcggcggcggcgcagccacacaccc

SEQ ID NO: 18115 - DNA, 30 bp, Homo sapiens; identical to SEQ ID NO: 6932
  misc_feature 1..30: note = chr3:110789665-110789695
  misc_feature 1..30: note = hyper
  source 1..30: mol_type = genomic DNA

SEQ ID NO: 18116 - DNA, 15 bp, Homo sapiens
  misc_feature 1..15: note = chr3:112930422-112930437
  misc_feature 1..15: note = hyper
  source 1..15: mol_type = genomic DNA
tccatatggagggac

SEQ ID NO: 18117 - DNA, 30 bp, Homo sapiens; identical to SEQ ID NO: 6934
  misc_feature 1..30: note = chr3:112931110-112931140
  misc_feature 1..30: note = hyper
  source 1..30: mol_type = genomic DNA

SEQ ID NO: 18118 - DNA, 30 bp, Homo sapiens; identical to SEQ ID NO: 6935
  misc_feature 1..30: note = chr3:115231640-115231670
  misc_feature 1..30: note = hyper
  source 1..30: mol_type = genomic DNA

SEQ ID NO: 18119 - DNA, 142 bp, Homo sapiens; identical to SEQ ID NO: 6936
  misc_feature 1..142: note = chr3:116163769-116163911
  misc_feature 1..142: note = hyper
  source 1..142: mol_type = genomic DNA

SEQ ID NO: 18120 - DNA, 208 bp, Homo sapiens
  misc_feature 1..208: note = chr3:117716473-117716681
  misc_feature 1..208: note = hyper
  source 1..208: mol_type = genomic DNA
aagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttgg

SEQ ID NO: 18121 - DNA, 48 bp, Homo sapiens; identical to SEQ ID NO: 6941
  misc_feature 1..48: note = chr3:120003868-120003916
  misc_feature 1..48: note = hyper
  source 1..48: mol_type = genomic DNA

SEQ ID NO: 18122 - skipped

SEQ ID NO: 18123 - DNA, 53 bp, Homo sapiens; identical to SEQ ID NO: 6943
  misc_feature 1..53: note = chr3:120170117-120170170
  misc_feature 1..53: note = hyper
  source 1..53: mol_type = genomic DNA

SEQ ID NO: 18124 - DNA, 65 bp, Homo sapiens
  misc_feature 1..65: note = chr3:120627453-120627518
  misc_feature 1..65: note = hyper
  source 1..65: mol_type = genomic DNA
cgcctcagcgctgggcctgggggagggacagcgggagcggcggctctgcgcgcccagcaggctga

SEQ ID NO: 18125 - DNA, 39 bp, Homo sapiens; identical to SEQ ID NO: 2248
  misc_feature 1..39: note = chr3:120627972-120628011
  misc_feature 1..39: note = hyper
  source 1..39: mol_type = genomic DNA

SEQ ID NO: 18126 - DNA, 173 bp, Homo sapiens; identical to SEQ ID NO: 308
  misc_feature 1..173: note = chr3:121902777-121902950
  misc_feature 1..173: note = hyper
  source 1..173: mol_type = genomic DNA

SEQ ID NO: 18127 - DNA, 29 bp, Homo sapiens
  misc_feature 1..29: note = chr3:121903619-121903648
  misc_feature 1..29: note = hyper
  source 1..29: mol_type = genomic DNA
aatgaacgggagcgcgcaccaaaacgcct

SEQ ID NO: 18128 - DNA, 45 bp, Homo sapiens; identical to SEQ ID NO: 6949
  misc_feature 1..45: note = chr3:122296693-122296738
  misc_feature 1..45: note = hyper
  source 1..45: mol_type = genomic DNA

SEQ ID NO: 18129 - DNA, 28 bp, Homo sapiens
  misc_feature 1..28: note = chr3:123166978-123167006
  misc_feature 1..28: note = hyper
  source 1..28: mol_type = genomic DNA
gccgccgccgccgcccgcagggggcgcc

SEQ ID NO: 18130 - DNA, 201 bp, Homo sapiens
  misc_feature 1..201: note = chr3:123167529-123167730
  misc_feature 1..201: note = hyper
  source 1..201: mol_type = genomic DNA
cggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgaggg

SEQ ID NO: 18131 - DNA, 102 bp, Homo sapiens; identical to SEQ ID NO: 6952
  misc_feature 1..102: note = chr3:123602641-123602743
  misc_feature 1..102: note = hyper
  source 1..102: mol_type = genomic DNA

SEQ ID NO: 18132 - DNA, 240 bp, Homo sapiens; identical to SEQ ID NO: 6953
  misc_feature 1..240: note = chr3:123603253-123603493
  misc_feature 1..240: note = hyper
  source 1..240: mol_type = genomic DNA

SEQ ID NO: 18133 - DNA, 134 bp, Homo sapiens; identical to SEQ ID NO: 6956
  misc_feature 1..134: note = chr3:125986552-125986686
  misc_feature 1..134: note = hyper
  source 1..134: mol_type = genomic DNA

SEQ ID NO: 18134 - DNA, 30 bp, Homo sapiens; identical to SEQ ID NO: 6957
  misc_feature 1..30: note = chr3:126113880-126113910
  misc_feature 1..30: note = hyper
  source 1..30: mol_type = genomic DNA

SEQ ID NO: 18135 - DNA, 72 bp, Homo sapiens
  misc_feature 1..72: note = chr3:127794474-127794546
  misc_feature 1..72: note = hyper
  source 1..72: mol_type = genomic DNA
tgtgacttggaatctcggatccctgggctaggcctggccacgcccccatggggggaggggcagcgcggcggg

SEQ ID NO: 18136 - DNA, 30 bp, Homo sapiens
  misc_feature 1..30: note = chr3:128202417-128202447
  misc_feature 1..30: note = hyper
  source 1..30: mol_type = genomic DNA
cagaggacaggagtccggcccgtggacact

SEQ ID NO: 18137 - DNA, 222 bp, Homo sapiens; identical to SEQ ID NO: 6961
  misc_feature 1..222: note = chr3:128205402-128205624
  misc_feature 1..222: note = hyper
  source 1..222: mol_type = genomic DNA

SEQ ID NO: 18138 - DNA, 67 bp, Homo sapiens; identical to SEQ ID NO: 6962
  misc_feature 1..67: note = chr3:128208538-128208605
  misc_feature 1..67: note = hyper
  source 1..67: mol_type = genomic DNA

SEQ ID NO: 18139 - DNA, 161 bp, Homo sapiens
  misc_feature 1..161: note = chr3:128273832-128273993
  misc_feature 1..161: note = hyper
  source 1..161: mol_type = genomic DNA
cctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggag

SEQ ID NO: 18140 - DNA, 44 bp, Homo sapiens
  misc_feature 1..44: note = chr3:128274611-128274655
  misc_feature 1..44: note = hyper
  source 1..44: mol_type = genomic DNA
tggcagcgctgctagagccatcggacctgtgaggggggggcgcc

SEQ ID NO: 18141 - DNA, 206 bp, Homo sapiens
  misc_feature 1..206: note = chr3:128417231-128417437
  misc_feature 1..206: note = hyper
  source 1..206: mol_type = genomic DNA
caggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacc

SEQ ID NO: 18142 - DNA, 39 bp, Homo sapiens
  misc_feature 1..39: note = chr3:128720830-128720869
  misc_feature 1..39: note = hyper
  source 1..39: mol_type = genomic DNA
cggggactcagataccgatgaagaggcgcgcctggcgct

SEQ ID NO: 18143 - DNA, 86 bp, Homo sapiens
  misc_feature 1..86: note = chr3:128721229-128721315
  misc_feature 1..86: note = hyper
  source 1..86: mol_type = genomic DNA
ctggctgcggagcccgacaggacagagtcagaggaaggggagacagagggcagccccacaccatcccactccgcatcagcacactt

SEQ ID NO: 18144 - DNA, 126 bp, Homo sapiens
  misc_feature 1..126: note = chr3:130064484-130064610
  misc_feature 1..126: note = hyper
  source 1..126: mol_type = genomic DNA
aaagccagcaaacagctggagcgtctctggacactcacattaaaacttgtgaagagttaaaagccccagggaagagccaggccaagggcacgggtcagcgccggcttaaaagaccctctcagggca

SEQ ID NO: 18145 - DNA, 37 bp, Homo sapiens; identical to SEQ ID NO: 6977
  misc_feature 1..37: note = chr3:130235542-130235579
  misc_feature 1..37: note = hyper
  source 1..37: mol_type = genomic DNA

SEQ ID NO: 18146 - DNA, 93 bp, Homo sapiens; identical to SEQ ID NO: 2266
  misc_feature 1..93: note = chr3:130235834-130235927
  misc_feature 1..93: note = hyper
  source 1..93: mol_type = genomic DNA

SEQ ID NO: 18147 - DNA, 83 bp, Homo sapiens
  misc_feature 1..83: note = chr3:132757104-132757187
  misc_feature 1..83: note = hyper
  source 1..83: mol_type = genomic DNA
gcgaccggattggctgtcgcggacgctgacggacaaggccggggcgggccagagcctggtcggaggggcgcgcgcgggggccc

SEQ ID NO: 18148 - DNA, 95 bp, Homo sapiens; identical to SEQ ID NO: 6981
  misc_feature 1..95: note = chr3:132757780-132757875
  misc_feature 1..95: note = hyper
  source 1..95: mol_type = genomic DNA

SEQ ID NO: 18149 - DNA, 81 bp, Homo sapiens; identical to SEQ ID NO: 6982
  misc_feature 1..81: note = chr3:133646291-133646372
  misc_feature 1..81: note = hyper
  source 1..81: mol_type = genomic DNA

SEQ ID NO: 18150 - DNA, 63 bp, Homo sapiens; identical to SEQ ID NO: 6983
  misc_feature 1..63: note = chr3:134125472-134125535
  misc_feature 1..63: note = hyper
  source 1..63: mol_type = genomic DNA

SEQ ID NO: 18151 - DNA, 53 bp, Homo sapiens; identical to SEQ ID NO: 6984
  misc_feature 1..53: note = chr3:134370030-134370083
  misc_feature 1..53: note = hyper
  source 1..53: mol_type = genomic DNA

SEQ ID NO: 18152 - DNA, 298 bp, Homo sapiens; identical to SEQ ID NO: 6985
  misc_feature 1..298: note = chr3:134514320-134514618
  misc_feature 1..298: note = hyper
  source 1..298: mol_type = genomic DNA

SEQ ID NO: 18153 - DNA, 151 bp, Homo sapiens; identical to SEQ ID NO: 6986
  misc_feature 1..151: note = chr3:134515381-134515532
  misc_feature 1..151: note = hyper
  source 1..151: mol_type = genomic DNA

SEQ ID NO: 18154 - DNA, 82 bp, Homo sapiens
  misc_feature 1..82: note = chr3:134516222-134516304
  misc_feature 1..82: note = hyper
  source 1..82: mol_type = genomic DNA
gggtgagcgcatttgcaagggcaattccagactggacttgcagcattggggtggcgtcatgcaggtccgaggctcggtccgg

SEQ ID NO: 18155 - DNA, 11 bp, Homo sapiens
  misc_feature 1..11: note = chr3:136537631-136537642
  misc_feature 1..11: note = hyper
  source 1..11: mol_type = genomic DNA
gaaggaataga

SEQ ID NO: 18156 - DNA, 30 bp, Homo sapiens; identical to SEQ ID NO: 6991
  misc_feature 1..30: note = chr3:137479200-137479230
  misc_feature 1..30: note = hyper
  source 1..30: mol_type = genomic DNA

SEQ ID NO: 18157 - DNA, 79 bp, Homo sapiens
  misc_feature 1..79: note = chr3:137479522-137479601
  misc_feature 1..79: note = hyper
  source 1..79: mol_type = genomic DNA
ggccggagggtggggcggagccttgtggcaaggcaggtgggtgcaggcctctggggccccagactgccgcgtctggctc

SEQ ID NO: 18158 - DNA, 37 bp, Homo sapiens
  misc_feature 1..37: note = chr3:137479943-137479980
  misc_feature 1..37: note = hyper
  source 1..37: mol_type = genomic DNA
tacgcgcaggagctgcgtgaaaggagaggcccagagc

SEQ ID NO: 18159 - DNA, 157 bp, Homo sapiens
  misc_feature 1..157: note = chr3:137484531-137484688
  misc_feature 1..157: note = hyper
  source 1..157: mol_type = genomic DNA
gacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 18160 - DNA, 54 bp, Homo sapiens; identical to SEQ ID NO: 6997
  misc_feature 1..54: note = chr3:137485531-137485585
  misc_feature 1..54: note = hyper
  source 1..54: mol_type = genomic DNA

SEQ ID NO: 18161 - DNA, 92 bp, Homo sapiens
  misc_feature 1..92: note = chr3:137485937-137486029
  misc_feature 1..92: note = hyper
  source 1..92: mol_type = genomic DNA
cttttctttcccctccgggtgaatgttttcttgaagattattgtctttcctgagaaaggaccctccgatgttatccagcaaaactctttgga

SEQ ID NO: 18162 - DNA, 16 bp, Homo sapiens
  misc_feature 1..16: note = chr3:137487065-137487081
  misc_feature 1..16: note = hyper
  source 1..16: mol_type = genomic DNA
gaggggcaaaggcctc

SEQ ID NO: 18163 - DNA, 17 bp, Homo sapiens
  misc_feature 1..17: note = chr3:137487082-137487099
  misc_feature 1..17: note = hyper
  source 1..17: mol_type = genomic DNA
gacggtggctgaagctg

SEQ ID NO: 18164 - DNA, 75 bp, Homo sapiens; identical to SEQ ID NO: 7002
  misc_feature 1..75: note = chr3:137488337-137488412
  misc_feature 1..75: note = hyper
  source 1..75: mol_type = genomic DNA

SEQ ID NO: 18165 - DNA, 143 bp, Homo sapiens
  misc_feature 1..143: note = chr3:137488807-137488950
  misc_feature 1..143: note = hyper
  source 1..143: mol_type = genomic DNA
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggc

SEQ ID NO: 18166 - DNA, 167 bp, Homo sapiens; identical to SEQ ID NO: 7006
  misc_feature 1..167: note = chr3:138154014-138154181
  misc_feature 1..167: note = hyper
  source 1..167: mol_type = genomic DNA

SEQ ID NO: 18167 - DNA, 47 bp, Homo sapiens
  misc_feature 1..47: note = chr3:138662087-138662134
  misc_feature 1..47: note = hyper
  source 1..47: mol_type = genomic DNA
ccctgaggttcctaccgcctgaccactggagggctgaagtgagaggc

SEQ ID NO: 18168 - DNA, 16 bp, Homo sapiens
  misc_feature 1..16: note = chr3:138662164-138662180
  misc_feature 1..16: note = hyper
  source 1..16: mol_type = genomic DNA
ctcctggcccaccagc

SEQ ID NO: 18169 - DNA, 86 bp, Homo sapiens
  misc_feature 1..86: note = chr3:138662296-138662382
  misc_feature 1..86: note = hyper
  source 1..86: mol_type = genomic DNA
atctatcctatcagaagtcggaagtcatctatcccatcagaagagtgaaagccgaccaccccctaatccgcctgggagaaccagac

SEQ ID NO: 18170 - DNA, 18 bp, Homo sapiens
  misc_feature 1..18: note = chr3:138664165-138664183
  misc_feature 1..18: note = hyper
  source 1..18: mol_type = genomic DNA
gcgcgcagagaggcagct

SEQ ID NO: 18171 - skipped

SEQ ID NO: 18172 - DNA, 105 bp, Homo sapiens; identical to SEQ ID NO: 321
  misc_feature 1..105: note = chr3:138679188-138679293
  misc_feature 1..105: note = hyper
  source 1..105: mol_type = genomic DNA

SEQ ID NO: 18173 - DNA, 55 bp, Homo sapiens
  misc_feature 1..55: note = chr3:139258212-139258267
  misc_feature 1..55: note = hyper
  source 1..55: mol_type = genomic DNA
gaggcaggcaggcagcgtctcgggagggctctagggagcggcccggagctgctcg

SEQ ID NO: 18174 - DNA, 308 bp, Homo sapiens; identical to SEQ ID NO: 7019
  misc_feature 1..308: note = chr3:139396463-139396771
  misc_feature 1..308: note = hyper
  source 1..308: mol_type = genomic DNA

SEQ ID NO: 18175 - DNA, 179 bp, Homo sapiens
  misc_feature 1..179: note = chr3:139653693-139653872
  misc_feature 1..179: note = hyper
  source 1..179: mol_type = genomic DNA
ccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagac

SEQ ID NO: 18176 - DNA, 682 bp, Homo sapiens; identical to SEQ ID NO: 324
  misc_feature 1..682: note = chr3:139653873-139654555
  misc_feature 1..682: note = hyper
  source 1..682: mol_type = genomic DNA

SEQ ID NO: 18177 - DNA, 273 bp, Homo sapiens; identical to SEQ ID NO: 7023
  misc_feature 1..273: note = chr3:139654788-139655061
  misc_feature 1..273: note = hyper
  source 1..273: mol_type = genomic DNA

SEQ ID NO: 18178 - DNA, 203 bp, Homo sapiens
  misc_feature 1..203: note = chr3:140769705-140769908
  misc_feature 1..203: note = hyper
  source 1..203: mol_type = genomic DNA
ctttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatga

SEQ ID NO: 18179 - DNA, 211 bp, Homo sapiens
  misc_feature 1..211: note = chr3:140770829-140771040
  misc_feature 1..211: note = hyper
  source 1..211: mol_type = genomic DNA
ttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatca

SEQ ID NO: 18180 - DNA, 48 bp, Homo sapiens; identical to SEQ ID NO: 7028
  misc_feature 1..48: note = chr3:140771752-140771800
  misc_feature 1..48: note = hyper
  source 1..48: mol_type = genomic DNA

SEQ ID NO: 18181 - DNA, 93 bp, Homo sapiens; identical to SEQ ID NO: 7029
  misc_feature 1..93: note = chr3:141516089-141516182
  misc_feature 1..93: note = hyper
  source 1..93: mol_type = genomic DNA

SEQ ID NO: 18182 - DNA, 25 bp, Homo sapiens
  misc_feature 1..25: note = chr3:141516719-141516744
  misc_feature 1..25: note = hyper
  source 1..25: mol_type = genomic DNA
gaaggacctgcgcacactcatactt

SEQ ID NO: 18183 - DNA, 192 bp, Homo sapiens; identical to SEQ ID NO: 7031
  misc_feature 1..192: note = chr3:142443659-142443851
  misc_feature 1..192: note = hyper
  source 1..192: mol_type = genomic DNA

SEQ ID NO: 18184 - DNA, 41 bp, Homo sapiens; identical to SEQ ID NO: 7032
  misc_feature 1..41: note = chr3:142607792-142607833
  misc_feature 1..41: note = hyper
  source 1..41: mol_type = genomic DNA

SEQ ID NO: 18185 - DNA, 60 bp, Homo sapiens; identical to SEQ ID NO: 7033
  misc_feature 1..60: note = chr3:142681935-142681995
  misc_feature 1..60: note = hyper
  source 1..60: mol_type = genomic DNA

SEQ ID NO: 18186 - DNA, 224 bp, Homo sapiens
  misc_feature 1..224: note = chr3:142682049-142682273
  misc_feature 1..224: note = hyper
  source 1..224: mol_type = genomic DNA
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgt

SEQ ID NO: 18187 - DNA, 658 bp, Homo sapiens
  misc_feature 1..658: note = chr3:142682392-142683050
  misc_feature 1..658: note = hyper
  source 1..658: mol_type = genomic DNA
gagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctc

SEQ ID NO: 18188 - DNA, 34 bp, Homo sapiens; identical to SEQ ID NO: 7035
  misc_feature 1..34: note = chr3:142683110-142683144
  misc_feature 1..34: note = hyper
  source 1..34: mol_type = genomic DNA

SEQ ID NO: 18189 - DNA, 142 bp, Homo sapiens
  misc_feature 1..142: note = chr3:142838479-142838621
  misc_feature 1..142: note = hyper
  source 1..142: mol_type = genomic DNA
cgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggct

SEQ ID NO: 18190 - DNA, 86 bp, Homo sapiens; identical to SEQ ID NO: 2296
  misc_feature 1..86: note = chr3:142839440-142839526
  misc_feature 1..86: note = hyper
  source 1..86: mol_type = genomic DNA

SEQ ID NO: 18191 - DNA, 18 bp, Homo sapiens
  misc_feature 1..18: note = chr3:142840236-142840254
  misc_feature 1..18: note = hyper
  source 1..18: mol_type = genomic DNA
ctacgagccagtgtggca

SEQ ID NO: 18192 - DNA, 33 bp, Homo sapiens; identical to SEQ ID NO: 7046
  misc_feature 1..33: note = chr3:145878520-145878553
  misc_feature 1..33: note = hyper
  source 1..33: mol_type = genomic DNA

SEQ ID NO: 18193 - DNA, 30 bp, Homo sapiens; identical to SEQ ID NO: 7047
  misc_feature 1..30: note = chr3:147072640-147072670
  misc_feature 1..30: note = hyper
  source 1..30: mol_type = genomic DNA

SEQ ID NO: 18194 - DNA, 167 bp, Homo sapiens
  misc_feature 1..167: note = chr3:147087395-147087562
  misc_feature 1..167: note = hyper
  source 1..167: mol_type = genomic DNA
tcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaacccc

SEQ ID NO: 18195 - DNA, 36 bp, Homo sapiens; identical to SEQ ID NO: 7053
  misc_feature 1..36: note = chr3:147090647-147090683
  misc_feature 1..36: note = hyper
  source 1..36: mol_type = genomic DNA

SEQ ID NO: 18196 - DNA, 49 bp, Homo sapiens; identical to SEQ ID NO: 7054
  misc_feature 1..49: note = chr3:147096028-147096077
  misc_feature 1..49: note = hyper
  source 1..49: mol_type = genomic DNA

SEQ ID NO: 18197 - DNA, 10 bp, Homo sapiens
  misc_feature 1..10: note = chr3:147098421-147098431
  misc_feature 1..10: note = hyper
  source 1..10: mol_type = genomic DNA
ttcagactgc

SEQ ID NO: 18198 - DNA, 15 bp, Homo sapiens
  misc_feature 1..15: note = chr3:147105883-147105898
  misc_feature 1..15: note = hyper
  source 1..15: mol_type = genomic DNA
taaacgtgggcaagt

SEQ ID NO: 18199 - DNA, 35 bp, Homo sapiens
  misc_feature 1..35: note = chr3:147108806-147108841
  misc_feature 1..35: note = hyper
  source 1..35: mol_type = genomic DNA
ggcagacggtgtagccgaatcgtagccagagctgg

SEQ ID NO: 18200 - DNA, 42 bp, Homo sapiens
  misc_feature 1..42: note = chr3:147110683-147110725
  misc_feature 1..42: note = hyper
  source 1..42: mol_type = genomic DNA
attttataaaacagtgatagaaagatgcggaataaatcagtg

SEQ ID NO: 18201 - DNA, 45 bp, Homo sapiens
  misc_feature 1..45: note = chr3:147111089-147111134
  misc_feature 1..45: note = hyper
  source 1..45: mol_type = genomic DNA
ggccaggtgaggccgcgccccagcttgctccggagctgcaggagg

SEQ ID NO: 18202 - DNA, 122 bp, Homo sapiens; identical to SEQ ID NO: 7061
  misc_feature 1..122: note = chr3:147111988-147112110
  misc_feature 1..122: note = hyper
  source 1..122: mol_type = genomic DNA

SEQ ID NO: 18203 - DNA, 39 bp, Homo sapiens; identical to SEQ ID NO: 7062
  misc_feature 1..39: note = chr3:147114179-147114218
  misc_feature 1..39: note = hyper
  source 1..39: mol_type = genomic DNA

SEQ ID NO: 18204 - DNA, 45 bp, Homo sapiens
  misc_feature 1..45: note = chr3:147126992-147127037
  misc_feature 1..45: note = hyper
  source 1..45: mol_type = genomic DNA
cgggccaatgagctgcgcgcggcgcctcggcgcgccctccgttgg

SEQ ID NO: 18205 - DNA, 10 bp, Homo sapiens
  misc_feature 1..10: note = chr3:147127902-147127912
  misc_feature 1..10: note = hyper
  source 1..10: mol_type = genomic DNA
ctcctggacg

SEQ ID NO: 18206 - DNA, 31 bp, Homo sapiens
  misc_feature 1..31: note = chr3:147136900-147136931
  misc_feature 1..31: note = hyper
  source 1..31: mol_type = genomic DNA
caccgaaggctgggtcgtcagcgtttgaggg

SEQ ID NO: 18207 - DNA, 143 bp, Homo sapiens
  misc_feature 1..143: note = chr3:147138856-147138999
  misc_feature 1..143: note = hyper
  source 1..143: mol_type = genomic DNA
gccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgc

SEQ ID NO: 18208 - DNA, 30 bp, Homo sapiens; identical to SEQ ID NO: 7068
  misc_feature 1..30: note = chr3:147139541-147139571
  misc_feature 1..30: note = hyper
  source 1..30: mol_type = genomic DNA

SEQ ID NO: 18209 - DNA, 87 bp, Homo sapiens
  misc_feature 1..87: note = chr3:148415340-148415427
  misc_feature 1..87: note = hyper
  source 1..87: mol_type = genomic DNA
agaagttctctaattcgtccttaaaagttttccaagttcagaaaaaaaaaatgttgaagaacacgaatctccgcaggaaatgatact

SEQ ID NO: 18210 - DNA, 176 bp, Homo sapiens
  misc_feature 1..176: note = chr3:148415644-148415820
  misc_feature 1..176: note = hyper
  source 1..176: mol_type = genomic DNA
agcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtg

SEQ ID NO: 18211 - DNA, 30 bp, Homo sapiens; identical to SEQ ID NO: 7070
  misc_feature 1..30: note = chr3:148416021-148416051
  misc_feature 1..30: note = hyper
  source 1..30: mol_type = genomic DNA

SEQ ID NO: 18212 - DNA, 155 bp, Homo sapiens; identical to SEQ ID NO: 7071
  misc_feature 1..155: note = chr3:149375236-149375391
  misc_feature 1..155: note = hyper
  source 1..155: mol_type = genomic DNA

SEQ ID NO: 18213 - DNA, 46 bp, Homo sapiens
  misc_feature 1..46: note = chr3:150802935-150802981
  misc_feature 1..46: note = hyper
  source 1..46: mol_type = genomic DNA
atcaagatcctggcacgtagcgaaggctccataaatggcagccatc

SEQ ID NO: 18214 - DNA, 518 bp, Homo sapiens
  misc_feature 1..518: note = chr3:150803080-150803598
  misc_feature 1..518: note = hyper
  source 1..518: mol_type = genomic DNA
cgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccggg

SEQ ID NO: 18215 - DNA, 64 bp, Homo sapiens; identical to SEQ ID NO: 7074
  misc_feature 1..64: note = chr3:150803966-150804030
  misc_feature 1..64: note = hyper
  source 1..64: mol_type = genomic DNA

SEQ ID NO: 18216 - DNA, 161 bp, Homo sapiens; identical to SEQ ID NO: 7075
  misc_feature 1..161: note = chr3:150804735-150804896
  misc_feature 1..161: note = hyper
  source 1..161: mol_type = genomic DNA

SEQ ID NO: 18217 - DNA, 31 bp, Homo sapiens
  misc_feature 1..31: note = chr3:150804936-150804967
  misc_feature 1..31: note = hyper
  source 1..31: mol_type = genomic DNA
cgggggccaggctgggggtgctgggcgaccc

SEQ ID NO: 18218 - skipped

SEQ ID NO: 18219 - DNA, 68 bp, Homo sapiens
  misc_feature 1..68: note = chr3:152553275-152553343
  misc_feature 1..68: note = hyper
  source 1..68: mol_type = genomic DNA
cggcggttccctgcgcgccctgttgtgtaagctcggcgttgccagcggacggagaagttgctggcttg

SEQ ID NO: 18220 - DNA, 102 bp, Homo sapiens
  misc_feature 1..102: note = chr3:152553384-152553486
  misc_feature 1..102: note = hyper
  source 1..102: mol_type = genomic DNA
ggcccgcggcgaacgcggggccagagctggcgtgggcgagcccctgcgcgccccctcccgcggggatccagttcgcctgctcccttccgctcgctggctttt

SEQ ID NO: 18221 - DNA, 53 bp, Homo sapiens
  misc_feature 1..53: note = chr3:154146601-154146654
  misc_feature 1..53: note = hyper
  source 1..53: mol_type = genomic DNA
gagcatcccccagagcgccgcagactcgggcctggagcatcctctggggacag

SEQ ID NO: 18222 - DNA, 57 bp, Homo sapiens
  misc_feature 1..57: note = chr3:154146908-154146965
  misc_feature 1..57: note = hyper
  source 1..57: mol_type = genomic DNA
ccgagagcagcagactggctgcccacacggtcagcaccacgccgagcacctggcccg

SEQ ID NO: 18223 - DNA, 75 bp, Homo sapiens
  misc_feature 1..75: note = chr3:154797703-154797778
  misc_feature 1..75: note = hyper
  source 1..75: mol_type = genomic DNA
tcagcccgccactgccacccggccccgtgcgctcattggtcgggatgtgtcggctcagcagcctccaacttctcc

SEQ ID NO: 18224 - DNA, 184 bp, Homo sapiens; identical to SEQ ID NO: 7082
  misc_feature 1..184: note = chr3:154797835-154798019
  misc_feature 1..184: note = hyper
  source 1..184: mol_type = genomic DNA

SEQ ID NO: 18225 - DNA, 158 bp, Homo sapiens
  misc_feature 1..158: note = chr3:156009425-156009583
  misc_feature 1..158: note = hyper
  source 1..158: mol_type = genomic DNA
acctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaa

SEQ ID NO: 18226 - DNA, 30 bp, Homo sapiens; identical to SEQ ID NO: 7085
  misc_feature 1..30: note = chr3:156009875-156009905
  misc_feature 1..30: note = hyper
  source 1..30: mol_type = genomic DNA

SEQ ID NO: 18227 - DNA, 32 bp, Homo sapiens; identical to SEQ ID NO: 7088
  misc_feature 1..32: note = chr3:157261124-157261156
  misc_feature 1..32: note = hyper
  source 1..32: mol_type = genomic DNA

SEQ ID NO: 18228 - DNA, 39 bp, Homo sapiens
  misc_feature 1..39: note = chr3:157812157-157812196
  misc_feature 1..39: note = hyper
  source 1..39: mol_type = genomic DNA
aggaggcaagggcgccgcgagctccccggatgcactggt

SEQ ID NO: 18229 - skipped

SEQ ID NO: 18230 - DNA, 234 bp, Homo sapiens
  misc_feature 1..234: note = chr3:157823143-157823377
  misc_feature 1..234: note = hyper
  source 1..234: mol_type = genomic DNA
gcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccc

SEQ ID NO: 18231 - DNA, 106 bp, Homo sapiens; identical to SEQ ID NO: 7096
  misc_feature 1..106: note = chr3:157823732-157823838
  misc_feature 1..106: note = hyper
  source 1..106: mol_type = genomic DNA

SEQ ID NO: 18232 - DNA, 38 bp, Homo sapiens
  misc_feature 1..38: note = chr3:157824871-157824909
  misc_feature 1..38: note = hyper
  source 1..38: mol_type = genomic DNA
catccccgcctctccctcacaatcccacccctgccggc

SEQ ID NO: 18233 - DNA, 92 bp, Homo sapiens; identical to SEQ ID NO: 7099
  misc_feature 1..92: note = chr3:158288920-158289012
  misc_feature 1..92: note = hyper
  source 1..92: mol_type = genomic DNA

SEQ ID NO: 18234 - DNA, 49 bp, Homo sapiens
  misc_feature 1..49: note = chr3:159944437-159944486
  misc_feature 1..49: note = hyper
  source 1..49: mol_type = genomic DNA
ccctctgccttgcctcgtattgtggttcactagtaagtgcctgcttccc

SEQ ID NO: 18235 - DNA, 60 bp, Homo sapiens; identical to SEQ ID NO: 7102
  misc_feature 1..60: note = chr3:160822815-160822875
  misc_feature 1..60: note = hyper
  source 1..60: mol_type = genomic DNA

SEQ ID NO: 18236 - DNA, 34 bp, Homo sapiens; identical to SEQ ID NO: 7105
  misc_feature 1..34: note = chr3:164914188-164914222
  misc_feature 1..34: note = hyper
  source 1..34: mol_type = genomic DNA

SEQ ID NO: 18237 - DNA, 116 bp, Homo sapiens
  misc_feature 1..116: note = chr3:164915129-164915245
  misc_feature 1..116: note = hyper
  source 1..116: mol_type = genomic DNA
taaaactgtagggcacagggagttgggaggggggcatttgcctgagagatgctggataccatttcgcgataaattagatacggacactggaacaattaatacgtgtaataacacgt

SEQ ID NO: 18238 - DNA, 30 bp, Homo sapiens; identical to SEQ ID NO: 7107
  misc_feature 1..30: note = chr3:167097947-167097977
  misc_feature 1..30: note = hyper
  source 1..30: mol_type = genomic DNA

SEQ ID NO: 18239 - DNA, 328 bp, Homo sapiens; identical to SEQ ID NO: 7108
  misc_feature 1..328: note = chr3:167968002-167968330
  misc_feature 1..328: note = hyper
  source 1..328: mol_type = genomic DNA

SEQ ID NO: 18240 - DNA, 30 bp, Homo sapiens; identical to SEQ ID NO: 7110
  misc_feature 1..30: note = chr3:169530363-169530393
  misc_feature 1..30: note = hyper
  source 1..30: mol_type = genomic DNA

SEQ ID NO: 18241 - DNA, 107 bp, Homo sapiens; identical to SEQ ID NO: 7111
  misc_feature 1..107: note = chr3:170136940-170137047
  misc_feature 1..107: note = hyper
  source 1..107: mol_type = genomic DNA

SEQ ID NO: 18242 - DNA, 27 bp, Homo sapiens
  misc_feature 1..27: note = chr3:170302590-170302617
  misc_feature 1..27: note = hyper
  source 1..27: mol_type = genomic DNA
cagggtgacatcctgcggcccttgggc

SEQ ID NO: 18243 - DNA, 52 bp, Homo sapiens
  misc_feature 1..52: note = chr3:170303035-170303087
  misc_feature 1..52: note = hyper
  source 1..52: mol_type = genomic DNA
cctggacaccgctcccgtcacgtcctcttcgccgctcccgggagagtcacca

SEQ ID NO: 18244 - DNA, 30 bp, Homo sapiens; identical to SEQ ID NO: 7116
  misc_feature 1..30: note = chr3:170625828-170625858
  misc_feature 1..30: note = hyper
  source 1..30: mol_type = genomic DNA

SEQ ID NO: 18245 - DNA, 53 bp, Homo sapiens; identical to SEQ ID NO: 7123
  misc_feature 1..53: note = chr3:173114201-173114254
  misc_feature 1..53: note = hyper
  source 1..53: mol_type = genomic DNA

SEQ ID NO: 18246 - DNA, 87 bp, Homo sapiens; identical to SEQ ID NO: 7124
  misc_feature 1..87: note = chr3:173114500-173114587
  misc_feature 1..87: note = hyper
  source 1..87: mol_type = genomic DNA

SEQ ID NO: 18247 - DNA, 120 bp, Homo sapiens; identical to SEQ ID NO: 2321
  misc_feature 1..120: note = chr3:173115047-173115167
  misc_feature 1..120: note = hyper
  source 1..120: mol_type = genomic DNA

SEQ ID NO: 18248 - DNA, 39 bp, Homo sapiens; identical to SEQ ID NO: 7126
  misc_feature 1..39: note = chr3:173115655-173115694
  misc_feature 1..39: note = hyper
  source 1..39: mol_type = genomic DNA

SEQ ID NO: 18249 - DNA, 210 bp, Homo sapiens; identical to SEQ ID NO: 7127
  misc_feature 1..210: note = chr3:173115965-173116175
  misc_feature 1..210: note = hyper
  source 1..210: mol_type = genomic DNA

SEQ ID NO: 18250 - DNA, 65 bp, Homo sapiens
  misc_feature 1..65: note = chr3:173302927-173302992
  misc_feature 1..65: note = hyper
  source 1..65: mol_type = genomic DNA
aatataaaaccacctcgcgcatccccggggggatcgctagggagctacctagatcgagctaaaaa

SEQ ID NO: 18251 - DNA, 374 bp, Homo sapiens
  misc_feature 1..374: note = chr3:179169266-179169640
  misc_feature 1..374: note = hyper
  source 1..374: mol_type = genomic DNA
ccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 18252 - DNA, 308 bp, Homo sapiens; identical to SEQ ID NO: 7133
  misc_feature 1..308: note = chr3:180397489-180397797
  misc_feature 1..308: note = hyper
  source 1..308: mol_type = genomic DNA

SEQ ID NO: 18253 - DNA, 41 bp, Homo sapiens; identical to SEQ ID NO: 7134
  misc_feature 1..41: note = chr3:180398001-180398042
  misc_feature 1..41: note = hyper
  source 1..41: mol_type = genomic DNA

SEQ ID NO: 18254 - DNA, 27 bp, Homo sapiens
  misc_feature 1..27: note = chr3:181413421-181413448
  misc_feature 1..27: note = hyper
  source 1..27: mol_type = genomic DNA
gacccacccagccgggcccgatccctc

SEQ ID NO: 18255 - DNA, 38 bp, Homo sapiens
  misc_feature 1..38: note = chr3:181413704-181413742
  misc_feature 1..38: note = hyper
  source 1..38: mol_type = genomic DNA
cgtcaagtggggtgtcgggtcgttttgttttttctcta

SEQ ID NO: 18256 - DNA, 46 bp, Homo sapiens; identical to SEQ ID NO: 7137
  misc_feature 1..46: note = chr3:181419696-181419742
  misc_feature 1..46: note = hyper
  source 1..46: mol_type = genomic DNA

SEQ ID NO: 18257 - DNA, 90 bp, Homo sapiens
  misc_feature 1..90: note = chr3:181419975-181420065
  misc_feature 1..90: note = hyper
  source 1..90: mol_type = genomic DNA
gcggctctcgccttccggggctggaacccgactcagatgtgaagcggcactgagccgctgcgcaggttcgtgcccagcgccccctgttgg

SEQ ID NO: 18258 - DNA, 200 bp, Homo sapiens
  misc_feature 1..200: note = chr3:181420116-181420316
  misc_feature 1..200: note = hyper
  source 1..200: mol_type = genomic DNA
ctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactc

SEQ ID NO: 18259 - DNA, 84 bp, Homo sapiens
  misc_feature 1..84: note = chr3:181420374-181420458
  misc_feature 1..84: note = hyper
  source 1..84: mol_type = genomic DNA
ttttctgtagccgtggagaatcaagcaaagtatacttcctccgttttgtccacatttcaaaaaattaaacggaagatgctgctg

SEQ ID NO: 18260 - DNA, 71 bp, Homo sapiens; identical to SEQ ID NO: 7139
  misc_feature 1..71: note = chr3:181421249-181421320
  misc_feature 1..71: note = hyper
  source 1..71: mol_type = genomic DNA

SEQ ID NO: 18261 - DNA, 190 bp, Homo sapiens
  misc_feature 1..190: note = chr3:181422985-181423175
  misc_feature 1..190: note = hyper
  source 1..190: mol_type = genomic DNA
attgggatgggtttggaaacccaactccatctgagccaggactggaagaggggcgctgggggcaagcagaagtgggcccctgggaaggccgacttctcaggcatttcttttgaggccggaatagcttttgggagagggttctagatgtcaatgggaggccttgaggatgccagcccgcccaggatgggtg

SEQ ID NO: 18262 - DNA, 38 bp, Homo sapiens
  misc_feature 1..38: note = chr3:181428772-181428810
  misc_feature 1..38: note = hyper
  source 1..38: mol_type = genomic DNA
ccagcccccatttgaaagccgcacgaccgaaacccttc

SEQ ID NO: 18263 - DNA, 318 bp, Homo sapiens
  misc_feature 1..318: note = chr3:181430771-181431089
  misc_feature 1..318: note = hyper
  source 1..318: mol_type = genomic DNA
ctccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccct

SEQ ID NO: 18264 - DNA, 112 bp, Homo sapiens
  misc_feature 1..112: note = chr3:181437349-181437461
  misc_feature 1..112: note = hyper
  source 1..112: mol_type = genomic DNA
atggggctccccaagaaggtgctgtgtggggctcgagttctctctgcccgggctctgctcaaacggtcgcattccctctccctcaggcaccgacccgcgtcagacaagtcta

SEQ ID NO: 18265 - DNA, 70 bp, Homo sapiens
  misc_feature 1..70: note = chr3:181438353-181438423
  misc_feature 1..70: note = hyper
  source 1..70: mol_type = genomic DNA
ccagctccatcaccactaccaagccccagtttgggaggctcccgaggcccctggccgccccccagacccc

SEQ ID NO: 18266 - DNA, 30 bp, Homo sapiens; identical to SEQ ID NO: 7147
  misc_feature 1..30: note = chr3:181440785-181440815
  misc_feature 1..30: note = hyper
  source 1..30: mol_type = genomic DNA

SEQ ID NO: 18267 - DNA, 183 bp, Homo sapiens
  misc_feature 1..183: note = chr3:181441962-181442145
  misc_feature 1..183: note = hyper
  source 1..183: mol_type = genomic DNA
ggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgc

SEQ ID NO: 18268 - DNA, 356 bp, Homo sapiens
  misc_feature 1..356: note = chr3:181445013-181445369
  misc_feature 1..356: note = hyper
  source 1..356: mol_type = genomic DNA
actcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctc

SEQ ID NO: 18269 - DNA, 15 bp, Homo sapiens
  misc_feature 1..15: note = chr3:181445710-181445725
  misc_feature 1..15: note = hyper
  source 1..15: mol_type = genomic DNA
cgtaacaccatcatc

SEQ ID NO: 18270 - DNA, 152 bp, Homo sapiens; identical to SEQ ID NO: 7158
  misc_feature 1..152: note = chr3:182896884-182897036
  misc_feature 1..152: note = hyper
  source 1..152: mol_type = genomic DNA

SEQ ID NO: 18271 - DNA, 30 bp, Homo sapiens; identical to SEQ ID NO: 7159
  misc_feature 1..30: note = chr3:182897285-182897315
  misc_feature 1..30: note = hyper
  source 1..30: mol_type = genomic DNA

SEQ ID NO: 18272 - DNA, 41 bp, Homo sapiens
  misc_feature 1..41: note = chr3:183145371-183145412
  misc_feature 1..41: note = hyper
  source 1..41: mol_type = genomic DNA
cacccaccctactcccgtcagaagcagctaacggatggtaa

SEQ ID NO: 18273 - DNA, 189 bp, Homo sapiens; identical to SEQ ID NO: 7161
  misc_feature 1..189: note = chr3:183980238-183980427
  misc_feature 1..189: note = hyper
  source 1..189: mol_type = genomic DNA

SEQ ID NO: 18274 - DNA, 98 bp, Homo sapiens; identical to SEQ ID NO: 7162
  misc_feature 1..98: note = chr3:184243116-184243214
  misc_feature 1..98: note = hyper
  source 1..98: mol_type = genomic DNA

SEQ ID NO: 18275 - DNA, 76 bp, Homo sapiens; identical to SEQ ID NO: 7163
  misc_feature 1..76: note = chr3:184301502-184301578
  misc_feature 1..76: note = hyper
  source 1..76: mol_type = genomic DNA

SEQ ID NO: 18276 - DNA, 182 bp, Homo sapiens; identical to SEQ ID NO: 7164
  misc_feature 1..182: note = chr3:184871097-184871279
  misc_feature 1..182: note = hyper
  source 1..182: mol_type = genomic DNA

SEQ ID NO: 18277 - skipped

SEQ ID NO: 18278 - DNA, 104 bp, Homo sapiens; identical to SEQ ID NO: 7167
  misc_feature 1..104: note = chr3:186079667-186079771
  misc_feature 1..104: note = hyper
  source 1..104: mol_type = genomic DNA

SEQ ID NO: 18279 - DNA, 26 bp, Homo sapiens
  misc_feature 1..26: note = chr3:186080162-186080188
  misc_feature 1..26: note = hyper
  source 1..26: mol_type = genomic DNA
ttccacacatgcacacgcgtgcgcac

SEQ ID NO: 18280 - DNA, 27 bp, Homo sapiens
  misc_feature 1..27: note = chr3:186080218-186080245
  misc_feature 1..27: note = hyper
  source 1..27: mol_type = genomic DNA
tgaccccctttggtgcaactagggcgc

SEQ ID NO: 18281 - DNA, 49 bp, Homo sapiens; identical to SEQ ID NO: 7169
  misc_feature 1..49: note = chr3:186080246-186080295
  misc_feature 1..49: note = hyper
  source 1..49: mol_type = genomic DNA

SEQ ID NO: 18282 - DNA, 56 bp, Homo sapiens
  misc_feature 1..56: note = chr3:186857096-186857152
  misc_feature 1..56: note = hyper
  source 1..56: mol_type = genomic DNA
aggtctgcgtgtcaccgacccgaacccgctccgtcgtcctgacgcccccggcctag

SEQ ID NO: 18283 - DNA, 65 bp, Homo sapiens
  misc_feature 1..65: note = chr3:186857607-186857672
  misc_feature 1..65: note = hyper
  source 1..65: mol_type = genomic DNA
ggaaccgccaatgcctccagggggcgctctccctcccatcgagccaccgccgggccattggagac

SEQ ID NO: 18284 - DNA, 59 bp, Homo sapiens
  misc_feature 1..59: note = chr3:187387791-187387850
  misc_feature 1..59: note = hyper
  source 1..59: mol_type = genomic DNA
ttttctcaagagcttcgggagctgagggacccagaaaagcaccaaaactctttagaagg

SEQ ID NO: 18285 - DNA, 118 bp, Homo sapiens; identical to SEQ ID NO: 7173
  misc_feature 1..118: note = chr3:187456159-187456277
  misc_feature 1..118: note = hyper
  source 1..118: mol_type = genomic DNA

SEQ ID NO: 18286 - DNA, 30 bp, Homo sapiens; identical to SEQ ID NO: 7174
  misc_feature 1..30: note = chr3:187456549-187456579
  misc_feature 1..30: note = hyper
  source 1..30: mol_type = genomic DNA

SEQ ID NO: 18287 - DNA, 30 bp, Homo sapiens; identical to SEQ ID NO: 7175
  misc_feature 1..30: note = chr3:189838630-189838660
  misc_feature 1..30: note = hyper
  source 1..30: mol_type = genomic DNA

SEQ ID NO: 18288 - DNA, 101 bp, Homo sapiens; identical to SEQ ID NO: 7176
  misc_feature 1..101: note = chr3:190580811-190580912
  misc_feature 1..101: note = hyper
  source 1..101: mol_type = genomic DNA

SEQ ID NO: 18289 - DNA, 97 bp, Homo sapiens
  misc_feature 1..97: note = chr3:192126863-192126960
  misc_feature 1..97: note = hyper
  source 1..97: mol_type = genomic DNA
gggggagggcgcgagggagggagggagatcctcgagggccaagcacccctcggggagaaaccagcgagaggcgatctgcggggtcccaagagtgggc

SEQ ID NO: 18290 - DNA, 49 bp, Homo sapiens; identical to SEQ ID NO: 346
  misc_feature 1..49: note = chr3:192126961-192127010
  misc_feature 1..49: note = hyper
  source 1..49: mol_type = genomic DNA

SEQ ID NO: 18291 - DNA, 40 bp, Homo sapiens
  misc_feature 1..40: note = chr3:192127314-192127354
  misc_feature 1..40: note = hyper
  source 1..40: mol_type = genomic DNA
atggggattacccgccggacgcaaggccgatcactcagtc

SEQ ID NO: 18292 - DNA, 20 bp, Homo sapiens
  misc_feature 1..20: note = chr3:192232057-192232077
  misc_feature 1..20: note = hyper
  source 1..20: mol_type = genomic DNA
ccctctcctgtggaacgcac

SEQ ID NO: 18293 - DNA, 13 bp, Homo sapiens
  misc_feature 1..13: note = chr3:192232078-192232091
  misc_feature 1..13: note = hyper
  source 1..13: mol_type = genomic DNA
agcaacttttcgg

SEQ ID NO: 18294 - DNA, 21 bp, Homo sapiens
  misc_feature 1..21: note = chr3:192232798-192232819
  misc_feature 1..21: note = hyper
  source 1..21: mol_type = genomic DNA
ccccttgagaccttccggagg

SEQ ID NO: 18295 - DNA, 67 bp, Homo sapiens
  misc_feature 1..67: note = chr3:192233150-192233217
  misc_feature 1..67: note = hyper
  source 1..67: mol_type = genomic DNA
agggggtggggtagggaggcggggacgtggaataaagaaagctcctgggtgccggctatgagaagtc

SEQ ID NO: 18296 - DNA, 13 bp, Homo sapiens
  misc_feature 1..13: note = chr3:193776076-193776089
  misc_feature 1..13: note = hyper
  source 1..13: mol_type = genomic DNA
cggttcctctgca

SEQ ID NO: 18297 - DNA, 60 bp, Homo sapiens
  misc_feature 1..60: note = chr3:193776119-193776179
  misc_feature 1..60: note = hyper
  source 1..60: mol_type = genomic DNA
cgggaagcgaaagctgcggcgacctcccagagcctctcaggcacgcggcatctctcccca

SEQ ID NO: 18298 - skipped

SEQ ID NO: 18299 - DNA, 37 bp, Homo sapiens
  misc_feature 1..37: note = chr3:194409021-194409058
  misc_feature 1..37: note = hyper
  source 1..37: mol_type = genomic DNA
ggctctgttgcgcgtggggatgcggggagatttgaga

SEQ ID NO: 18300 - DNA, 60 bp, Homo sapiens; identical to SEQ ID NO: 7194
  misc_feature 1..60: note = chr3:196366801-196366861
  misc_feature 1..60: note = hyper
  source 1..60: mol_type = genomic DNA

SEQ ID NO: 18301 - DNA, 102 bp, Homo sapiens; identical to SEQ ID NO: 7195
  misc_feature 1..102: note = chr3:197840446-197840548
  misc_feature 1..102: note = hyper
  source 1..102: mol_type = genomic DNA

SEQ ID NO: 18302 - DNA, 15 bp, Homo sapiens
  misc_feature 1..15: note = chr4:570242-570257
  misc_feature 1..15: note = hyper
  source 1..15: mol_type = genomic DNA
ttcctcctcccggag

SEQ ID NO: 18303 - DNA, 203 bp, Homo sapiens; identical to SEQ ID NO: 7201
  misc_feature 1..203: note = chr4:570298-570501
  misc_feature 1..203: note = hyper
  source 1..203: mol_type = genomic DNA

SEQ ID NO: 18304 - DNA, 130 bp, Homo sapiens
  misc_feature 1..130: note = chr4:570836-570966
  misc_feature 1..130: note = hyper
  source 1..130: mol_type = genomic DNA
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgag

SEQ ID NO: 18305 - DNA, 495 bp, Homo sapiens
  misc_feature 1..495: note = chr4:571013-571508
  misc_feature 1..495: note = hyper
  source 1..495: mol_type = genomic DNA
ccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgca

SEQ ID NO: 18306 - DNA, 44 bp, Homo sapiens; identical to SEQ ID NO: 7203
  misc_feature 1..44: note = chr4:788891-788935
  misc_feature 1..44: note = hyper
  source 1..44: mol_type = genomic DNA

SEQ ID NO: 18307 - DNA, 102 bp, Homo sapiens; identical to SEQ ID NO: 7204
  misc_feature 1..102: note = chr4:789169-789271
  misc_feature 1..102: note = hyper
  source 1..102: mol_type = genomic DNA

SEQ ID NO: 18308 - DNA, 44 bp, Homo sapiens; identical to SEQ ID NO: 7207
  misc_feature 1..44: note = chr4:996495-996539
  misc_feature 1..44: note = hyper
  source 1..44: mol_type = genomic DNA

SEQ ID NO: 18309 - DNA, 139 bp, Homo sapiens; identical to SEQ ID NO: 7209
  misc_feature 1..139: note = chr4:1166167-1166306
  misc_feature 1..139: note = hyper
  source 1..139: mol_type = genomic DNA

SEQ ID NO: 18310 - DNA, 26 bp, Homo sapiens
  misc_feature 1..26: note = chr4:1398277-1398303
  misc_feature 1..26: note = hyper
  source 1..26: mol_type = genomic DNA
gggtagggccctgctcggcctcacca

SEQ ID NO: 18311 - DNA, 72 bp, Homo sapiens; identical to SEQ ID NO: 7212
  misc_feature 1..72: note = chr4:1399065-1399137
  misc_feature 1..72: note = hyper
  source 1..72: mol_type = genomic DNA

SEQ ID NO: 18312 - DNA, 92 bp, Homo sapiens; identical to SEQ ID NO: 7213
  misc_feature 1..92: note = chr4:1400248-1400340
  misc_feature 1..92: note = hyper
  source 1..92: mol_type = genomic DNA

SEQ ID NO: 18313 - DNA, 372 bp, Homo sapiens; identical to SEQ ID NO: 7214
  misc_feature 1..372: note = chr4:1401106-1401478
  misc_feature 1..372: note = hyper
  source 1..372: mol_type = genomic DNA

SEQ ID NO: 18314 - DNA, 28 bp, Homo sapiens
  misc_feature 1..28: note = chr4:1401683-1401711
  misc_feature 1..28: note = hyper
  source 1..28: mol_type = genomic DNA
ccccggagcctgttccgcgcgcagggcg

SEQ ID NO: 18315 - DNA, 81 bp, Homo sapiens
  misc_feature 1..81: note = chr4:1401743-1401824
  misc_feature 1..81: note = hyper
  source 1..81: mol_type = genomic DNA
tggaagcagaaattaaaagttgggagaaataatggtggaccgatcggctgtaatttgggccaagctcggacacgctgagcc

SEQ ID NO: 18316 - DNA, 30 bp, Homo sapiens; identical to SEQ ID NO: 7216
  misc_feature 1..30: note = chr4:1404132-1404162
  misc_feature 1..30: note = hyper
  source 1..30: mol_type = genomic DNA

SEQ ID NO: 18317 - DNA, 99 bp, Homo sapiens; identical to SEQ ID NO: 7217
  misc_feature 1..99: note = chr4:1404368-1404467
  misc_feature 1..99: note = hyper
  source 1..99: mol_type = genomic DNA

SEQ ID NO: 18318 - DNA, 68 bp, Homo sapiens; identical to SEQ ID NO: 7218
  misc_feature 1..68: note = chr4:1408020-1408088
  misc_feature 1..68: note = hyper
  source 1..68: mol_type = genomic DNA

SEQ ID NO: 18319 - DNA, 42 bp, Homo sapiens; identical to SEQ ID NO: 7219
  misc_feature 1..42: note = chr4:1811789-1811831
  misc_feature 1..42: note = hyper
  source 1..42: mol_type = genomic DNA

SEQ ID NO: 18320 - DNA, 14 bp, Homo sapiens
  misc_feature 1..14: note = chr4:2042655-2042669
  misc_feature 1..14: note = hyper
  source 1..14: mol_type = genomic DNA
gcagtcccagcttg

SEQ ID NO: 18321 - DNA, 43 bp, Homo sapiens; identical to SEQ ID NO: 7223
  misc_feature 1..43: note = chr4:2060112-2060155
  misc_feature 1..43: note = hyper
  source 1..43: mol_type = genomic DNA

SEQ ID NO: 18322 - DNA, 41 bp, Homo sapiens; identical to SEQ ID NO: 7224
  misc_feature 1..41: note = chr4:2060173-2060214
  misc_feature 1..41: note = hyper
  source 1..41: mol_type = genomic DNA

SEQ ID NO: 18323 - DNA, 82 bp, Homo sapiens; identical to SEQ ID NO: 7225
  misc_feature 1..82: note = chr4:2062004-2062086
  misc_feature 1..82: note = hyper
  source 1..82: mol_type = genomic DNA

SEQ ID NO: 18324 - DNA, 84 bp, Homo sapiens
  misc_feature 1..84: note = chr4:2765778-2765862
  misc_feature 1..84: note = hyper
  source 1..84: mol_type = genomic DNA
tggtatgggaccctccgggtgggcgcggccccgcggggccttgcggccacaccgccaccgtgcccagcggccccatcagcgcat

SEQ ID NO: 18325 - DNA, 42 bp, Homo sapiens
  misc_feature 1..42: note = chr4:2765910-2765952
  misc_feature 1..42: note = hyper
  source 1..42: mol_type = genomic DNA
tgatgaaagctcgaatcttataggatccgtattcatttcccg

SEQ ID NO: 18326 - DNA, 42 bp, Homo sapiens; identical to SEQ ID NO: 7227
  misc_feature 1..42: note = chr4:2766173-2766215
  misc_feature 1..42: note = hyper
  source 1..42: mol_type = genomic DNA

SEQ ID NO: 18327 - DNA, 30 bp, Homo sapiens; identical to SEQ ID NO: 7228
  misc_feature 1..30: note = chr4:3767309-3767339
  misc_feature 1..30: note = hyper
  source 1..30: mol_type = genomic DNA

SEQ ID NO: 18328 - DNA, 45 bp, Homo sapiens; identical to SEQ ID NO: 7229
  misc_feature 1..45: note = chr4:3767848-3767893
  misc_feature 1..45: note = hyper
  source 1..45: mol_type = genomic DNA

SEQ ID NO: 18329 - DNA, 611 bp, Homo sapiens
  misc_feature 1..611: note = chr4:3873083-3873694
  misc_feature 1..611: note = hyper
  source 1..611: mol_type = genomic DNA
actggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccc

SEQ ID NO: 18330 - DNA, 50 bp, Homo sapiens; identical to SEQ ID NO: 7232
  misc_feature 1..50: note = chr4:3882155-3882205
  misc_feature 1..50: note = hyper
  source 1..50: mol_type = genomic DNA

SEQ ID NO: 18331 - DNA, 15 bp, Homo sapiens
  misc_feature 1..15: note = chr4:4145386-4145401
  misc_feature 1..15: note = hyper
  source 1..15: mol_type = genomic DNA
cgggatgtggggcta

SEQ ID NO: 18332 - DNA, 84 bp, Homo sapiens; identical to SEQ ID NO: 7234
  misc_feature 1..84: note = chr4:4228084-4228168
  misc_feature 1..84: note = hyper
  source 1..84: mol_type = genomic DNA

SEQ ID NO: 18333 - DNA, 34 bp, Homo sapiens
  misc_feature 1..34: note = chr4:4228241-4228275
  misc_feature 1..34: note = hyper
  source 1..34: mol_type = genomic DNA
tgcgcggagctgcggcccacgtaccacagcatcc

SEQ ID NO: 18334 - skipped

SEQ ID NO: 18335 - DNA, 19 bp, Homo sapiens
  misc_feature 1..19: note = chr4:4387627-4387646
  misc_feature 1..19: note = hyper
  source 1..19: mol_type = genomic DNA
gccgcggggaagtccccgg

SEQ ID NO: 18336 - DNA, 578 bp, Homo sapiens; identical to SEQ ID NO: 7238
  misc_feature 1..578: note = chr4:4387927-4388505
  misc_feature 1..578: note = hyper
  source 1..578: mol_type = genomic DNA

SEQ ID NO: 18337 - DNA, 50 bp, Homo sapiens; identical to SEQ ID NO: 7239
  misc_feature 1..50: note = chr4:4388506-4388556
  misc_feature 1..50: note = hyper
  source 1..50: mol_type = genomic DNA

SEQ ID NO: 18338 - DNA, 46 bp, Homo sapiens; identical to SEQ ID NO: 7240
  misc_feature 1..46: note = chr4:4388772-4388818
  misc_feature 1..46: note = hyper
  source 1..46: mol_type = genomic DNA

SEQ ID NO: 18339 - DNA, 82 bp, Homo sapiens; identical to SEQ ID NO: 7241
  misc_feature 1..82: note = chr4:4854669-4854751
  misc_feature 1..82: note = hyper
  source 1..82: mol_type = genomic DNA

SEQ ID NO: 18340 - DNA, 148 bp, Homo sapiens
  misc_feature 1..148: note = chr4:4854954-4855102
  misc_feature 1..148: note = hyper
  source 1..148: mol_type = genomic DNA
agagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactccc

SEQ ID NO: 18341 - DNA, 21 bp, Homo sapiens
  misc_feature 1..21: note = chr4:4855171-4855192
  misc_feature 1..21: note = hyper
  source 1..21: mol_type = genomic DNA
gctgcccccgcgaaggtgggg

SEQ ID NO: 18342 - DNA, 44 bp, Homo sapiens; identical to SEQ ID NO: 7243
  misc_feature 1..44: note = chr4:4858727-4858771
  misc_feature 1..44: note = hyper
  source 1..44: mol_type = genomic DNA

SEQ ID NO: 18343 - DNA, 259 bp, Homo sapiens; identical to SEQ ID NO: 7244
  misc_feature 1..259: note = chr4:4862186-4862445
  misc_feature 1..259: note = hyper
  source 1..259: mol_type = genomic DNA

SEQ ID NO: 18344 - DNA, 107 bp, Homo sapiens
  misc_feature 1..107: note = chr4:4867591-4867698
  misc_feature 1..107: note = hyper
  source 1..107: mol_type = genomic DNA
agagcaacataattgcggtaatgagcaacggctcaccctctgcagacgcgtcgcggctccagcgaggcggtagctgcaggcgaggcgggcgcgcctccccgccccct

SEQ ID NO: 18345 - DNA, 30 bp, Homo sapiens; identical to SEQ ID NO: 7247
  misc_feature 1..30: note = chr4:4868050-4868080
  misc_feature 1..30: note = hyper
  source 1..30: mol_type = genomic DNA

SEQ ID NO: 18346 - DNA, 11 bp, Homo sapiens
  misc_feature 1..11: note = chr4:4868555-4868566
  misc_feature 1..11: note = hyper
  source 1..11: mol_type = genomic DNA
ctcaccggccc

SEQ ID NO: 18347 - DNA, 127 bp, Homo sapiens; identical to SEQ ID NO: 2364
  misc_feature 1..127: note = chr4:4869131-4869258
  misc_feature 1..127: note = hyper
  source 1..127: mol_type = genomic DNA

SEQ ID NO: 18348 - DNA, 30 bp, Homo sapiens; identical to SEQ ID NO: 7251
  misc_feature 1..30: note = chr4:4870173-4870203
  misc_feature 1..30: note = hyper
  source 1..30: mol_type = genomic DNA

SEQ ID NO: 18349 - DNA, 15 bp, Homo sapiens
  misc_feature 1..15: note = chr4:4872017-4872032
  misc_feature 1..15: note = hyper
  source 1..15: mol_type = genomic DNA
gggtgagaaggggag

SEQ ID NO: 18350 - DNA, 29 bp, Homo sapiens
  misc_feature 1..29: note = chr4:4872059-4872088
  misc_feature 1..29: note = hyper
  source 1..29: mol_type = genomic DNA
cggagcatagaggcaggatggtgacctga

SEQ ID NO: 18351 - DNA, 140 bp, Homo sapiens
  misc_feature 1..140: note = chr4:5052930-5053070
  misc_feature 1..140: note = hyper
  source 1..140: mol_type = genomic DNA
gacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgc

SEQ ID NO: 18352 - DNA, 229 bp, Homo sapiens
  misc_feature 1..229: note = chr4:5053518-5053747
  misc_feature 1..229: note = hyper
  source 1..229: mol_type = genomic DNA
ctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacc

SEQ ID NO: 18353 - DNA, 12 bp, Homo sapiens
  misc_feature 1..12: note = chr4:5054093-5054105
  misc_feature 1..12: note = hyper
  source 1..12: mol_type = genomic DNA
gcaagggcctgt

SEQ ID NO: 18354 - DNA, 194 bp, Homo sapiens; identical to SEQ ID NO: 7257
  misc_feature 1..194: note = chr4:5889144-5889338
  misc_feature 1..194: note = hyper
  source 1..194: mol_type = genomic DNA

SEQ ID NO: 18355 - DNA, 403 bp, Homo sapiens
  misc_feature 1..403: note = chr4:5889545-5889948
  misc_feature 1..403: note = hyper
  source 1..403: mol_type = genomic DNA
ggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggcc

SEQ ID NO: 18356 - DNA, 229 bp, Homo sapiens
  misc_feature 1..229: note = chr4:5890045-5890274
  misc_feature 1..229: note = hyper
  source 1..229: mol_type = genomic DNA
ggaaccggcgctctcggccccgctcccagcgggcgcgctgacaaaggcccgggagggatagagacacggacggaggctcggcgcccgtggatgcccacgcgcggctgccccggctgctcggcccgcccgccgccgctccggctgccagcaccgcccggatcggcgaggagggcgggagaaggaggagggagaggcgagggcgggaggagggggctgcagacagctcctc

SEQ ID NO: 18357 - DNA, 30 bp, Homo sapiens; identical to SEQ ID NO: 7259
  misc_feature 1..30: note = chr4:5890534-5890564
  misc_feature 1..30: note = hyper
  source 1..30: mol_type = genomic DNA

SEQ ID NO: 18358 - DNA, 234 bp, Homo sapiens; identical to SEQ ID NO: 7262
  misc_feature 1..234: note = chr4:5893517-5893751
  misc_feature 1..234: note = hyper
  source 1..234: mol_type = genomic DNA

SEQ ID NO: 18359 - DNA, 52 bp, Homo sapiens; identical to SEQ ID NO: 7263
  misc_feature 1..52: note = chr4:5894812-5894864
  misc_feature 1..52: note = hyper
  source 1..52: mol_type = genomic DNA

SEQ ID NO: 18360 - DNA, 19 bp, Homo sapiens
  misc_feature 1..19: note = chr4:6200878-6200897
  misc_feature 1..19: note = hyper
  source 1..19: mol_type = genomic DNA
aggacagtgtgcctgcgag

SEQ ID NO: 18361 - DNA, 58 bp, Homo sapiens
  misc_feature 1..58: note = chr4:6201235-6201293
  misc_feature 1..58: note = hyper
  source 1..58: mol_type = genomic DNA
caccacgagagtcaatccttgcgcgccatctccggaggccagtgcgcccagggcgcgc

SEQ ID NO: 18362 - DNA, 138 bp, Homo sapiens; identical to SEQ ID NO: 7265
  misc_feature 1..138: note = chr4:6201349-6201487
  misc_feature 1..138: note = hyper
  source 1..138: mol_type = genomic DNA

SEQ ID NO: 18363 - DNA, 208 bp, Homo sapiens
  misc_feature 1..208: note = chr4:6201895-6202103
  misc_feature 1..208: note = hyper
  source 1..208: mol_type = genomic DNA
gccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgcc

SEQ ID NO: 18364 - DNA, 264 bp, Homo sapiens
  misc_feature 1..264: note = chr4:6202276-6202540
  misc_feature 1..264: note = hyper
  source 1..264: mol_type = genomic DNA
gcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgc

SEQ ID NO: 18365 - DNA, 336 bp, Homo sapiens
  misc_feature 1..336: note = chr4:6247381-6247717
  misc_feature 1..336: note = hyper
  source 1..336: mol_type = genomic DNA
cttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 18366 - DNA, 30 bp, Homo sapiens; identical to SEQ ID NO: 7268
  misc_feature 1..30: note = chr4:6473934-6473964
  misc_feature 1..30: note = hyper
  source 1..30: mol_type = genomic DNA

SEQ ID NO: 18367 - DNA, 277 bp, Homo sapiens; identical to SEQ ID NO: 7269
  misc_feature 1..277: note = chr4:6473965-6474242
  misc_feature 1..277: note = hyper
  source 1..277: mol_type = genomic DNA

SEQ ID NO: 18368 - skipped

SEQ ID NO: 18369 - DNA, 101 bp, Homo sapiens; identical to SEQ ID NO: 7271
  misc_feature 1..101: note = chr4:7194437-7194538
  misc_feature 1..101: note = hyper
  source 1..101: mol_type = genomic DNA

SEQ ID NO: 18370 - DNA, 30 bp, Homo sapiens; identical to SEQ ID NO: 7272
  misc_feature 1..30: note = chr4:7195153-7195183
  misc_feature 1..30: note = hyper
  source 1..30: mol_type = genomic DNA

SEQ ID NO: 18371 - DNA, 38 bp, Homo sapiens; identical to SEQ ID NO: 7273
  misc_feature 1..38: note = chr4:8271520-8271558
  misc_feature 1..38: note = hyper
  source 1..38: mol_type = genomic DNA

SEQ ID NO: 18372 - DNA, 69 bp, Homo sapiens
  misc_feature 1..69: note = chr4:8858758-8858827
  misc_feature 1..69: note = hyper
  source 1..69: mol_type = genomic DNA
ctgatcgcgacactgcactccagcctgggcgacacagcggaccatctcaataacaaaccgaaactctgg

SEQ ID NO: 18373 - DNA, 200 bp, Homo sapiens
  misc_feature 1..200: note = chr4:8859738-8859938
  misc_feature 1..200: note = hyper
  source 1..200: mol_type = genomic DNA
agcatcagctaagccattagggctaatgcgatgtactgtaagacggggatcaatgccgggcctcggggaccggcgtgggggagggggcagcaggccgaccgcccccaagccggtcgaggcccccgtccatttgggggaaatggattttcgcgatttaagaaacaaacccaaatcaaatgagcgaggcccggatgtgctga

SEQ ID NO: 18374 - DNA, 393 bp, Homo sapiens
  misc_feature 1..393: note = chr4:8862404-8862797
  misc_feature 1..393: note = hyper
  source 1..393: mol_type = genomic DNA
ccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcg

SEQ ID NO: 18375 - DNA, 69 bp, Homo sapiens
  misc_feature 1..69: note = chr4:8863372-8863441
  misc_feature 1..69: note = hyper
  source 1..69: mol_type = genomic DNA
cgccaggcgccttcccgggcggttggcgaaacccgaggaggcccacagctctggcctggggcgccgtcg

SEQ ID NO: 18376 - DNA, 106 bp, Homo sapiens; identical to SEQ ID NO: 7282
  misc_feature 1..106: note = chr4:8868710-8868816
  misc_feature 1..106: note = hyper
  source 1..106: mol_type = genomic DNA

SEQ ID NO: 18377 - DNA, 233 bp, Homo sapiens
  misc_feature 1..233: note = chr4:8869368-8869601
  misc_feature 1..233: note = hyper
  source 1..233: mol_type = genomic DNA
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggct

SEQ ID NO: 18378 - DNA, 30 bp, Homo sapiens; identical to SEQ ID NO: 7285
  misc_feature 1..30: note = chr4:8872946-8872976
  misc_feature 1..30: note = hyper
  source 1..30: mol_type = genomic DNA

SEQ ID NO: 18379 - DNA, 36 bp, Homo sapiens
  misc_feature 1..36: note = chr4:8873773-8873809
  misc_feature 1..36: note = hyper
  source 1..36: mol_type = genomic DNA
gggcgcaggcggggggtcgcgccgggtccgatcccg

SEQ ID NO: 18380 - skipped

SEQ ID NO: 18381 - DNA, 104 bp, Homo sapiens
  misc_feature 1..104: note = chr4:8875773-8875877
  misc_feature 1..104: note = hyper
  source 1..104: mol_type = genomic DNA
ggtggtggccctgagcgcataacgctcgcgggtgtcttcccactgcctctggggggcgcgcatgagaggggcgcttccacacactgccgcgtggggcctgggat

SEQ ID NO: 18382 - DNA, 76 bp, Homo sapiens; identical to SEQ ID NO: 7289
  misc_feature 1..76: note = chr4:8878569-8878645
  misc_feature 1..76: note = hyper
  source 1..76: mol_type = genomic DNA

SEQ ID NO: 18383 - DNA, 60 bp, Homo sapiens; identical to SEQ ID NO: 7290
  misc_feature 1..60: note = chr4:8879491-8879551
  misc_feature 1..60: note = hyper
  source 1..60: mol_type = genomic DNA

SEQ ID NO: 18384 - DNA, 41 bp, Homo sapiens; identical to SEQ ID NO: 7291
  misc_feature 1..41: note = chr4:8893958-8893999
  misc_feature 1..41: note = hyper
  source 1..41: mol_type = genomic DNA

SEQ ID NO: 18385 - DNA, 46 bp, Homo sapiens
  misc_feature 1..46: note = chr4:8896052-8896098
  misc_feature 1..46: note = hyper
  source 1..46: mol_type = genomic DNA
ggattatctcccctctcccaccaggccccggcggggggcaccaact

SEQ ID NO: 18386 - DNA, 205 bp, Homo sapiens; identical to SEQ ID NO: 2376
  misc_feature 1..205: note = chr4:8896117-8896322
  misc_feature 1..205: note = hyper
  source 1..205: mol_type = genomic DNA

SEQ ID NO: 18387 - DNA, 58 bp, Homo sapiens
  misc_feature 1..58: note = chr4:10462775-10462833
  misc_feature 1..58: note = hyper
  source 1..58: mol_type = genomic DNA
tgccagtctctgagacgttttctcaactgcaaaacaggagtaactggagcaacctttc

SEQ ID NO: 18388 - DNA, 51 bp, Homo sapiens; identical to SEQ ID NO: 7300
  misc_feature 1..51: note = chr4:11429636-11429687
  misc_feature 1..51: note = hyper
  source 1..51: mol_type = genomic DNA

SEQ ID NO: 18389 - DNA, 30 bp, Homo sapiens; identical to SEQ ID NO: 7301
  misc_feature 1..30: note = chr4:13523948-13523978
  misc_feature 1..30: note = hyper
  source 1..30: mol_type = genomic DNA

SEQ ID NO: 18390 - DNA, 54 bp, Homo sapiens
  misc_feature 1..54: note = chr4:13537688-13537742
  misc_feature 1..54: note = hyper
  source 1..54: mol_type = genomic DNA
cgagcaggggcatggagtgggagggaaagctgaggagagcgggctttgagcctg

SEQ ID NO: 18391 - DNA, 83 bp, Homo sapiens; identical to SEQ ID NO: 357
  misc_feature 1..83: note = chr4:13545940-13546023
  misc_feature 1..83: note = hyper
  source 1..83: mol_type = genomic DNA

SEQ ID NO: 18392 - DNA, 86 bp, Homo sapiens; identical to SEQ ID NO: 7305
  misc_feature 1..86: note = chr4:13546466-13546552
  misc_feature 1..86: note = hyper
  source 1..86: mol_type = genomic DNA

SEQ ID NO: 18393 - DNA, 67 bp, Homo sapiens
  misc_feature 1..67: note = chr4:13548895-13548962
  misc_feature 1..67: note = hyper
  source 1..67: mol_type = genomic DNA
ctggacgcgaccgcgcgggcgtgcctgggtcccgcttcctgcccatcgagggcgacttccttcgggc

SEQ ID NO: 18394 - DNA, 30 bp, Homo sapiens; identical to SEQ ID NO: 7308
  misc_feature 1..30: note = chr4:13549282-13549312
  misc_feature 1..30: note = hyper
  source 1..30: mol_type = genomic DNA

SEQ ID NO: 18395 - DNA, 89 bp, Homo sapiens; identical to SEQ ID NO: 7309
  misc_feature 1..89: note = chr4:13549546-13549635
  misc_feature 1..89: note = hyper
  source 1..89: mol_type = genomic DNA

SEQ ID NO: 18396 - DNA, 132 bp, Homo sapiens
  misc_feature 1..132: note = chr4:15780320-15780452
  misc_feature 1..132: note = hyper
  source 1..132: mol_type = genomic DNA
cccgcgcgcagggaagccgcccggatcgcccggaaccgggcatcttccgtggcgggtcagccgagagcccgccgggtggtgctgagtagggagtcccgggctcggggctccgcgggccgctttcaggagcag

SEQ ID NO: 18397 - DNA, 30 bp, Homo sapiens; identical to SEQ ID NO: 7311
  misc_feature 1..30: note = chr4:16083935-16083965
  misc_feature 1..30: note = hyper
  source 1..30: mol_type = genomic DNA

SEQ ID NO: 18398 - DNA, 60 bp, Homo sapiens; identical to SEQ ID NO: 7312
  misc_feature 1..60: note = chr4:16084408-16084468
  misc_feature 1..60: note = hyper
  source 1..60: mol_type = genomic DNA

SEQ ID NO: 18399 - DNA, 18 bp, Homo sapiens
  misc_feature 1..18: note = chr4:16085381-16085399
  misc_feature 1..18: note = hyper
  source 1..18: mol_type = genomic DNA
acccggcttctgggacca

SEQ ID NO: 18400 - DNA, 18 bp, Homo sapiens
  misc_feature 1..18: note = chr4:16085682-16085700
  misc_feature 1..18: note = hyper
  source 1..18: mol_type = genomic DNA
ggacgcactctgattgga

SEQ ID NO: 18401 - DNA, 30 bp, Homo sapiens; identical to SEQ ID NO: 7321
  misc_feature 1..30: note = chr4:20253853-20253883
  misc_feature 1..30: note = hyper
  source 1..30: mol_type = genomic DNA

SEQ ID NO: 18402 - DNA, 40 bp, Homo sapiens; identical to SEQ ID NO: 7322
  misc_feature 1..40: note = chr4:20254263-20254303
  misc_feature 1..40: note = hyper
  source 1..40: mol_type = genomic DNA

SEQ ID NO: 18403 - DNA, 51 bp, Homo sapiens; identical to SEQ ID NO: 7323
  misc_feature 1..51: note = chr4:20255045-20255096
  misc_feature 1..51: note = hyper
  source 1..51: mol_type = genomic DNA

SEQ ID NO: 18404 - DNA, 291 bp, Homo sapiens
  misc_feature 1..291: note = chr4:20255861-20256152
  misc_feature 1..291: note = hyper
  source 1..291: mol_type = genomic DNA
agctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggg

SEQ ID NO: 18405 - DNA, 28 bp, Homo sapiens
  misc_feature 1..28: note = chr4:20256841-20256869
  misc_feature 1..28: note = hyper
  source 1..28: mol_type = genomic DNA
gctctgacccgcacgtctccacccgcgc

SEQ ID NO: 18406 - DNA, 122 bp, Homo sapiens; identical to SEQ ID NO: 7327
  misc_feature 1..122: note = chr4:30720054-30720176
  misc_feature 1..122: note = hyper
  source 1..122: mol_type = genomic DNA

SEQ ID NO: 18407 - DNA, 81 bp, Homo sapiens
  misc_feature 1..81: note = chr4:30724372-30724453
  misc_feature 1..81: note = hyper
  source 1..81: mol_type = genomic DNA
tctggtgcaggtgtccgaccgagaccaaggcgagaacggggtggtcacctgcaccgtggtgggcgacgtgcccttccagct

SEQ ID NO: 18408 - DNA, 45 bp, Homo sapiens; identical to SEQ ID NO: 2391
  misc_feature 1..45: note = chr4:37245537-37245582
  misc_feature 1..45: note = hyper
  source 1..45: mol_type = genomic DNA

SEQ ID NO: 18409 - DNA, 283 bp, Homo sapiens
  misc_feature 1..283: note = chr4:37245851-37246134
  misc_feature 1..283: note = hyper
  source 1..283: mol_type = genomic DNA
ggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggag

SEQ ID NO: 18410 - DNA, 81 bp, Homo sapiens
  misc_feature 1..81: note = chr4:37247015-37247096
  misc_feature 1..81: note = hyper
  source 1..81: mol_type = genomic DNA
gctggccggttttgcctgcacacttctattaggacacccattctccaccccgggttattcccctgggtcaatccaagaaac

SEQ ID NO: 18411 - DNA, 37 bp, Homo sapiens; identical to SEQ ID NO: 7333
  misc_feature 1..37: note = chr4:37247355-37247392
  misc_feature 1..37: note = hyper
  source 1..37: mol_type = genomic DNA

SEQ ID NO: 18412 - DNA, 80 bp, Homo sapiens; identical to SEQ ID NO: 7334
  misc_feature 1..80: note = chr4:39047287-39047367
  misc_feature 1..80: note = hyper
  source 1..80: mol_type = genomic DNA

SEQ ID NO: 18413 - DNA, 290 bp, Homo sapiens
  misc_feature 1..290: note = chr4:41259176-41259466
  misc_feature 1..290: note = hyper
  source 1..290: mol_type = genomic DNA
cccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgt

SEQ ID NO: 18414 - DNA, 176 bp, Homo sapiens
  misc_feature 1..176: note = chr4:41746833-41747009
  misc_feature 1..176: note = hyper
  source 1..176: mol_type = genomic DNA
tgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatgg

SEQ ID NO: 18415 - DNA, 103 bp, Homo sapiens
  misc_feature 1..103: note = chr4:41747133-41747236
  misc_feature 1..103: note = hyper
  source 1..103: mol_type = genomic DNA
ctggaacggcgtccctactcttccctgaagaagagccccaagagaatccgtgctgttaggagggagcggatttaggggttcacaagatcgagccttcagctcc

SEQ ID NO: 18416 - DNA, 70 bp, Homo sapiens
  misc_feature 1..70: note = chr4:41747888-41747958
  misc_feature 1..70: note = hyper
  source 1..70: mol_type = genomic DNA
cgctggcgaagggacccccaagcgaatccgggatggaggtgatggggccggggccgggagcccagccttg

SEQ ID NO: 18417 - DNA, 41 bp, Homo sapiens
  misc_feature 1..41: note = chr4:41748296-41748337
  misc_feature 1..41: note = hyper
  source 1..41: mol_type = genomic DNA
gctcctgcttgcgaaacttggcgcggcggttctggaaccac

SEQ ID NO: 18418 - DNA, 95 bp, Homo sapiens
  misc_feature 1..95: note = chr4:41750504-41750599
  misc_feature 1..95: note = hyper
  source 1..95: mol_type = genomic DNA
gccactggcctggctgcaggaactgaagtcagcataggctgaagccaggctcgaggtgtccatcccagccatacaggactcgtaggcagaggaat

SEQ ID NO: 18419 - DNA, 14 bp, Homo sapiens
  misc_feature 1..14: note = chr4:41752954-41752968
  misc_feature 1..14: note = hyper
  source 1..14: mol_type = genomic DNA
gcacaaggctgaga

SEQ ID NO: 18420 - DNA, 212 bp, Homo sapiens
  misc_feature 1..212: note = chr4:41753398-41753610
  misc_feature 1..212: note = hyper
  source 1..212: mol_type = genomic DNA
gctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcagg

SEQ ID NO: 18421 - DNA, 32 bp, Homo sapiens; identical to SEQ ID NO: 7347
  misc_feature 1..32: note = chr4:41867804-41867836
  misc_feature 1..32: note = hyper
  source 1..32: mol_type = genomic DNA

SEQ ID NO: 18422 - DNA, 20 bp, Homo sapiens
  misc_feature 1..20: note = chr4:41875410-41875430
  misc_feature 1..20: note = hyper
  source 1..20: mol_type = genomic DNA
aaccttttttgtaaccggct

SEQ ID NO: 18423 - skipped

SEQ ID NO: 18424 - DNA, 156 bp, Homo sapiens
  misc_feature 1..156: note = chr4:41882935-41883091
  misc_feature 1..156: note = hyper
  source 1..156: mol_type = genomic DNA
gggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaag

SEQ ID NO: 18425 - DNA, 208 bp, Homo sapiens
  misc_feature 1..208: note = chr4:41883302-41883510
  misc_feature 1..208: note = hyper
  source 1..208: mol_type = genomic DNA
tttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgat

SEQ ID NO: 18426 - DNA, 14 bp, Homo sapiens
  misc_feature 1..14: note = chr4:41883610-41883624
  misc_feature 1..14: note = hyper
  source 1..14: mol_type = genomic DNA
gctcacccgccccg

SEQ ID NO: 18427 - DNA, 60 bp, Homo sapiens; identical to SEQ ID NO: 7351
  misc_feature 1..60: note = chr4:41883886-41883946
  misc_feature 1..60: note = hyper
  source 1..60: mol_type = genomic DNA

SEQ ID NO: 18428 - DNA, 82 bp, Homo sapiens; identical to SEQ ID NO: 7352
  misc_feature 1..82: note = chr4:41884164-41884246
  misc_feature 1..82: note = hyper
  source 1..82: mol_type = genomic DNA

SEQ ID NO: 18429 - DNA, 255 bp, Homo sapiens
  misc_feature 1..255: note = chr4:42154025-42154280
  misc_feature 1..255: note = hyper
  source 1..255: mol_type = genomic DNA
ggtgggtcgctcgtagcgcttggccagcgccggtctcttgctggggaacgtcttgaggacgctgtaggggctgcgctgcttgtagattttggggacgctgggcccctcctctgccggctgcatctcttcctccatccggcgcctcggggccggtccctcggagcacgtcccctccccgccgggcgccgggctccgagggtgcctccgccgcctgcccgccgggtctgccctggtgcgcgcgtgtgggagggtgtg

SEQ ID NO: 18430 - DNA, 26 bp, Homo sapiens
  misc_feature 1..26: note = chr4:42154359-42154385
  misc_feature 1..26: note = hyper
  source 1..26: mol_type = genomic DNA
cgagctcctgattgacaggctgcctc

SEQ ID NO: 18431 - DNA, 276 bp, Homo sapiens
  misc_feature 1..276: note = chr4:42154386-42154662
  misc_feature 1..276: note = hyper
  source 1..276: mol_type = genomic DNA
ccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccgg

SEQ ID NO: 18432 - DNA, 38 bp, Homo sapiens
  misc_feature 1..38: note = chr4:42399099-42399137
  misc_feature 1..38: note = hyper
  source 1..38: mol_type = genomic DNA
cttcaatgactgcaccgcattcatgcattatatccatt

SEQ ID NO: 18433 - DNA, 254 bp, Homo sapiens
  misc_feature 1..254: note = chr4:42399191-42399445
  misc_feature 1..254: note = hyper
  source 1..254: mol_type = genomic DNA
gaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaa

SEQ ID NO: 18434 - DNA, 606 bp, Homo sapiens
  misc_feature 1..606: note = chr4:42399872-42400478
  misc_feature 1..606: note = hyper
  source 1..606: mol_type = genomic DNA
cccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcg

SEQ ID NO: 18435 - DNA, 147 bp, Homo sapiens; identical to SEQ ID NO: 7359
  misc_feature 1..147: note = chr4:42400901-42401048
  misc_feature 1..147: note = hyper
  source 1..147: mol_type = genomic DNA

SEQ ID NO: 18436 - DNA, 30 bp, Homo sapiens; identical to SEQ ID NO: 7360
  misc_feature 1..30: note = chr4:44449013-44449043
  misc_feature 1..30: note = hyper
  source 1..30: mol_type = genomic DNA

SEQ ID NO: 18437 - DNA, 27 bp, Homo sapiens
  misc_feature 1..27: note = chr4:44449652-44449679
  misc_feature 1..27: note = hyper
  source 1..27: mol_type = genomic DNA
cgaggagttacacgccaccatgtggaa

SEQ ID NO: 18438 - DNA, 127 bp, Homo sapiens; identical to SEQ ID NO: 2409
  misc_feature 1..127: note = chr4:44450050-44450177
  misc_feature 1..127: note = hyper
  source 1..127: mol_type = genomic DNA

SEQ ID NO: 18439 - DNA, 223 bp, Homo sapiens; identical to SEQ ID NO: 2410
  misc_feature 1..223: note = chr4:44450741-44450964
  misc_feature 1..223: note = hyper
  source 1..223: mol_type = genomic DNA

SEQ ID NO: 18440 - DNA, 554 bp, Homo sapiens
  misc_feature 1..554: note = chr4:46995835-46996389
  misc_feature 1..554: note = hyper
  source 1..554: mol_type = genomic DNA
cgaccccaagtgggctccccgcccacagcagtgttcgtcctcctacctcctggccccctcccttccgctgggatttggatctaaccaatgaagctcctctgtcatcaggttgtgcgaggacctgtttgtacccagagtcaaggttggaggtggagaaagggcgggtgacggggactgctgggcgtcgggtggtagcggtggtgaggagaggggatcaagtccgggctcaaaccacctttgagaccctcccattcaggtgttatggggggcggtagggagagcaatgaaagcagaaagattcttcctggtaacaggggttgcagctcacccggcggactctcgccaaactattgggaagtggactcgagccgcactctagtcccagtatttgctaagctattgctttaaagacaccccatttctttacccgcctccaccagacacgcgcacaccctccgctttgctgctccatccttttctggagaggaggggagaggtggagacaagcgacctctggtcaaaatcactttcacttcttgcgacactcttctttt

SEQ ID NO: 18441 - DNA, 341 bp, Homo sapiens; identical to SEQ ID NO: 7366
  misc_feature 1..341: note = chr4:47034412-47034753
  misc_feature 1..341: note = hyper
  source 1..341: mol_type = genomic DNA

SEQ ID NO: 18442 - DNA, 154 bp, Homo sapiens
  misc_feature 1..154: note = chr4:47034754-47034908
  misc_feature 1..154: note = hyper
  source 1..154: mol_type = genomic DNA
tggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggc

SEQ ID NO: 18443 - DNA, 114 bp, Homo sapiens; identical to SEQ ID NO: 7370
  misc_feature 1..114: note = chr4:48987949-48988063
  misc_feature 1..114: note = hyper
  source 1..114: mol_type = genomic DNA

SEQ ID NO: 18444 - DNA, 30 bp, Homo sapiens; identical to SEQ ID NO: 7371
  misc_feature 1..30: note = chr4:48988465-48988495
  misc_feature 1..30: note = hyper
  source 1..30: mol_type = genomic DNA

SEQ ID NO: 18445 - DNA, 88 bp, Homo sapiens; identical to SEQ ID NO: 7372
  misc_feature 1..88: note = chr4:53617427-53617515
  misc_feature 1..88: note = hyper
  source 1..88: mol_type = genomic DNA

SEQ ID NO: 18446 - DNA, 30 bp, Homo sapiens; identical to SEQ ID NO: 7373
  misc_feature 1..30: note = chr4:53728192-53728222
  misc_feature 1..30: note = hyper
  source 1..30: mol_type = genomic DNA

SEQ ID NO: 18447 - DNA, 78 bp, Homo sapiens; identical to SEQ ID NO: 7375
  misc_feature 1..78: note = chr4:54965843-54965921
  misc_feature 1..78: note = hyper
  source 1..78: mol_type = genomic DNA

SEQ ID NO: 18448 - DNA, 333 bp, Homo sapiens
  misc_feature 1..333: note = chr4:54966521-54966854
  misc_feature 1..333: note = hyper
  source 1..333: mol_type = genomic DNA
ccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctgggg

SEQ ID NO: 18449 - DNA, 12 bp, Homo sapiens
  misc_feature 1..12: note = chr4:54967330-54967342
  misc_feature 1..12: note = hyper
  source 1..12: mol_type = genomic DNA
gggccttaggga

SEQ ID NO: 18450 - skipped

SEQ ID NO: 18451 - DNA, 274 bp, Homo sapiens
  misc_feature 1..274: note = chr4:54970095-54970369
  misc_feature 1..274: note = hyper
  source 1..274: mol_type = genomic DNA
aagattctgtctcccttcttcccaagaagcaggcctctccgcgcgcgagaacagaggtgggaggacgggagtttgcaggcgcaaagaacaggagtttaagcagactatttccaccaggggaaataagaagcacaaagagcgcctgctgcagctctttgcgctcttgcccaaagctaagcttcctctgggctgtggggagactcctctggtccccgttccatctacccagcccggcccctctggggctcagcgcttgggtttagccctcccctat

SEQ ID NO: 18452 - DNA, 33 bp, Homo sapiens
  misc_feature 1..33: note = chr4:54970482-54970515
  misc_feature 1..33: note = hyper
  source 1..33: mol_type = genomic DNA
tgccatgccgcagatagccgcagtgccaaccct

SEQ ID NO: 18453 - DNA, 130 bp, Homo sapiens; identical to SEQ ID NO: 369
  misc_feature 1..130: note = chr4:54975802-54975932
  misc_feature 1..130: note = hyper
  source 1..130: mol_type = genomic DNA

SEQ ID NO: 18454 - DNA, 15 bp, Homo sapiens
  misc_feature 1..15: note = chr4:55093818-55093833
  misc_feature 1..15: note = hyper
  source 1..15: mol_type = genomic DNA
ttttgccttttattc

SEQ ID NO: 18455 - DNA, 123 bp, Homo sapiens; identical to SEQ ID NO: 7383
  misc_feature 1..123: note = chr4:55093888-55094011
  misc_feature 1..123: note = hyper
  source 1..123: mol_type = genomic DNA

SEQ ID NO: 18456 - DNA, 63 bp, Homo sapiens; identical to SEQ ID NO: 7384
  misc_feature 1..63: note = chr4:55094012-55094075
  misc_feature 1..63: note = hyper
  source 1..63: mol_type = genomic DNA

SEQ ID NO: 18457 - DNA, 72 bp, Homo sapiens; identical to SEQ ID NO: 7386
  misc_feature 1..72: note = chr4:55096538-55096610
  misc_feature 1..72: note = hyper
  source 1..72: mol_type = genomic DNA

SEQ ID NO: 18458 - DNA, 37 bp, Homo sapiens
  misc_feature 1..37: note = chr4:55098637-55098674
  misc_feature 1..37: note = hyper
  source 1..37: mol_type = genomic DNA
cctactgcagtttctcggcccccgcgaaaggggagcg

SEQ ID NO: 18459 - DNA, 111 bp, Homo sapiens
  misc_feature 1..111: note = chr4:55099062-55099173
  misc_feature 1..111: note = hyper
  source 1..111: mol_type = genomic DNA
cttaaatgccgagagggcgcatgctagctctcctcagcattcccggtgagccgctacccacggccgtgcggctctcgtgcccataggaggcgctggcgagctcctgtaacc

SEQ ID NO: 18460 - DNA, 62 bp, Homo sapiens; identical to SEQ ID NO: 7390
  misc_feature 1..62: note = chr4:55523652-55523714
  misc_feature 1..62: note = hyper
  source 1..62: mol_type = genomic DNA

SEQ ID NO: 18461 - DNA, 30 bp, Homo sapiens; identical to SEQ ID NO: 7391
  misc_feature 1..30: note = chr4:55991067-55991097
  misc_feature 1..30: note = hyper
  source 1..30: mol_type = genomic DNA

SEQ ID NO: 18462 - DNA, 30 bp, Homo sapiens; identical to SEQ ID NO: 7392
  misc_feature 1..30: note = chr4:56501660-56501690
  misc_feature 1..30: note = hyper
  source 1..30: mol_type = genomic DNA

SEQ ID NO: 18463 - DNA, 51 bp, Homo sapiens
  misc_feature 1..51: note = chr4:57371963-57372014
  misc_feature 1..51: note = hyper
  source 1..51: mol_type = genomic DNA
gggcccagagccaccgctcagcacgcgggcacgcggcgggagggaaggaaa

SEQ ID NO: 18464 - DNA, 171 bp, Homo sapiens; identical to SEQ ID NO: 7396
  misc_feature 1..171: note = chr4:57396480-57396651
  misc_feature 1..171: note = hyper
  source 1..171: mol_type = genomic DNA

SEQ ID NO: 18465 - DNA, 18 bp, Homo sapiens
  misc_feature 1..18: note = chr4:57397264-57397282
  misc_feature 1..18: note = hyper
  source 1..18: mol_type = genomic DNA
cgccgcagtaatgatctc

SEQ ID NO: 18466 - skipped

SEQ ID NO: 18467 - DNA, 50 bp, Homo sapiens; identical to SEQ ID NO: 7402
  misc_feature 1..50: note = chr4:57687669-57687719
  misc_feature 1..50: note = hyper
  source 1..50: mol_type = genomic DNA

SEQ ID NO: 18468 - DNA, 11 bp, Homo sapiens
  misc_feature 1..11: note = chr4:57976405-57976416
  misc_feature 1..11: note = hyper
  source 1..11: mol_type = genomic DNA
ccggctcgcag

SEQ ID NO: 18469 - DNA, 96 bp, Homo sapiens
  misc_feature 1..96: note = chr4:57976573-57976669
  misc_feature 1..96: note = hyper
  source 1..96: mol_type = genomic DNA
gccttaaacccgccgccccgcccggcctgtccgcgggaaccacaccccggggcggtgagagcacgggggccccgcccgtgccgccctcccggcccc

SEQ ID NO: 18470 - DNA, 30 bp, Homo sapiens; identical to SEQ ID NO: 7405
  misc_feature 1..30: note = chr4:57977077-57977107
  misc_feature 1..30: note = hyper
  source 1..30: mol_type = genomic DNA

SEQ ID NO: 18471 - DNA, 18 bp, Homo sapiens
  misc_feature 1..18: note = chr4:62065800-62065818
  misc_feature 1..18: note = hyper
  source 1..18: mol_type = genomic DNA
cgccgaggcgggcctcga

SEQ ID NO: 18472 - DNA, 290 bp, Homo sapiens; identical to SEQ ID NO: 7408
  misc_feature 1..290: note = chr4:62066913-62067203
  misc_feature 1..290: note = hyper
  source 1..290: mol_type = genomic DNA

SEQ ID NO: 18473 - DNA, 71 bp, Homo sapiens
  misc_feature 1..71: note = chr4:62067440-62067511
  misc_feature 1..71: note = hyper
  source 1..71: mol_type = genomic DNA
gagcaactgatgggacgatctcagggaccggcgtttacgaaaggtaatttattcttcgcactcttcataat

SEQ ID NO: 18474 - DNA, 23 bp, Homo sapiens
  misc_feature 1..23: note = chr4:66535107-66535130
  misc_feature 1..23: note = hyper
  source 1..23: mol_type = genomic DNA
aaccgcagaggggagcgaaaagg

SEQ ID NO: 18475 - DNA, 108 bp, Homo sapiens; identical to SEQ ID NO: 7411
  misc_feature 1..108: note = chr4:71600516-71600624
  misc_feature 1..108: note = hyper
  source 1..108: mol_type = genomic DNA

SEQ ID NO: 18476 - DNA, 39 bp, Homo sapiens; identical to SEQ ID NO: 7412
  misc_feature 1..39: note = chr4:73434048-73434087
  misc_feature 1..39: note = hyper
  source 1..39: mol_type = genomic DNA

SEQ ID NO: 18477 - DNA, 252 bp, Homo sapiens; identical to SEQ ID NO: 7413
  misc_feature 1..252: note = chr4:73434964-73435216
  misc_feature 1..252: note = hyper
  source 1..252: mol_type = genomic DNA

SEQ ID NO: 18478 - DNA, 42 bp, Homo sapiens; identical to SEQ ID NO: 7414
  misc_feature 1..42: note = chr4:75231005-75231047
  misc_feature 1..42: note = hyper
  source 1..42: mol_type = genomic DNA

SEQ ID NO: 18479 - DNA, 188 bp, Homo sapiens
  misc_feature 1..188: note = chr4:81106163-81106351
  misc_feature 1..188: note = hyper
  source 1..188: mol_type = genomic DNA
gggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaatt

SEQ ID NO: 18480 - DNA, 92 bp, Homo sapiens; identical to SEQ ID NO: 7417
  misc_feature 1..92: note = chr4:81123206-81123298
  misc_feature 1..92: note = hyper
  source 1..92: mol_type = genomic DNA

SEQ ID NO: 18481 - DNA, 279 bp, Homo sapiens; identical to SEQ ID NO: 2424
  misc_feature 1..279: note = chr4:81123625-81123904
  misc_feature 1..279: note = hyper
  source 1..279: mol_type = genomic DNA

SEQ ID NO: 18482 - DNA, 156 bp, Homo sapiens
  misc_feature 1..156: note = chr4:81124121-81124277
  misc_feature 1..156: note = hyper
  source 1..156: mol_type = genomic DNA
gcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcgga

SEQ ID NO: 18483 - DNA, 36 bp, Homo sapiens; identical to SEQ ID NO: 7420
  misc_feature 1..36: note = chr4:81124695-81124731
  misc_feature 1..36: note = hyper
  source 1..36: mol_type = genomic DNA

SEQ ID NO: 18484 - skipped

SEQ ID NO: 18485 - DNA, 327 bp, Homo sapiens
  misc_feature 1..327: note = chr4:81187076-81187403
  misc_feature 1..327: note = hyper
  source 1..327: mol_type = genomic DNA
agaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcaca

SEQ ID NO: 18486 - DNA, 16 bp, Homo sapiens
  misc_feature 1..16: note = chr4:81187782-81187798
  misc_feature 1..16: note = hyper
  source 1..16: mol_type = genomic DNA
gcgttataaatatccc

SEQ ID NO: 18487 - DNA, 271 bp, Homo sapiens; identical to SEQ ID NO: 7423
  misc_feature 1..271: note = chr4:81187799-81188070
  misc_feature 1..271: note = hyper
  source 1..271: mol_type = genomic DNA

SEQ ID NO: 18488 - DNA, 40 bp, Homo sapiens; identical to SEQ ID NO: 7424
  misc_feature 1..40: note = chr4:81188276-81188316
  misc_feature 1..40: note = hyper
  source 1..40: mol_type = genomic DNA

SEQ ID NO: 18489 - skipped

SEQ ID NO: 18490 - DNA, 214 bp, Homo sapiens; identical to SEQ ID NO: 7427
  misc_feature 1..214: note = chr4:81257025-81257239
  misc_feature 1..214: note = hyper
  source 1..214: mol_type = genomic DNA

SEQ ID NO: 18491 - DNA, 10 bp, Homo sapiens
  misc_feature 1..10: note = chr4:81951421-81951431
  misc_feature 1..10: note = hyper
  source 1..10: mol_type = genomic DNA
gcaggtgcag

SEQ ID NO: 18492 - DNA, 26 bp, Homo sapiens
  misc_feature 1..26: note = chr4:81951460-81951486
  misc_feature 1..26: note = hyper
  source 1..26: mol_type = genomic DNA
gggaaagtaagcgagaatggtgttca

SEQ ID NO: 18493 - DNA, 17 bp, Homo sapiens
  misc_feature 1..17: note = chr4:81951832-81951849
  misc_feature 1..17: note = hyper
  source 1..17: mol_type = genomic DNA
agatcagctagagagcg

SEQ ID NO: 18494 - DNA, 32 bp, Homo sapiens
  misc_feature 1..32: note = chr4:81951909-81951941
  misc_feature 1..32: note = hyper
  source 1..32: mol_type = genomic DNA
cgcacacacacacacacgtacactaaaaaact

SEQ ID NO: 18495 - DNA, 76 bp, Homo sapiens
  misc_feature 1..76: note = chr4:81951970-81952046
  misc_feature 1..76: note = hyper
  source 1..76: mol_type = genomic DNA
ccctggaaaaggcaatcgagcgccctccggaccgctgcgcacagccccggctccgacctggcgcccaaaacagagc

SEQ ID NO: 18496 - DNA, 157 bp, Homo sapiens; identical to SEQ ID NO: 7432
  misc_feature 1..157: note = chr4:81952727-81952884
  misc_feature 1..157: note = hyper
  source 1..157: mol_type = genomic DNA

SEQ ID NO: 18497 - DNA, 123 bp, Homo sapiens; identical to SEQ ID NO: 7433
  misc_feature 1..123: note = chr4:82136082-82136205
  misc_feature 1..123: note = hyper
  source 1..123: mol_type = genomic DNA

SEQ ID NO: 18498 - DNA, 37 bp, Homo sapiens; identical to SEQ ID NO: 7434
  misc_feature 1..37: note = chr4:82136243-82136280
  misc_feature 1..37: note = hyper
  source 1..37: mol_type = genomic DNA

SEQ ID NO: 18499 - DNA, 172 bp, Homo sapiens
  misc_feature 1..172: note = chr4:82136635-82136807
  misc_feature 1..172: note = hyper
  source 1..172: mol_type = genomic DNA
ttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcac

SEQ ID NO: 18500 - DNA, 84 bp, Homo sapiens
  misc_feature 1..84: note = chr4:82136837-82136921
  misc_feature 1..84: note = hyper
  source 1..84: mol_type = genomic DNA
ccgaagcagctcgtcgacgcgcccctcccggactctggggccataacttacatctagtttgccagttcacgtgatgctgggggc

SEQ ID NO: 18501 - DNA, 12 bp, Homo sapiens
  misc_feature 1..12: note = chr4:85402764-85402776
  misc_feature 1..12: note = hyper
  source 1..12: mol_type = genomic DNA
cggagactattc

SEQ ID NO: 18502 - DNA, 189 bp, Homo sapiens; identical to SEQ ID NO: 7440
  misc_feature 1..189: note = chr4:85414148-85414337
  misc_feature 1..189: note = hyper
  source 1..189: mol_type = genomic DNA

SEQ ID NO: 18503 - DNA, 25 bp, Homo sapiens
  misc_feature 1..25: note = chr4:85414457-85414482
  misc_feature 1..25: note = hyper
  source 1..25: mol_type = genomic DNA
ggctcggacgcgtgcagtaggaggc

SEQ ID NO: 18504 - DNA, 401 bp, Homo sapiens
  misc_feature 1..401: note = chr4:85416935-85417336
  misc_feature 1..401: note = hyper
  source 1..401: mol_type = genomic DNA
ggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctc

SEQ ID NO: 18505 - DNA, 53 bp, Homo sapiens; identical to SEQ ID NO: 7444
  misc_feature 1..53: note = chr4:85417666-85417719
  misc_feature 1..53: note = hyper
  source 1..53: mol_type = genomic DNA

SEQ ID NO: 18506 - DNA, 37 bp, Homo sapiens; identical to SEQ ID NO: 7446
  misc_feature 1..37: note = chr4:85418265-85418302
  misc_feature 1..37: note = hyper
  source 1..37: mol_type = genomic DNA

SEQ ID NO: 18507 - DNA, 123 bp, Homo sapiens; identical to SEQ ID NO: 378
  misc_feature 1..123: note = chr4:85419120-85419243
  misc_feature 1..123: note = hyper
  source 1..123: mol_type = genomic DNA

SEQ ID NO: 18508 - DNA, 87 bp, Homo sapiens; identical to SEQ ID NO: 7448
  misc_feature 1..87: note = chr4:85419695-85419782
  misc_feature 1..87: note = hyper
  source 1..87: mol_type = genomic DNA

SEQ ID NO: 18509 - DNA, 18 bp, Homo sapiens
  misc_feature 1..18: note = chr4:85422432-85422450
  misc_feature 1..18: note = hyper
  source 1..18: mol_type = genomic DNA
cttcggacactccaccct

SEQ ID NO: 18510 - DNA, 86 bp, Homo sapiens; identical to SEQ ID NO: 7451
  misc_feature 1..86: note = chr4:87281209-87281295
  misc_feature 1..86: note = hyper
  source 1..86: mol_type = genomic DNA

SEQ ID NO: 18511 - DNA, 75 bp, Homo sapiens; identical to SEQ ID NO: 7452
  misc_feature 1..75: note = chr4:87515552-87515627
  misc_feature 1..75: note = hyper
  source 1..75: mol_type = genomic DNA

SEQ ID NO: 18512 - DNA, 91 bp, Homo sapiens
  misc_feature 1..91: note = chr4:89378373-89378464
  misc_feature 1..91: note = hyper
  source 1..91: mol_type = genomic DNA
ggcgttctctcctctcgcctctgggcctgggaccccgcaaagcggcgatggagcggaggtcgcggaggaagtcgcggcgcaacgggcgctc

SEQ ID NO: 18513 - DNA, 12 bp, Homo sapiens
  misc_feature 1..12: note = chr4:89378497-89378509
  misc_feature 1..12: note = hyper
  source 1..12: mol_type = genomic DNA
gaagtctccggg

SEQ ID NO: 18514 - DNA, 122 bp, Homo sapiens; identical to SEQ ID NO: 7455
  misc_feature 1..122: note = chr4:90758478-90758600
  misc_feature 1..122: note = hyper
  source 1..122: mol_type = genomic DNA

SEQ ID NO: 18515 - DNA, 30 bp, Homo sapiens; identical to SEQ ID NO: 7457
  misc_feature 1..30: note = chr4:90759319-90759349
  misc_feature 1..30: note = hyper
  source 1..30: mol_type = genomic DNA

SEQ ID NO: 18516 - DNA, 30 bp, Homo sapiens; identical to SEQ ID NO: 7458
  misc_feature 1..30: note = chr4:93225390-93225420
  misc_feature 1..30: note = hyper
  source 1..30: mol_type = genomic DNA

SEQ ID NO: 18517 - DNA, 76 bp, Homo sapiens
  misc_feature 1..76: note = chr4:94750906-94750982
  misc_feature 1..76: note = hyper
  source 1..76: mol_type = genomic DNA
cagccccagcttctgcgggagggtactcggtgcagctggacgctctgcacttctcgactttcgaggacagcgccct

SEQ ID NO: 18518 - DNA, 51 bp, Homo sapiens
  misc_feature 1..51: note = chr4:94751368-94751419
  misc_feature 1..51: note = hyper
  source 1..51: mol_type = genomic DNA
aaattgtgtcctttccgcccaccttctgctccccctttagatagatacggt

SEQ ID NO: 18519 - DNA, 97 bp, Homo sapiens
  misc_feature 1..97: note = chr4:94751502-94751599
  misc_feature 1..97: note = hyper
  source 1..97: mol_type = genomic DNA
actggtttgggtttaatttattttacgccctgggcatccatccttgtgtgttgcgcactcaagtgtgggagatttagtcttccgaagttgttttcca

SEQ ID NO: 18520 - DNA, 114 bp, Homo sapiens; identical to SEQ ID NO: 7462
  misc_feature 1..114: note = chr4:94753279-94753393
  misc_feature 1..114: note = hyper
  source 1..114: mol_type = genomic DNA

SEQ ID NO: 18521 - DNA, 55 bp, Homo sapiens; identical to SEQ ID NO: 7464
  misc_feature 1..55: note = chr4:95678866-95678921
  misc_feature 1..55: note = hyper
  source 1..55: mol_type = genomic DNA

SEQ ID NO: 18522 - DNA, 30 bp, Homo sapiens; identical to SEQ ID NO: 7465
  misc_feature 1..30: note = chr4:95679715-95679745
  misc_feature 1..30: note = hyper
  source 1..30: mol_type = genomic DNA

SEQ ID NO: 18523 - DNA, 30 bp, Homo sapiens; identical to SEQ ID NO: 7466
  misc_feature 1..30: note = chr4:96469039-96469069
  misc_feature 1..30: note = hyper
  source 1..30: mol_type = genomic DNA

SEQ ID NO: 18524 - DNA, 83 bp, Homo sapiens
  misc_feature 1..83: note = chr4:101111504-101111587
  misc_feature 1..83: note = hyper
  source 1..83: mol_type = genomic DNA
acaggcaggtggcttcttaggagtcccctctcctggggactcggtgacctgcagaccccagcagccagcggcaccctgctcac

SEQ ID NO: 18525 - DNA, 31 bp, Homo sapiens
  misc_feature 1..31: note = chr4:101111826-101111857
  misc_feature 1..31: note = hyper
  source 1..31: mol_type = genomic DNA
ttccagggtagatctcgggccactgggaccg

SEQ ID NO: 18526 - DNA, 61 bp, Homo sapiens
  misc_feature 1..61: note = chr4:107955250-107955311
  misc_feature 1..61: note = hyper
  source 1..61: mol_type = genomic DNA
ctgcaaaattgtccccgtgagagggcagtagggggccaagcccgggtcttgtctctctgtc

SEQ ID NO: 18527 - DNA, 113 bp, Homo sapiens; identical to SEQ ID NO: 7472
  misc_feature 1..113: note = chr4:107957249-107957362
  misc_feature 1..113: note = hyper
  source 1..113: mol_type = genomic DNA

SEQ ID NO: 18528 - DNA, 10 bp, Homo sapiens
  misc_feature 1..10: note = chr4:107957363-107957373
  misc_feature 1..10: note = hyper
  source 1..10: mol_type = genomic DNA
ttgtcccctg

SEQ ID NO: 18529 - DNA, 85 bp, Homo sapiens
  misc_feature 1..85: note = chr4:107957466-107957551
  misc_feature 1..85: note = hyper
  source 1..85: mol_type = genomic DNA
tgctctctccccagtcctctttgctttttatagcttcccacagtgaggactttttttttttttttacctccgcccccaattcaag

SEQ ID NO: 18530 - DNA, 30 bp, Homo sapiens; identical to SEQ ID NO: 7474
  misc_feature 1..30: note = chr4:107957963-107957993
  misc_feature 1..30: note = hyper
  source 1..30: mol_type = genomic DNA

SEQ ID NO: 18531 - DNA, 30 bp, Homo sapiens; identical to SEQ ID NO: 7475
  misc_feature 1..30: note = chr4:107958442-107958472
  misc_feature 1..30: note = hyper
  source 1..30: mol_type = genomic DNA

SEQ ID NO: 18532 - DNA, 213 bp, Homo sapiens; identical to SEQ ID NO: 7476
  misc_feature 1..213: note = chr4:109088250-109088463
  misc_feature 1..213: note = hyper
  source 1..213: mol_type = genomic DNA

SEQ ID NO: 18533 - DNA, 98 bp, Homo sapiens
  misc_feature 1..98: note = chr4:109093307-109093405
  misc_feature 1..98: note = hyper
  source 1..98: mol_type = genomic DNA
tcctctccgccccctcggtcctaacccccgcccaggctccaggtcttcccctttgtgtggcctggactctctcccagctacgactttggtgggatcca

SEQ ID NO: 18534 - skipped

SEQ ID NO: 18535 - DNA, 117 bp, Homo sapiens; identical to SEQ ID NO: 7478
  misc_feature 1..117: note = chr4:109093806-109093923
  misc_feature 1..117: note = hyper
  source 1..117: mol_type = genomic DNA

SEQ ID NO: 18536 - DNA, 89 bp, Homo sapiens; identical to SEQ ID NO: 7479
  misc_feature 1..89: note = chr4:109094183-109094272
  misc_feature 1..89: note = hyper
  source 1..89: mol_type = genomic DNA

SEQ ID NO: 18537 - DNA, 30 bp, Homo sapiens; identical to SEQ ID NO: 7480
  misc_feature 1..30: note = chr4:109683691-109683721
  misc_feature 1..30: note = hyper
  source 1..30: mol_type = genomic DNA

SEQ ID NO: 18538 - DNA, 70 bp, Homo sapiens; identical to SEQ ID NO: 7481
  misc_feature 1..70: note = chr4:109684016-109684086
  misc_feature 1..70: note = hyper
  source 1..70: mol_type = genomic DNA

SEQ ID NO: 18539 - DNA, 37 bp, Homo sapiens; identical to SEQ ID NO: 7485
  misc_feature 1..37: note = chr4:110224118-110224155
  misc_feature 1..37: note = hyper
  source 1..37: mol_type = genomic DNA

SEQ ID NO: 18540 - DNA, 49 bp, Homo sapiens
  misc_feature 1..49: note = chr4:111532961-111533010
  misc_feature 1..49: note = hyper
  source 1..49: mol_type = genomic DNA
accccggaggtgcgtaggtggccctccgggttcccgcttctcctagtgc

SEQ ID NO: 18541 - DNA, 19 bp, Homo sapiens
  misc_feature 1..19: note = chr4:111540360-111540379
  misc_feature 1..19: note = hyper
  source 1..19: mol_type = genomic DNA
ggtacgtgctcccttaaca

SEQ ID NO: 18542 - skipped

SEQ ID NO: 18543 - DNA, 105 bp, Homo sapiens; identical to SEQ ID NO: 2442
  misc_feature 1..105: note = chr4:111544076-111544181
  misc_feature 1..105: note = hyper
  source 1..105: mol_type = genomic DNA

SEQ ID NO: 18544 - DNA, 83 bp, Homo sapiens
  misc_feature 1..83: note = chr4:111544298-111544381
  misc_feature 1..83: note = hyper
  source 1..83: mol_type = genomic DNA
cgccgcggccctccccagccctctccgcctccgcctcctcccagacccttctccgggtgcgactgacgtggctccgcaccaat

SEQ ID NO: 18545 - DNA, 30 bp, Homo sapiens; identical to SEQ ID NO: 7494
  misc_feature 1..30: note = chr4:111549993-111550023
  misc_feature 1..30: note = hyper
  source 1..30: mol_type = genomic DNA

SEQ ID NO: 18546 - DNA, 10 bp, Homo sapiens
  misc_feature 1..10: note = chr4:111550834-111550844
  misc_feature 1..10: note = hyper
  source 1..10: mol_type = genomic DNA
cgcaaagcca

SEQ ID NO: 18547 - DNA, 105 bp, Homo sapiens
  misc_feature 1..105: note = chr4:111552994-111553099
  misc_feature 1..105: note = hyper
  source 1..105: mol_type = genomic DNA
cttcagggatgttgtcggccccccgcccctcccccaaccagccaaagcaaaccttcgccaactcaagtttcccttgcttgcctcccgcgatgaaccgcgcaccca

SEQ ID NO: 18548 - DNA, 245 bp, Homo sapiens
  misc_feature 1..245: note = chr4:111553450-111553695
  misc_feature 1..245: note = hyper
  source 1..245: mol_type = genomic DNA
cggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaa

SEQ ID NO: 18549 - DNA, 67 bp, Homo sapiens
  misc_feature 1..67: note = chr4:111557898-111557965
  misc_feature 1..67: note = hyper
  source 1..67: mol_type = genomic DNA
tatctcacatccctgcgggatagatggcctccacttaccggctaccgggagagagctgctgtctccg

SEQ ID NO: 18550 - DNA, 18 bp, Homo sapiens
  misc_feature 1..18: note = chr4:111559233-111559251
  misc_feature 1..18: note = hyper
  source 1..18: mol_type = genomic DNA
tggcgaggatggtattaa

SEQ ID NO: 18551 - DNA, 24 bp, Homo sapiens
  misc_feature 1..24: note = chr4:113431810-113431834
  misc_feature 1..24: note = hyper
  source 1..24: mol_type = genomic DNA
tttcttttgcagattcggaggccg

SEQ ID NO: 18552 - DNA, 30 bp, Homo sapiens; identical to SEQ ID NO: 7506
  misc_feature 1..30: note = chr4:113432579-113432609
  misc_feature 1..30: note = hyper
  source 1..30: mol_type = genomic DNA

SEQ ID NO: 18553 - DNA, 379 bp, Homo sapiens
  misc_feature 1..379: note = chr4:113435837-113436216
  misc_feature 1..379: note = hyper
  source 1..379: mol_type = genomic DNA
aggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtgggga

SEQ ID NO: 18554 - DNA, 106 bp, Homo sapiens
  misc_feature 1..106: note = chr4:113436287-113436393
  misc_feature 1..106: note = hyper
  source 1..106: mol_type = genomic DNA
agtctacgggtcttcttgatgcgctgcaccgtctcggccgtcttggcgcctcgggagacggcccgcgcccgggaagggcgccgtttgcaatcgtgtaccagaccca

SEQ ID NO: 18555 - DNA, 342 bp, Homo sapiens; identical to SEQ ID NO: 7508
  misc_feature 1..342: note = chr4:113437629-113437971
  misc_feature 1..342: note = hyper
  source 1..342: mol_type = genomic DNA

SEQ ID NO: 18556 - DNA, 30 bp, Homo sapiens; identical to SEQ ID NO: 7509
  misc_feature 1..30: note = chr4:113438171-113438201
  misc_feature 1..30: note = hyper
  source 1..30: mol_type = genomic DNA

SEQ ID NO: 18557 - DNA, 198 bp, Homo sapiens; identical to SEQ ID NO: 7510
  misc_feature 1..198: note = chr4:113438506-113438704
  misc_feature 1..198: note = hyper
  source 1..198: mol_type = genomic DNA

SEQ ID NO: 18558 - DNA, 151 bp, Homo sapiens
  misc_feature 1..151: note = chr4:113441947-113442098
  misc_feature 1..151: note = hyper
  source 1..151: mol_type = genomic DNA
gagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcat

SEQ ID NO: 18559 - DNA, 32 bp, Homo sapiens; identical to SEQ ID NO: 7516
  misc_feature 1..32: note = chr4:113626580-113626612
  misc_feature 1..32: note = hyper
  source 1..32: mol_type = genomic DNA

SEQ ID NO: 18560 - DNA, 93 bp, Homo sapiens
  misc_feature 1..93: note = chr4:117847306-117847399
  misc_feature 1..93: note = hyper
  source 1..93: mol_type = genomic DNA
cgacccctcccatctcgctccccacatccccgcggacacagctggtggcgactcagacctctcgggcagcggctgcagggcgagcacagaggg

SEQ ID NO: 18561 - skipped

SEQ ID NO: 18562 - DNA, 11 bp, Homo sapiens
  misc_feature 1..11: note = chr4:117847469-117847480
  misc_feature 1..11: note = hyper
  source 1..11: mol_type = genomic DNA
cgggcccgctc

SEQ ID NO: 18563 - DNA, 56 bp, Homo sapiens
  misc_feature 1..56: note = chr4:121844007-121844063
  misc_feature 1..56: note = hyper
  source 1..56: mol_type = genomic DNA
gggcgcgggcctgggcgctgcgggcgccgggacgccgctcgctgattggcccgaag

SEQ ID NO: 18564 - DNA, 114 bp, Homo sapiens; identical to SEQ ID NO: 7520
  misc_feature 1..114: note = chr4:121992426-121992540
  misc_feature 1..114: note = hyper
  source 1..114: mol_type = genomic DNA

SEQ ID NO: 18565 - DNA, 249 bp, Homo sapiens; identical to SEQ ID NO: 7521
  misc_feature 1..249: note = chr4:121993436-121993685
  misc_feature 1..249: note = hyper
  source 1..249: mol_type = genomic DNA

SEQ ID NO: 18566 - skipped

SEQ ID NO: 18567 - DNA, 30 bp, Homo sapiens; identical to SEQ ID NO: 7523
  misc_feature 1..30: note = chr4:121994303-121994333
  misc_feature 1..30: note = hyper
  source 1..30: mol_type = genomic DNA

SEQ ID NO: 18568 - DNA, 48 bp, Homo sapiens; identical to SEQ ID NO: 385
  misc_feature 1..48: note = chr4:122301962-122302010
  misc_feature 1..48: note = hyper
  source 1..48: mol_type = genomic DNA

SEQ ID NO: 18569 - DNA, 57 bp, Homo sapiens
  misc_feature 1..57: note = chr4:122302246-122302303
  misc_feature 1..57: note = hyper
  source 1..57: mol_type = genomic DNA
cagcttcagtggcgccaacgccgcttccccgcaccctcagggcgagggaagacttcc

SEQ ID NO: 18570 - DNA, 43 bp, Homo sapiens
  misc_feature 1..43: note = chr4:122871251-122871294
  misc_feature 1..43: note = hyper
  source 1..43: mol_type = genomic DNA
ctccatttcctgggccgtttccattccacgcttatcttcagca

SEQ ID NO: 18571 - DNA, 239 bp, Homo sapiens
  misc_feature 1..239: note = chr4:122871334-122871573
  misc_feature 1..239: note = hyper
  source 1..239: mol_type = genomic DNA
agaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcg

SEQ ID NO: 18572 - DNA, 452 bp, Homo sapiens
  misc_feature 1..452: note = chr4:122872000-122872452
  misc_feature 1..452: note = hyper
  source 1..452: mol_type = genomic DNA
cccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcct

SEQ ID NO: 18573 - DNA, 258 bp, Homo sapiens; identical to SEQ ID NO: 7530
  misc_feature 1..258: note = chr4:123747826-123748084
  misc_feature 1..258: note = hyper
  source 1..258: mol_type = genomic DNA

SEQ ID NO: 18574 - DNA, 354 bp, Homo sapiens; identical to SEQ ID NO: 7531
  misc_feature 1..354: note = chr4:123748540-123748894
  misc_feature 1..354: note = hyper
  source 1..354: mol_type = genomic DNA

SEQ ID NO: 18575 - DNA, 24 bp, Homo sapiens
  misc_feature 1..24: note = chr4:126238000-126238024
  misc_feature 1..24: note = hyper
  source 1..24: mol_type = genomic DNA
ggaagacagtagcagcggacgcca

SEQ ID NO: 18576 - DNA, 30 bp, Homo sapiens
  misc_feature 1..30: note = chr4:128544161-128544191
  misc_feature 1..30: note = hyper
  source 1..30: mol_type = genomic DNA
gctcgcgcccagcgccggagacgggctgtg

SEQ ID NO: 18577 - DNA, 61 bp, Homo sapiens; identical to SEQ ID NO: 7535
  misc_feature 1..61: note = chr4:134068338-134068399
  misc_feature 1..61: note = hyper
  source 1..61: mol_type = genomic DNA

SEQ ID NO: 18578 - DNA, 43 bp, Homo sapiens; identical to SEQ ID NO: 7536
  misc_feature 1..43: note = chr4:134068856-134068899
  misc_feature 1..43: note = hyper
  source 1..43: mol_type = genomic DNA

SEQ ID NO: 18579 - DNA, 101 bp, Homo sapiens; identical to SEQ ID NO: 7538
  misc_feature 1..101: note = chr4:134071103-134071204
  misc_feature 1..101: note = hyper
  source 1..101: mol_type = genomic DNA

SEQ ID NO: 18580 - DNA, 30 bp, Homo sapiens; identical to SEQ ID NO: 7539
  misc_feature 1..30: note = chr4:134071425-134071455
  misc_feature 1..30: note = hyper
  source 1..30: mol_type = genomic DNA

SEQ ID NO: 18581 - DNA, 13 bp, Homo sapiens
  misc_feature 1..13: note = chr4:134072967-134072980
  misc_feature 1..13: note = hyper
  source 1..13: mol_type = genomic DNA
ccactgtcaacat

SEQ ID NO: 18582 - DNA, 228 bp, Homo sapiens
  misc_feature 1..228: note = chr4:134073340-134073568
  misc_feature 1..228: note = hyper
  source 1..228: mol_type = genomic DNA
cgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcct

SEQ ID NO: 18583 - DNA, 38 bp, Homo sapiens; identical to SEQ ID NO: 7546
  misc_feature 1..38: note = chr4:140657110-140657148
  misc_feature 1..38: note = hyper
  source 1..38: mol_type = genomic DNA

SEQ ID NO: 18584 - DNA, 47 bp, Homo sapiens; identical to SEQ ID NO: 7547
  misc_feature 1..47: note = chr4:141294349-141294396
  misc_feature 1..47: note = hyper
  source 1..47: mol_type = genomic DNA

SEQ ID NO: 18585 - DNA, 30 bp, Homo sapiens
  misc_feature 1..30: note = chr4:141348151-141348181
  misc_feature 1..30: note = hyper
  source 1..30: mol_type = genomic DNA
ggagactgagacagccgagcctattttgat

SEQ ID NO: 18586 - DNA, 13 bp, Homo sapiens
  misc_feature 1..13: note = chr4:141419418-141419431
  misc_feature 1..13: note = hyper
  source 1..13: mol_type = genomic DNA
gataatgccaggg

SEQ ID NO: 18587 - DNA, 142 bp, Homo sapiens; identical to SEQ ID NO: 7551
  misc_feature 1..142: note = chr4:142054074-142054216
  misc_feature 1..142: note = hyper
  source 1..142: mol_type = genomic DNA

SEQ ID NO: 18588 - DNA, 96 bp, Homo sapiens
  misc_feature 1..96: note = chr4:144622058-144622154
  misc_feature 1..96: note = hyper
  source 1..96: mol_type = genomic DNA
gctggcttctggggaccccagatacgcgcccagcgcggcgagacttagcgagggtgcagcgctgtcccctccgctcctgggcgcttcacccagcct

SEQ ID NO: 18589 - DNA, 125 bp, Homo sapiens
  misc_feature 1..125: note = chr4:145568334-145568459
  misc_feature 1..125: note = hyper
  source 1..125: mol_type = genomic DNA
atctctgaaaacagacgtttctgcggtacccgcaccctgggctgggtaaatattttaaaagaatcgcgatgaacagtgtgttttggatcgaatggggcattggctgcggtgaaactgtaaattaa

SEQ ID NO: 18590 - DNA, 112 bp, Homo sapiens
  misc_feature 1..112: note = chr4:147558504-147558616
  misc_feature 1..112: note = hyper
  source 1..112: mol_type = genomic DNA
cctgctcccggtcaacccccgtccggattgggccacccgcgggttcctgcgtcggggtcccggggccttctcaccctcgcctgcaccctgctccttccgctctctagggagg

SEQ ID NO: 18591 - DNA, 131 bp, Homo sapiens
  misc_feature 1..131: note = chr4:147559190-147559321
  misc_feature 1..131: note = hyper
  source 1..131: mol_type = genomic DNA
gggagggggaggagtcgcatgcgcacagacgacccgagcctgctccgcggctgtccaatccgctgagagctgcgagaaatcgagtgagagaaagccctgcagcccctccgaccccatgtctctttggcacc

SEQ ID NO: 18592 - DNA, 40 bp, Homo sapiens
  misc_feature 1..40: note = chr4:147562055-147562095
  misc_feature 1..40: note = hyper
  source 1..40: mol_type = genomic DNA
ccagtaaatgtgaatctcgacaaatcgaggactgaagagg

SEQ ID NO: 18593 - DNA, 41 bp, Homo sapiens; identical to SEQ ID NO: 7565
  misc_feature 1..41: note = chr4:147569117-147569158
  misc_feature 1..41: note = hyper
  source 1..41: mol_type = genomic DNA

SEQ ID NO: 18594 - DNA, 205 bp, Homo sapiens
  misc_feature 1..205: note = chr4:147576639-147576844
  misc_feature 1..205: note = hyper
  source 1..205: mol_type = genomic DNA
gggaagcgtcccaagcccgcgcggtctgccccggagccccggaggacccgaatactcagcggaatgtcaccctggccgggttctttggattcccctccggggccatcctacggaatccagccgtccccacaagctacctcatgtaactggagacctaagaaaagactctccataccttttgacaaaaagacgtaccagaagcaat

SEQ ID NO: 18595 - DNA, 30 bp, Homo sapiens; identical to SEQ ID NO: 7567
  misc_feature 1..30: note = chr4:151000206-151000236
  misc_feature 1..30: note = hyper
  source 1..30: mol_type = genomic DNA

SEQ ID NO: 18596 - DNA, 157 bp, Homo sapiens; identical to SEQ ID NO: 7568
  misc_feature 1..157: note = chr4:154143837-154143994
  misc_feature 1..157: note = hyper
  source 1..157: mol_type = genomic DNA

SEQ ID NO: 18597 - DNA, 46 bp, Homo sapiens; identical to SEQ ID NO: 7569
  misc_feature 1..46: note = chr4:154144430-154144476
  misc_feature 1..46: note = hyper
  source 1..46: mol_type = genomic DNA

SEQ ID NO: 18598 - DNA, 76 bp, Homo sapiens; identical to SEQ ID NO: 7570
  misc_feature 1..76: note = chr4:154680788-154680864
  misc_feature 1..76: note = hyper
  source 1..76: mol_type = genomic DNA

SEQ ID NO: 18599 - DNA, 30 bp, Homo sapiens; identical to SEQ ID NO: 7571
  misc_feature 1..30: note = chr4:154709169-154709199
  misc_feature 1..30: note = hyper
  source 1..30: mol_type = genomic DNA

SEQ ID NO: 18600 - DNA, 48 bp, Homo sapiens
  misc_feature 1..48: note = chr4:154709476-154709524
  misc_feature 1..48: note = hyper
  source 1..48: mol_type = genomic DNA
aaggcttaccttcctcggtggctggcaggaggtggtcgctgctagcga

SEQ ID NO: 18601 - DNA, 148 bp, Homo sapiens
  misc_feature 1..148: note = chr4:154712024-154712172
  misc_feature 1..148: note = hyper
  source 1..148: mol_type = genomic DNA
ctctgagagatgctacgacttgggcctgggagtgggataagggccctctcgctttcacgcccccccaaccccccgccggccccggccaacccctaaatccccaacgccctccgctggggtcgcctcctccccgcagagccccttgttg

SEQ ID NO: 18602 - DNA, 114 bp, Homo sapiens
  misc_feature 1..114: note = chr4:154712594-154712708
  misc_feature 1..114: note = hyper
  source 1..114: mol_type = genomic DNA
gcccatatgagcagcgcagggatgggacactgggtgcccatcccagcgcgcctccccagactggtccctgggatgctcacacgtggcgcggcaccgcggcggcgccttcacgaa

SEQ ID NO: 18603 - DNA, 36 bp, Homo sapiens
  misc_feature 1..36: note = chr4:155254130-155254166
  misc_feature 1..36: note = hyper
  source 1..36: mol_type = genomic DNA
cgcgtttctcgataacgactgtcagcaccagcaggg

SEQ ID NO: 18604 - DNA, 105 bp, Homo sapiens
  misc_feature 1..105: note = chr4:155254196-155254301
  misc_feature 1..105: note = hyper
  source 1..105: mol_type = genomic DNA
ccctgagagtcagcgtgagctcccgctgctcgcccgcgcccaggctgccgttgaggaacagcacccccagggctctgtcgatggcaaagacgcctggctgcgggc

SEQ ID NO: 18605 - DNA, 56 bp, Homo sapiens; identical to SEQ ID NO: 7579
  misc_feature 1..56: note = chr4:155411438-155411494
  misc_feature 1..56: note = hyper
  source 1..56: mol_type = genomic DNA

SEQ ID NO: 18606 - DNA, 143 bp, Homo sapiens; identical to SEQ ID NO: 7581
  misc_feature 1..143: note = chr4:155413374-155413517
  misc_feature 1..143: note = hyper
  source 1..143: mol_type = genomic DNA

SEQ ID NO: 18607 - DNA, 110 bp, Homo sapiens; identical to SEQ ID NO: 7583
  misc_feature 1..110: note = chr4:155664194-155664304
  misc_feature 1..110: note = hyper
  source 1..110: mol_type = genomic DNA

SEQ ID NO: 18608 - DNA, 60 bp, Homo sapiens
  misc_feature 1..60: note = chr4:155665385-155665445
  misc_feature 1..60: note = hyper
  source 1..60: mol_type = genomic DNA
cgcagcacccctgcccggcgagcttaacttgcccagcccggcccctgccggagtggcacc

SEQ ID NO: 18609 - DNA, 30 bp, Homo sapiens; identical to SEQ ID NO: 7585
  misc_feature 1..30: note = chr4:155665748-155665778
  misc_feature 1..30: note = hyper
  source 1..30: mol_type = genomic DNA

SEQ ID NO: 18610 - DNA, 140 bp, Homo sapiens
  misc_feature 1..140: note = chr4:156129606-156129746
  misc_feature 1..140: note = hyper
  source 1..140: mol_type = genomic DNA
gcaaagggagagattcgtggaagggaagggaggtaggggtggcgcaaacgcccagagtatcaaacttgggggtggcacagtaggtgacagcagcagctgcaggtggtggctggggacccgcgagggggcgcccctctggg

SEQ ID NO: 18611 - DNA, 250 bp, Homo sapiens
  misc_feature 1..250: note = chr4:156129797-156130047
  misc_feature 1..250: note = hyper
  source 1..250: mol_type = genomic DNA
ggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactg

SEQ ID NO: 18612 - DNA, 162 bp, Homo sapiens; identical to SEQ ID NO: 7589
  misc_feature 1..162: note = chr4:156588521-156588683
  misc_feature 1..162: note = hyper
  source 1..162: mol_type = genomic DNA

SEQ ID NO: 18613 - DNA, 130 bp, Homo sapiens; identical to SEQ ID NO: 7590
  misc_feature 1..130: note = chr4:156588684-156588814
  misc_feature 1..130: note = hyper
  source 1..130: mol_type = genomic DNA

SEQ ID NO: 18614 - DNA, 70 bp, Homo sapiens; identical to SEQ ID NO: 7591
  misc_feature 1..70: note = chr4:156680699-156680769
  misc_feature 1..70: note = hyper
  source 1..70: mol_type = genomic DNA

SEQ ID NO: 18615 - DNA, 200 bp, Homo sapiens; identical to SEQ ID NO: 7592
  misc_feature 1..200: note = chr4:156680770-156680970
  misc_feature 1..200: note = hyper
  source 1..200: mol_type = genomic DNA

SEQ ID NO: 18616 - DNA, 13 bp, Homo sapiens
  misc_feature 1..13: note = chr4:158142999-158143012
  misc_feature 1..13: note = hyper
  source 1..13: mol_type = genomic DNA
gaaggccagcgag

SEQ ID NO: 18617 - DNA, 74 bp, Homo sapiens
  misc_feature 1..74: note = chr4:158143369-158143443
  misc_feature 1..74: note = hyper
  source 1..74: mol_type = genomic DNA
gttggacaaatcccacgagggactgccggagcccagtggcctcctgccccagcagctgccgctctcgcccgctg

SEQ ID NO: 18618 - DNA, 30 bp, Homo sapiens; identical to SEQ ID NO: 7595
  misc_feature 1..30: note = chr4:158144242-158144272
  misc_feature 1..30: note = hyper
  source 1..30: mol_type = genomic DNA

SEQ ID NO: 18619 - DNA, 30 bp, Homo sapiens; identical to SEQ ID NO: 7598
  misc_feature 1..30: note = chr4:164264670-164264700
  misc_feature 1..30: note = hyper
  source 1..30: mol_type = genomic DNA

SEQ ID NO: 18620 - DNA, 98 bp, Homo sapiens; identical to SEQ ID NO: 2479
  misc_feature 1..98: note = chr4:164265532-164265630
  misc_feature 1..98: note = hyper
  source 1..98: mol_type = genomic DNA

SEQ ID NO: 18621 - DNA, 43 bp, Homo sapiens
  misc_feature 1..43: note = chr4:165304472-165304515
  misc_feature 1..43: note = hyper
  source 1..43: mol_type = genomic DNA
cgactcagggttgagcgcatcagcgctaaacccaagacaaagg

SEQ ID NO: 18622 - DNA, 61 bp, Homo sapiens
  misc_feature 1..61: note = chr4:165304578-165304639
  misc_feature 1..61: note = hyper
  source 1..61: mol_type = genomic DNA
cacactaggagcgcgtgagcctgtgaagtggctgtcatcgactccgcgctttccgaggggt

SEQ ID NO: 18623 - DNA, 27 bp, Homo sapiens
  misc_feature 1..27: note = chr4:165305163-165305190
  misc_feature 1..27: note = hyper
  source 1..27: mol_type = genomic DNA
ccggctctggctcggctccccagtcct

SEQ ID NO: 18624 - DNA, 61 bp, Homo sapiens; identical to SEQ ID NO: 7602
  misc_feature 1..61: note = chr4:166300073-166300134
  misc_feature 1..61: note = hyper
  source 1..61: mol_type = genomic DNA

SEQ ID NO: 18625 - DNA, 43 bp, Homo sapiens; identical to SEQ ID NO: 7603
  misc_feature 1..43: note = chr4:166300367-166300410
  misc_feature 1..43: note = hyper
  source 1..43: mol_type = genomic DNA

SEQ ID NO: 18626 - DNA, 30 bp, Homo sapiens; identical to SEQ ID NO: 7604
  misc_feature 1..30: note = chr4:166793825-166793855
  misc_feature 1..30: note = hyper
  source 1..30: mol_type = genomic DNA

SEQ ID NO: 18627 - DNA, 74 bp, Homo sapiens
  misc_feature 1..74: note = chr4:166794697-166794771
  misc_feature 1..74: note = hyper
  source 1..74: mol_type = genomic DNA
cggccgcgggaagttcggcagccagaaggacgacctggcaggctgcgagcgccagcgccgccagagccgagttt

SEQ ID NO: 18628 - DNA, 254 bp, Homo sapiens
  misc_feature 1..254: note = chr4:166794909-166795163
  misc_feature 1..254: note = hyper
  source 1..254: mol_type = genomic DNA
gtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacac

SEQ ID NO: 18629 - DNA, 53 bp, Homo sapiens
  misc_feature 1..53: note = chr4:166796212-166796265
  misc_feature 1..53: note = hyper
  source 1..53: mol_type = genomic DNA
gtaaaggttgcatggtggttggggctaacctagcagagcggtttgtaagcgga

SEQ ID NO: 18630 - DNA, 239 bp, Homo sapiens
  misc_feature 1..239: note = chr4:168155269-168155508
  misc_feature 1..239: note = hyper
  source 1..239: mol_type = genomic DNA
actgactgcaccaagcggctgcacacacacacagtacggctgacaccttgagcatctgggagaggagacacaacggggggtgggggggcatgtcagtgtcaaataaggggtacgaagccaggagcgaccctggaaaacatgcattagcaacgacgagggtagagggaggaggagacaagcagaggcaagcgtgtcccctccccgcaggctttacccccaaaagccgggcactcacacac

SEQ ID NO: 18631 - DNA, 98 bp, Homo sapiens; identical to SEQ ID NO: 2481
  misc_feature 1..98: note = chr4:172733771-172733869
  misc_feature 1..98: note = hyper
  source 1..98: mol_type = genomic DNA

SEQ ID NO: 18632 - DNA, 73 bp, Homo sapiens
  misc_feature 1..73: note = chr4:172734203-172734276
  misc_feature 1..73: note = hyper
  source 1..73: mol_type = genomic DNA
cagccgccgcgccccggctcgccgcgctcccgccggcaccatggaggaattcctgggacaaccgcctgcagcc

SEQ ID NO: 18633 - DNA, 115 bp, Homo sapiens; identical to SEQ ID NO: 404
  misc_feature 1..115: note = chr4:172734277-172734392
  misc_feature 1..115: note = hyper
  source 1..115: mol_type = genomic DNA

SEQ ID NO: 18634 - DNA, 10 bp, Homo sapiens
  misc_feature 1..10: note = chr4:174429648-174429658
  misc_feature 1..10: note = hyper
  source 1..10: mol_type = genomic DNA
cggacctctg

SEQ ID NO: 18635 - DNA, 30 bp, Homo sapiens; identical to SEQ ID NO: 7615
  misc_feature 1..30: note = chr4:174438209-174438239
  misc_feature 1..30: note = hyper
  source 1..30: mol_type = genomic DNA

SEQ ID NO: 18636 - DNA, 12 bp, Homo sapiens
  misc_feature 1..12: note = chr4:174443551-174443563
  misc_feature 1..12: note = hyper
  source 1..12: mol_type = genomic DNA
agatgtccctaa

SEQ ID NO: 18637 - DNA, 30 bp, Homo sapiens; identical to SEQ ID NO: 7623
  misc_feature 1..30: note = chr4:174459927-174459957
  misc_feature 1..30: note = hyper
  source 1..30: mol_type = genomic DNA

SEQ ID NO: 18638 - DNA, 29 bp, Homo sapiens
  misc_feature 1..29: note = chr4:175134868-175134897
  misc_feature 1..29: note = hyper
  source 1..29: mol_type = genomic DNA
cctctgggtccttaccgaaagggaaggtc

SEQ ID NO: 18639 - DNA, 16 bp, Homo sapiens
  misc_feature 1..16: note = chr4:175135672-175135688
  misc_feature 1..16: note = hyper
  source 1..16: mol_type = genomic DNA
gcggcagtgaggctgg

SEQ ID NO: 18640 - DNA, 30 bp, Homo sapiens; identical to SEQ ID NO: 7627
  misc_feature 1..30: note = chr4:175137723-175137753
  misc_feature 1..30: note = hyper
  source 1..30: mol_type = genomic DNA

SEQ ID NO: 18641 - DNA, 223 bp, Homo sapiens
  misc_feature 1..223: note = chr4:175138546-175138769
  misc_feature 1..223: note = hyper
  source 1..223: mol_type = genomic DNA
ggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggct

SEQ ID NO: 18642 - DNA, 79 bp, Homo sapiens
  misc_feature 1..79: note = chr4:175139254-175139333
  misc_feature 1..79: note = hyper
  source 1..79: mol_type = genomic DNA
tgaatcttcccagttccttccctgtttatttctcaacccagcagttcaaaaattcactttataacggtcccctaacaaa

SEQ ID NO: 18643 - DNA, 192 bp, Homo sapiens
  misc_feature 1..192: note = chr4:175750264-175750456
  misc_feature 1..192: note = hyper
  source 1..192: mol_type = genomic DNA
caaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggt

SEQ ID NO: 18644 - DNA, 57 bp, Homo sapiens; identical to SEQ ID NO: 7632
  misc_feature 1..57: note = chr4:176923024-176923081
  misc_feature 1..57: note = hyper
  source 1..57: mol_type = genomic DNA

SEQ ID NO: 18645 - DNA, 20 bp, Homo sapiens
  misc_feature 1..20: note = chr4:176923082-176923102
  misc_feature 1..20: note = hyper
  source 1..20: mol_type = genomic DNA
ctattcggatcctgggtctc

SEQ ID NO: 18646 - DNA, 22 bp, Homo sapiens
  misc_feature 1..22: note = chr4:176923402-176923424
  misc_feature 1..22: note = hyper
  source 1..22: mol_type = genomic DNA
gcccattcccgaggccgagcct

SEQ ID NO: 18647 - DNA, 85 bp, Homo sapiens
  misc_feature 1..85: note = chr4:176923558-176923643
  misc_feature 1..85: note = hyper
  source 1..85: mol_type = genomic DNA
cgccctggcaagtgacagcctcgcccctcccagcggagacaactcgcagggcgcctggcgactctgcgggcgcacagacccctcc

SEQ ID NO: 18648 - DNA, 124 bp, Homo sapiens; identical to SEQ ID NO: 2495
  misc_feature 1..124: note = chr4:176987050-176987174
  misc_feature 1..124: note = hyper
  source 1..124: mol_type = genomic DNA

SEQ ID NO: 18649 - skipped

SEQ ID NO: 18650 - DNA, 107 bp, Homo sapiens; identical to SEQ ID NO: 2497
  misc_feature 1..107: note = chr4:176987206-176987313
  misc_feature 1..107: note = hyper
  source 1..107: mol_type = genomic DNA

SEQ ID NO: 18651 - DNA, 10 bp, Homo sapiens
  misc_feature 1..10: note = chr4:176987314-176987324
  misc_feature 1..10: note = hyper
  source 1..10: mol_type = genomic DNA
agaggggctc

SEQ ID NO: 18652 - DNA, 530 bp, Homo sapiens; identical to SEQ ID NO: 7640
  misc_feature 1..530: note = chr4:177713662-177714192
  misc_feature 1..530: note = hyper
  source 1..530: mol_type = genomic DNA

SEQ ID NO: 18653 - DNA, 30 bp, Homo sapiens; identical to SEQ ID NO: 7641
  misc_feature 1..30: note = chr4:180979304-180979334
  misc_feature 1..30: note = hyper
  source 1..30: mol_type = genomic DNA

SEQ ID NO: 18654 - DNA, 91 bp, Homo sapiens; identical to SEQ ID NO: 7642
  misc_feature 1..91: note = chr4:183062455-183062546
  misc_feature 1..91: note = hyper
  source 1..91: mol_type = genomic DNA

SEQ ID NO: 18655 - DNA, 30 bp, Homo sapiens; identical to SEQ ID NO: 7645
  misc_feature 1..30: note = chr4:183065138-183065168
  misc_feature 1..30: note = hyper
  source 1..30: mol_type = genomic DNA

SEQ ID NO: 18656 - DNA, 33 bp, Homo sapiens; identical to SEQ ID NO: 7648
  misc_feature 1..33: note = chr4:184826624-184826657
  misc_feature 1..33: note = hyper
  source 1..33: mol_type = genomic DNA

SEQ ID NO: 18657 - DNA, 29 bp, Homo sapiens
  misc_feature 1..29: note = chr4:185937889-185937918
  misc_feature 1..29: note = hyper
  source 1..29: mol_type = genomic DNA
caggcctggctctgcgccctgaggctccc

SEQ ID NO: 18658 - DNA, 154 bp, Homo sapiens
  misc_feature 1..154: note = chr4:185938343-185938497
  misc_feature 1..154: note = hyper
  source 1..154: mol_type = genomic DNA
ccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattga

SEQ ID NO: 18659 - DNA, 170 bp, Homo sapiens
  misc_feature 1..170: note = chr4:185938564-185938734
  misc_feature 1..170: note = hyper
  source 1..170: mol_type = genomic DNA
aaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgt

SEQ ID NO: 18660 - DNA, 212 bp, Homo sapiens; identical to SEQ ID NO: 7652
  misc_feature 1..212: note = chr4:185939694-185939906
  misc_feature 1..212: note = hyper
  source 1..212: mol_type = genomic DNA

SEQ ID NO: 18661 - DNA, 44 bp, Homo sapiens
  misc_feature 1..44: note = chr4:185940294-185940338
  misc_feature 1..44: note = hyper
  source 1..44: mol_type = genomic DNA
ctgcctggaggctggcggccacctccccaaaggcctgggtaggg

SEQ ID NO: 18662 - DNA, 25 bp, Homo sapiens
  misc_feature 1..25: note = chr4:185941560-185941585
  misc_feature 1..25: note = hyper
  source 1..25: mol_type = genomic DNA
ttgcagtccaaggcccgcctgggcg

SEQ ID NO: 18663 - DNA, 174 bp, Homo sapiens
  misc_feature 1..174: note = chr4:185942760-185942934
  misc_feature 1..174: note = hyper
  source 1..174: mol_type = genomic DNA
ccttaggggattgttccctacacgccatcctttaccattcggacactggtgcaggatggagaccctggggtctccgtttaagttctcaggcttggagagaaaagtcctccttatcctttccccagtgagatttttttttttatctcgccccacccagaacgtggtgaggaaagt

SEQ ID NO: 18664 - DNA, 40 bp, Homo sapiens; identical to SEQ ID NO: 7657
  misc_feature 1..40: note = chr4:186048748-186048788
  misc_feature 1..40: note = hyper
  source 1..40: mol_type = genomic DNA

SEQ ID NO: 18665 - DNA, 70 bp, Homo sapiens; identical to SEQ ID NO: 7658
  misc_feature 1..70: note = chr4:186049492-186049562
  misc_feature 1..70: note = hyper
  source 1..70: mol_type = genomic DNA

SEQ ID NO: 18666 - DNA, 57 bp, Homo sapiens; identical to SEQ ID NO: 7659
  misc_feature 1..57: note = chr4:186049764-186049821
  misc_feature 1..57: note = hyper
  source 1..57: mol_type = genomic DNA

SEQ ID NO: 18667 - DNA, 61 bp, Homo sapiens; identical to SEQ ID NO: 7660
  misc_feature 1..61: note = chr5:53500-53561
  misc_feature 1..61: note = hyper
  source 1..61: mol_type = genomic DNA

SEQ ID NO: 18668 - DNA, 30 bp, Homo sapiens; identical to SEQ ID NO: 7662
  misc_feature 1..30: note = chr5:54402-54432
  misc_feature 1..30: note = hyper
  source 1..30: mol_type = genomic DNA

SEQ ID NO: 18669 - DNA, 74 bp, Homo sapiens; identical to SEQ ID NO: 7663
  misc_feature 1..74: note = chr5:92039-92113
  misc_feature 1..74: note = hyper
  source 1..74: mol_type = genomic DNA

SEQ ID NO: 18670 - DNA, 352 bp, Homo sapiens
  misc_feature 1..352: note = chr5:320982-321334
  misc_feature 1..352: note = hyper
  source 1..352: mol_type = genomic DNA
ccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagc

SEQ ID NO: 18671 - DNA, 76 bp, Homo sapiens
  misc_feature 1..76: note = chr5:374266-374342
  misc_feature 1..76: note = hyper
  source 1..76: mol_type = genomic DNA
tgtgcccccacccgcgctgccccagcccgcggacctcggcggggagcgcccagggccagcacgggggtctcacggg

SEQ ID NO: 18672 - DNA, 82 bp, Homo sapiens; identical to SEQ ID NO: 7667
  misc_feature 1..82: note = chr5:524772-524854
  misc_feature 1..82: note = hyper
  source 1..82: mol_type = genomic DNA

SEQ ID NO: 18673 - DNA, 23 bp, Homo sapiens
  misc_feature 1..23: note = chr5:1294607-1294630
  misc_feature 1..23: note = hyper
  source 1..23: mol_type = genomic DNA
cagtgcgtcggtcaccgtgttgg

SEQ ID NO: 18674 - DNA, 264 bp, Homo sapiens
  misc_feature 1..264: note = chr5:1294767-1295031
  misc_feature 1..264: note = hyper
  source 1..264: mol_type = genomic DNA
ttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtgg

SEQ ID NO: 18675 - DNA, 17 bp, Homo sapiens
  misc_feature 1..17: note = chr5:1295662-1295679
  misc_feature 1..17: note = hyper
  source 1..17: mol_type = genomic DNA
tccgggcaccacgaatg

SEQ ID NO: 18676 - DNA, 52 bp, Homo sapiens; identical to SEQ ID NO: 7670
  misc_feature 1..52: note = chr5:1444711-1444763
  misc_feature 1..52: note = hyper
  source 1..52: mol_type = genomic DNA

SEQ ID NO: 18677 - DNA, 14 bp, Homo sapiens
  misc_feature 1..14: note = chr5:1445157-1445171
  misc_feature 1..14: note = hyper
  source 1..14: mol_type = genomic DNA
agccatagacaccc

SEQ ID NO: 18678 - DNA, 26 bp, Homo sapiens
  misc_feature 1..26: note = chr5:1445928-1445954
  misc_feature 1..26: note = hyper
  source 1..26: mol_type = genomic DNA
gcggctgcgcgcggggaactgctggg

SEQ ID NO: 18679 - DNA, 83 bp, Homo sapiens
  misc_feature 1..83: note = chr5:1446236-1446319
  misc_feature 1..83: note = hyper
  source 1..83: mol_type = genomic DNA
cgcactcgcctaagaaaaccatttcccgggacgggcctggaaagccctggcggttggtatccggctccagggccgaatggact

SEQ ID NO: 18680 - DNA, 214 bp, Homo sapiens; identical to SEQ ID NO: 7674
  misc_feature 1..214: note = chr5:1667861-1668075
  misc_feature 1..214: note = hyper
  source 1..214: mol_type = genomic DNA

SEQ ID NO: 18681 - DNA, 133 bp, Homo sapiens; identical to SEQ ID NO: 7675
  misc_feature 1..133: note = chr5:1851756-1851889
  misc_feature 1..133: note = hyper
  source 1..133: mol_type = genomic DNA

SEQ ID NO: 18682 - DNA, 354 bp, Homo sapiens
  misc_feature 1..354: note = chr5:1875099-1875453
  misc_feature 1..354: note = hyper
  source 1..354: mol_type = genomic DNA
aacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagcca

SEQ ID NO: 18683 - DNA, 45 bp, Homo sapiens
  misc_feature 1..45: note = chr5:1875497-1875542
  misc_feature 1..45: note = hyper
  source 1..45: mol_type = genomic DNA
ccaagggaagggtgtgggggaagcgcccagcgaggggatgccatt

SEQ ID NO: 18684 - DNA, 41 bp, Homo sapiens
  misc_feature 1..41: note = chr5:1875829-1875870
  misc_feature 1..41: note = hyper
  source 1..41: mol_type = genomic DNA
ggggctgcagagccccgccaggctgcccgcggccgggagcg

SEQ ID NO: 18685 - DNA, 49 bp, Homo sapiens
  misc_feature 1..49: note = chr5:1878528-1878577
  misc_feature 1..49: note = hyper
  source 1..49: mol_type = genomic DNA
ccagggaccagatgcgcggcttagcctccaggcctgccgacgcccccgc

SEQ ID NO: 18686 - DNA, 67 bp, Homo sapiens
  misc_feature 1..67: note = chr5:1879538-1879605
  misc_feature 1..67: note = hyper
  source 1..67: mol_type = genomic DNA
aagacgtcctagaaccgcagagaaggcactgtgcctgcactccagggcctcagcccccagtgacaac

SEQ ID NO: 18687 - DNA, 239 bp, Homo sapiens
  misc_feature 1..239: note = chr5:1882605-1882844
  misc_feature 1..239: note = hyper
  source 1..239: mol_type = genomic DNA
tagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggag

SEQ ID NO: 18688 - DNA, 85 bp, Homo sapiens
  misc_feature 1..85: note = chr5:1883430-1883515
  misc_feature 1..85: note = hyper
  source 1..85: mol_type = genomic DNA
cagttaaaattagcccggcgctgcgcaggcggccggcccggcctcgcgctggcgcgctctgctccgagtggcaggaaggggctcg

SEQ ID NO: 18689 - DNA, 299 bp, Homo sapiens
  misc_feature 1..299: note = chr5:1883879-1884178
  misc_feature 1..299: note = hyper
  source 1..299: mol_type = genomic DNA
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggacct

SEQ ID NO: 18690 - DNA, 33 bp, Homo sapiens
  misc_feature 1..33: note = chr5:1884698-1884731
  misc_feature 1..33: note = hyper
  source 1..33: mol_type = genomic DNA
attcagacagtttagcgtcggtagccgcgagaa

SEQ ID NO: 18691 - DNA, 160 bp, Homo sapiens; identical to SEQ ID NO: 7691
  misc_feature 1..160: note = chr5:1886379-1886539
  misc_feature 1..160: note = hyper
  source 1..160: mol_type = genomic DNA

SEQ ID NO: 18692 - DNA, 73 bp, Homo sapiens
  misc_feature 1..73: note = chr5:1886739-1886812
  misc_feature 1..73: note = hyper
  source 1..73: mol_type = genomic DNA
cttgctccctgggtacggcctgaggctggacggagcgccgtccgggcgtccaggactcaggcctggccactcc

SEQ ID NO: 18693 - DNA, 19 bp, Homo sapiens
  misc_feature 1..19: note = chr5:1887737-1887756
  misc_feature 1..19: note = hyper
  source 1..19: mol_type = genomic DNA
cctccgaggtcttagtatt

SEQ ID NO: 18694 - DNA, 212 bp, Homo sapiens
  misc_feature 1..212: note = chr5:1931754-1931966
  misc_feature 1..212: note = hyper
  source 1..212: mol_type = genomic DNA
tttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgt

SEQ ID NO: 18695 - DNA, 266 bp, Homo sapiens
  misc_feature 1..266: note = chr5:2038439-2038705
  misc_feature 1..266: note = hyper
  source 1..266: mol_type = genomic DNA
cggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagcc

SEQ ID NO: 18696 - DNA, 13 bp, Homo sapiens
  misc_feature 1..13: note = chr5:2038850-2038863
  misc_feature 1..13: note = hyper
  source 1..13: mol_type = genomic DNA
tcaggatctgacc

SEQ ID NO: 18697 - DNA, 28 bp, Homo sapiens
  misc_feature 1..28: note = chr5:2738820-2738848
  misc_feature 1..28: note = hyper
  source 1..28: mol_type = genomic DNA
ccacccccagccgcacgcttgggcctcc

SEQ ID NO: 18698 - DNA, 31 bp, Homo sapiens
  misc_feature 1..31: note = chr5:2743713-2743744
  misc_feature 1..31: note = hyper
  source 1..31: mol_type = genomic DNA
ctgctcctggtcgccccgttttgccgacgtc

SEQ ID NO: 18699 - DNA, 21 bp, Homo sapiens
  misc_feature 1..21: note = chr5:2748353-2748374
  misc_feature 1..21: note = hyper
  source 1..21: mol_type = genomic DNA
cctggatcttcttcccggacc

SEQ ID NO: 18700 - DNA, 43 bp, Homo sapiens
  misc_feature 1..43: note = chr5:2751894-2751937
  misc_feature 1..43: note = hyper
  source 1..43: mol_type = genomic DNA
ccgcccgctgcagcctccgggccgcggccgggggaggggcaga

SEQ ID NO: 18701 - DNA, 200 bp, Homo sapiens; identical to SEQ ID NO: 7711
  misc_feature 1..200: note = chr5:2752242-2752442
  misc_feature 1..200: note = hyper
  source 1..200: mol_type = genomic DNA

SEQ ID NO: 18702 - DNA, 93 bp, Homo sapiens
  misc_feature 1..93: note = chr5:2752898-2752991
  misc_feature 1..93: note = hyper
  source 1..93: mol_type = genomic DNA
ggggcggttgccttgcggggctcagaagcgaggcggttggcgagggttcctaggaccccagcttcctagaaccctctccccatcacgcttctc

SEQ ID NO: 18703 - skipped

SEQ ID NO: 18704 - DNA, 114 bp, Homo sapiens
  misc_feature 1..114: note = chr5:2753078-2753192
  misc_feature 1..114: note = hyper
  source 1..114: mol_type = genomic DNA
aagagtgtcaggtctgtgctggcctattgggagcacccacccagcaggtgcctctatcctcggaagccgtctcgggtgggtgcggtggagaagagagagcgcagtggcctgggg

SEQ ID NO: 18705 - DNA, 30 bp, Homo sapiens; identical to SEQ ID NO: 7713
  misc_feature 1..30: note = chr5:2754590-2754620
  misc_feature 1..30: note = hyper
  source 1..30: mol_type = genomic DNA

SEQ ID NO: 18706 - DNA, 135 bp, Homo sapiens
  misc_feature 1..135: note = chr5:2756464-2756599
  misc_feature 1..135: note = hyper
  source 1..135: mol_type = genomic DNA
aattctccagcatctcgccgactccgtctctaccctcctctccttcctaatctcgcgctggcttcgcccttttctctctcctcctccttcctacgcgccccgccccctccccccaggtcgcacctctccccgccc

SEQ ID NO: 18707 - DNA, 30 bp, Homo sapiens; identical to SEQ ID NO: 7718
  misc_feature 1..30: note = chr5:3122164-3122194
  misc_feature 1..30: note = hyper
  source 1..30: mol_type = genomic DNA

SEQ ID NO: 18708 - DNA, 41 bp, Homo sapiens; identical to SEQ ID NO: 7719
  misc_feature 1..41: note = chr5:3197756-3197797
  misc_feature 1..41: note = hyper
  source 1..41: mol_type = genomic DNA

SEQ ID NO: 18709 - DNA, 123 bp, Homo sapiens; identical to SEQ ID NO: 7721
  misc_feature 1..123: note = chr5:3591143-3591266
  misc_feature 1..123: note = hyper
  source 1..123: mol_type = genomic DNA

SEQ ID NO: 18710 - DNA, 21 bp, Homo sapiens
  misc_feature 1..21: note = chr5:3600732-3600753
  misc_feature 1..21: note = hyper
  source 1..21: mol_type = genomic DNA
cgtccccaggccagattcgcc

SEQ ID NO: 18711 - DNA, 34 bp, Homo sapiens; identical to SEQ ID NO: 7727
  misc_feature 1..34: note = chr5:3606775-3606809
  misc_feature 1..34: note = hyper
  source 1..34: mol_type = genomic DNA

SEQ ID NO: 18712 - DNA, 30 bp, Homo sapiens; identical to SEQ ID NO: 7728
  misc_feature 1..30: note = chr5:3607118-3607148
  misc_feature 1..30: note = hyper
  source 1..30: mol_type = genomic DNA

SEQ ID NO: 18713 - DNA, 100 bp, Homo sapiens
  misc_feature 1..100: note = chr5:5139900-5140000
  misc_feature 1..100: note = hyper
  source 1..100: mol_type = genomic DNA
cacagctgtgcccgggcacagaggcgcggccagaccgcactccgcgggctgcaggtgtcccggcctctggcggcgccggtgcggcccggaggtgggagcc

SEQ ID NO: 18714 - DNA, 137 bp, Homo sapiens; identical to SEQ ID NO: 7730
  misc_feature 1..137: note = chr5:5140031-5140168
  misc_feature 1..137: note = hyper
  source 1..137: mol_type = genomic DNA

SEQ ID NO: 18715 - DNA, 18 bp, Homo sapiens
  misc_feature 1..18: note = chr5:5140438-5140456
  misc_feature 1..18: note = hyper
  source 1..18: mol_type = genomic DNA
cttcagtaataaccccgg

SEQ ID NO: 18716 - DNA, 103 bp, Homo sapiens
  misc_feature 1..103: note = chr5:5140527-5140630
  misc_feature 1..103: note = hyper
  source 1..103: mol_type = genomic DNA
cgctgccggccggggaccctccggtggcccctagcccctcggagcgctcctggatgaagccccgcgcgcgcggatggcggggcttggcggcgctgtggatgct

SEQ ID NO: 18717 - DNA, 192 bp, Homo sapiens
  misc_feature 1..192: note = chr5:6448738-6448930
  misc_feature 1..192: note = hyper
  source 1..192: mol_type = genomic DNA
gcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggt

SEQ ID NO: 18718 - DNA, 272 bp, Homo sapiens
  misc_feature 1..272: note = chr5:6583189-6583461
  misc_feature 1..272: note = hyper
  source 1..272: mol_type = genomic DNA
cccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaa

SEQ ID NO: 18719 - DNA, 30 bp, Homo sapiens; identical to SEQ ID NO: 7736
  misc_feature 1..30: note = chr5:6687127-6687157
  misc_feature 1..30: note = hyper
  source 1..30: mol_type = genomic DNA

SEQ ID NO: 18720 - skipped

SEQ ID NO: 18721 - DNA, 49 bp, Homo sapiens; identical to SEQ ID NO: 7740
  misc_feature 1..49: note = chr5:7396986-7397035
  misc_feature 1..49: note = hyper
  source 1..49: mol_type = genomic DNA

SEQ ID NO: 18722 - DNA, 53 bp, Homo sapiens
  misc_feature 1..53: note = chr5:7850962-7851015
  misc_feature 1..53: note = hyper
  source 1..53: mol_type = genomic DNA
tccgcgcccagtccgcggtcctcacccgcgccgggcggtagtagtagctgtgc

SEQ ID NO: 18723 - DNA, 18 bp, Homo sapiens
  misc_feature 1..18: note = chr5:7851121-7851139
  misc_feature 1..18: note = hyper
  source 1..18: mol_type = genomic DNA
cgtcgtcctccatgccgc

SEQ ID NO: 18724 - DNA, 70 bp, Homo sapiens
  misc_feature 1..70: note = chr5:10333618-10333688
  misc_feature 1..70: note = hyper
  source 1..70: mol_type = genomic DNA
tgcgtcctgggtgggcgcgatgctcccccagaacgactggagatggagagtgtcggggagggaaacggga

SEQ ID NO: 18725 - DNA, 31 bp, Homo sapiens; identical to SEQ ID NO: 428
  misc_feature 1..31: note = chr5:10564628-10564659
  misc_feature 1..31: note = hyper
  source 1..31: mol_type = genomic DNA

SEQ ID NO: 18726 - DNA, 221 bp, Homo sapiens
  misc_feature 1..221: note = chr5:10564800-10565021
  misc_feature 1..221: note = hyper
  source 1..221: mol_type = genomic DNA
cgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcct

SEQ ID NO: 18727 - DNA, 15 bp, Homo sapiens
  misc_feature 1..15: note = chr5:10565607-10565622
  misc_feature 1..15: note = hyper
  source 1..15: mol_type = genomic DNA
cggggctccccagag

SEQ ID NO: 18728 - DNA, 28 bp, Homo sapiens
  misc_feature 1..28: note = chr5:11385363-11385391
  misc_feature 1..28: note = hyper
  source 1..28: mol_type = genomic DNA
cacgcgcacttagcgagggagaagcaca

SEQ ID NO: 18729 - DNA, 180 bp, Homo sapiens; identical to SEQ ID NO: 7749
  misc_feature 1..180: note = chr5:11903545-11903725
  misc_feature 1..180: note = hyper
  source 1..180: mol_type = genomic DNA

SEQ ID NO: 18730 - DNA, 30 bp, Homo sapiens; identical to SEQ ID NO: 7754
  misc_feature 1..30: note = chr5:11904962-11904992
  misc_feature 1..30: note = hyper
  source 1..30: mol_type = genomic DNA

SEQ ID NO: 18731 - DNA, 30 bp, Homo sapiens; identical to SEQ ID NO: 7755
  misc_feature 1..30: note = chr5:15500979-15501009
  misc_feature 1..30: note = hyper
  source 1..30: mol_type = genomic DNA

SEQ ID NO: 18732 - DNA, 30 bp, Homo sapiens; identical to SEQ ID NO: 7756
  misc_feature 1..30: note = chr5:15501264-15501294
  misc_feature 1..30: note = hyper
  source 1..30: mol_type = genomic DNA

SEQ ID NO: 18733 - DNA, 61 bp, Homo sapiens
  misc_feature 1..61: note = chr5:16180260-16180321
  misc_feature 1..61: note = hyper
  source 1..61: mol_type = genomic DNA
cgggccgggtggggcgcgacagtctgagccgagacccgcgtgggcttaagggtgcgcgagg

SEQ ID NO: 18734 - DNA, 53 bp, Homo sapiens; identical to SEQ ID NO: 2541
  misc_feature 1..53: note = chr5:16180371-16180424
  misc_feature 1..53: note = hyper
  source 1..53: mol_type = genomic DNA

SEQ ID NO: 18735 - DNA, 43 bp, Homo sapiens; identical to SEQ ID NO: 7761
  misc_feature 1..43: note = chr5:17216867-17216910
  misc_feature 1..43: note = hyper
  source 1..43: mol_type = genomic DNA

SEQ ID NO: 18736 - DNA, 16 bp, Homo sapiens
  misc_feature 1..16: note = chr5:17217708-17217724
  misc_feature 1..16: note = hyper
  source 1..16: mol_type = genomic DNA
atgcagaggctgcagc

SEQ ID NO: 18737 - DNA, 81 bp, Homo sapiens; identical to SEQ ID NO: 7763
  misc_feature 1..81: note = chr5:17217784-17217865
  misc_feature 1..81: note = hyper
  source 1..81: mol_type = genomic DNA

SEQ ID NO: 18738 - DNA, 49 bp, Homo sapiens; identical to SEQ ID NO: 7764
  misc_feature 1..49: note = chr5:17217991-17218040
  misc_feature 1..49: note = hyper
  source 1..49: mol_type = genomic DNA

SEQ ID NO: 18739 - DNA, 276 bp, Homo sapiens; identical to SEQ ID NO: 7765
  misc_feature 1..276: note = chr5:17218658-17218934
  misc_feature 1..276: note = hyper
  source 1..276: mol_type = genomic DNA

SEQ ID NO: 18740 - DNA, 16 bp, Homo sapiens
  misc_feature 1..16: note = chr5:17219018-17219034
  misc_feature 1..16: note = hyper
  source 1..16: mol_type = genomic DNA
tcggtggacagccctt

SEQ ID NO: 18741 - DNA, 121 bp, Homo sapiens; identical to SEQ ID NO: 2542
  misc_feature 1..121: note = chr5:22853104-22853225
  misc_feature 1..121: note = hyper
  source 1..121: mol_type = genomic DNA

SEQ ID NO: 18742 - DNA, 270 bp, Homo sapiens; identical to SEQ ID NO: 7769
  misc_feature 1..270: note = chr5:31855221-31855491
  misc_feature 1..270: note = hyper
  source 1..270: mol_type = genomic DNA

SEQ ID NO: 18743 - DNA, 66 bp, Homo sapiens; identical to SEQ ID NO: 7770
  misc_feature 1..66: note = chr5:32710234-32710300
  misc_feature 1..66: note = hyper
  source 1..66: mol_type = genomic DNA

SEQ ID NO: 18744 - DNA, 183 bp, Homo sapiens; identical to SEQ ID NO: 7771
  misc_feature 1..183: note = chr5:32710598-32710781
  misc_feature 1..183: note = hyper
  source 1..183: mol_type = genomic DNA

SEQ ID NO: 18745 - DNA, 61 bp, Homo sapiens
  misc_feature 1..61: note = chr5:32711765-32711826
  misc_feature 1..61: note = hyper
  source 1..61: mol_type = genomic DNA
aagcgcccaagggggcgcagggaccttggagagaagagtggggaggaaagaggaagggtgg

SEQ ID NO: 18746 - DNA, 273 bp, Homo sapiens
  misc_feature 1..273: note = chr5:32712491-32712764
  misc_feature 1..273: note = hyper
  source 1..273: mol_type = genomic DNA
tacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgg

SEQ ID NO: 18747 - DNA, 29 bp, Homo sapiens
  misc_feature 1..29: note = chr5:33892054-33892083
  misc_feature 1..29: note = hyper
  source 1..29: mol_type = genomic DNA
gggtgcatggtcaggcgcgagaaggcagc

SEQ ID NO: 18748 - DNA, 298 bp, Homo sapiens
  misc_feature 1..298: note = chr5:33892115-33892413
  misc_feature 1..298: note = hyper
  source 1..298: mol_type = genomic DNA
tttttaagcagaaaggagctagacacctttttcccctccctcctcctaaaaggggagtgattcagctgacagtgtccgctttcggcggggtgtggaatgggccagagcgggagggcgcagcccaccccggtccccacccctccgcctcccgcatgccccgcggcctcgcagcccgcccgctcggtgcatcttcctcccggactcccacccccgcgctcctccggccccgccccgaacgccaggcccagctggccgagccggccaaataggggagacccgggagagccgccctgggagg

SEQ ID NO: 18749 - DNA, 106 bp, Homo sapiens
  misc_feature 1..106: note = chr5:33892443-33892549
  misc_feature 1..106: note = hyper
  source 1..106: mol_type = genomic DNA
caggccagccccccggcgtgcttaaatacaagctcaaaatgaggagaacagagttgaggcagaggggggccccactccctccatccttccgcgctcagcgctgccc

SEQ ID NO: 18750 - DNA, 26 bp, Homo sapiens
  misc_feature 1..26: note = chr5:33936336-33936362
  misc_feature 1..26: note = hyper
  source 1..26: mol_type = genomic DNA
acccactgacctccaggaagctgagc

SEQ ID NO: 18751 - DNA, 123 bp, Homo sapiens
  misc_feature 1..123: note = chr5:33936363-33936486
  misc_feature 1..123: note = hyper
  source 1..123: mol_type = genomic DNA
tggtggatggaactctacgatctctttctctccaaggacggaaacctcatccaagcagtcccagaggaaacggataaaggtatttgaaagggagcgagcggccccaaatcgcacaattgagcg

SEQ ID NO: 18752 - DNA, 133 bp, Homo sapiens; identical to SEQ ID NO: 7780
  misc_feature 1..133: note = chr5:36690192-36690325
  misc_feature 1..133: note = hyper
  source 1..133: mol_type = genomic DNA

SEQ ID NO: 18753 - DNA, 12 bp, Homo sapiens
  misc_feature 1..12: note = chr5:37834672-37834684
  misc_feature 1..12: note = hyper
  source 1..12: mol_type = genomic DNA
gtgcggggctgg

SEQ ID NO: 18754 - DNA, 23 bp, Homo sapiens
  misc_feature 1..23: note = chr5:37834714-37834737
  misc_feature 1..23: note = hyper
  source 1..23: mol_type = genomic DNA
gcggcccccccgcggggagggaa

SEQ ID NO: 18755 - DNA, 385 bp, Homo sapiens
  misc_feature 1..385: note = chr5:37837992-37838377
  misc_feature 1..385: note = hyper
  source 1..385: mol_type = genomic DNA
ctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagaga

SEQ ID NO: 18756 - DNA, 30 bp, Homo sapiens; identical to SEQ ID NO: 7784
  misc_feature 1..30: note = chr5:37839237-37839267
  misc_feature 1..30: note = hyper
  source 1..30: mol_type = genomic DNA

SEQ ID NO: 18757 - DNA, 95 bp, Homo sapiens
  misc_feature 1..95: note = chr5:37840125-37840220
  misc_feature 1..95: note = hyper
  source 1..95: mol_type = genomic DNA
gcgccaggagcgcaggctggtcttctagagcccgggctgggggtccggggtccggggtgggggaggggaggcgcggggccccgggagggaggggt

SEQ ID NO: 18758 - DNA, 96 bp, Homo sapiens; identical to SEQ ID NO: 2551
  misc_feature 1..96: note = chr5:37840267-37840363
  misc_feature 1..96: note = hyper
  source 1..96: mol_type = genomic DNA

SEQ ID NO: 18759 - DNA, 34 bp, Homo sapiens
  misc_feature 1..34: note = chr5:38257451-38257485
  misc_feature 1..34: note = hyper
  source 1..34: mol_type = genomic DNA
agccaggacgcccaccgagtcctggcagcgttgc

SEQ ID NO: 18760 - DNA, 496 bp, Homo sapiens; identical to SEQ ID NO: 7793
  misc_feature 1..496: note = chr5:38258174-38258670
  misc_feature 1..496: note = hyper
  source 1..496: mol_type = genomic DNA

SEQ ID NO: 18761 - DNA, 144 bp, Homo sapiens; identical to SEQ ID NO: 7794
  misc_feature 1..144: note = chr5:38258671-38258815
  misc_feature 1..144: note = hyper
  source 1..144: mol_type = genomic DNA

SEQ ID NO: 18762 - DNA, 123 bp, Homo sapiens; identical to SEQ ID NO: 7795
  misc_feature 1..123: note = chr5:38556551-38556674
  misc_feature 1..123: note = hyper
  source 1..123: mol_type = genomic DNA

SEQ ID NO: 18763 - DNA, 30 bp, Homo sapiens; identical to SEQ ID NO: 7796
  misc_feature 1..30: note = chr5:39425493-39425523
  misc_feature 1..30: note = hyper
  source 1..30: mol_type = genomic DNA

SEQ ID NO: 18764 - DNA, 150 bp, Homo sapiens
  misc_feature 1..150: note = chr5:42424672-42424822
  misc_feature 1..150: note = hyper
  source 1..150: mol_type = genomic DNA
tgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcg

SEQ ID NO: 18765 - DNA, 99 bp, Homo sapiens
  misc_feature 1..99: note = chr5:42425060-42425159
  misc_feature 1..99: note = hyper
  source 1..99: mol_type = genomic DNA
ggtgtgcagggtggaagaggccacagaggtgccgcctgtctgtttgtgccgccaggagaccttggaagggacagagaaaggtaacggaaggccaaagtg

SEQ ID NO: 18766 - DNA, 40 bp, Homo sapiens
  misc_feature 1..40: note = chr5:42991785-42991825
  misc_feature 1..40: note = hyper
  source 1..40: mol_type = genomic DNA
tggaggagccaaatccgtcccattctggatccttattcca

SEQ ID NO: 18767 - DNA, 87 bp, Homo sapiens
  misc_feature 1..87: note = chr5:42992934-42993021
  misc_feature 1..87: note = hyper
  source 1..87: mol_type = genomic DNA
accccgcagattcgtctgtcgttggcttgttggtcctaacaagtttcgatttcagggtgcctgcgtttctttttcttttctcttctt

SEQ ID NO: 18768 - DNA, 118 bp, Homo sapiens
  misc_feature 1..118: note = chr5:43007818-43007936
  misc_feature 1..118: note = hyper
  source 1..118: mol_type = genomic DNA
taagcatgcctgctgcggattaagagcgcgcatgcgcactgggggaatgggatggagccacccgggattctcgccttatacaaacagggaacccagcctccttagctttcatataaaa

SEQ ID NO: 18769 - DNA, 236 bp, Homo sapiens
  misc_feature 1..236: note = chr5:43007966-43008202
  misc_feature 1..236: note = hyper
  source 1..236: mol_type = genomic DNA
ggcaacctgctttcaggacccttgttttttatgagagctttcgtttacgcttaataaattctactccactcactcttcgatatccgcgtgcccacttcctcctgatcgtgagacaaggacccggatatagctgagcttagaagcaaaaatcctgcatcaatagcaaatgcggacactgaacgactagcggagtacccagcggcaaactttagtttttggtgcagttaaggtattgc

SEQ ID NO: 18770 - DNA, 199 bp, Homo sapiens; identical to SEQ ID NO: 7810
  misc_feature 1..199: note = chr5:43008737-43008936
  misc_feature 1..199: note = hyper
  source 1..199: mol_type = genomic DNA

SEQ ID NO: 18771 - DNA, 47 bp, Homo sapiens
  misc_feature 1..47: note = chr5:43019191-43019238
  misc_feature 1..47: note = hyper
  source 1..47: mol_type = genomic DNA
gcaagtcctgccgaacgcgactttttcctcttgtggaccaagtctga

SEQ ID NO: 18772 - skipped

SEQ ID NO: 18773 - DNA, 52 bp, Homo sapiens
  misc_feature 1..52: note = chr5:43040964-43041016
  misc_feature 1..52: note = hyper
  source 1..52: mol_type = genomic DNA
aaaagtgacagcactgagaacctaaggaccccgcgaacgggaaatgtcacgt

SEQ ID NO: 18774 - DNA, 238 bp, Homo sapiens; identical to SEQ ID NO: 7816
  misc_feature 1..238: note = chr5:43191854-43192092
  misc_feature 1..238: note = hyper
  source 1..238: mol_type = genomic DNA

SEQ ID NO: 18775 - DNA, 470 bp, Homo sapiens; identical to SEQ ID NO: 7817
  misc_feature 1..470: note = chr5:43192670-43193140
  misc_feature 1..470: note = hyper
  source 1..470: mol_type = genomic DNA

SEQ ID NO: 18776 - DNA, 33 bp, Homo sapiens
  misc_feature 1..33: note = chr5:43396969-43397002
  misc_feature 1..33: note = hyper
  source 1..33: mol_type = genomic DNA
tgaagtggaaaacagcgggcggtagccgaagca

SEQ ID NO: 18777 - DNA, 72 bp, Homo sapiens; identical to SEQ ID NO: 7819
  misc_feature 1..72: note = chr5:43397305-43397377
  misc_feature 1..72: note = hyper
  source 1..72: mol_type = genomic DNA

SEQ ID NO: 18778 - DNA, 367 bp, Homo sapiens; identical to SEQ ID NO: 7820
  misc_feature 1..367: note = chr5:44388245-44388612
  misc_feature 1..367: note = hyper
  source 1..367: mol_type = genomic DNA

SEQ ID NO: 18779 - DNA, 30 bp, Homo sapiens; identical to SEQ ID NO: 7821
  misc_feature 1..30: note = chr5:44388856-44388886
  misc_feature 1..30: note = hyper
  source 1..30: mol_type = genomic DNA

SEQ ID NO: 18780 - DNA, 252 bp, Homo sapiens
  misc_feature 1..252: note = chr5:44389852-44390104
  misc_feature 1..252: note = hyper
  source 1..252: mol_type = genomic DNA
acggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcag

SEQ ID NO: 18781 - DNA, 75 bp, Homo sapiens
  misc_feature 1..75: note = chr5:45695533-45695608
  misc_feature 1..75: note = hyper
  source 1..75: mol_type = genomic DNA
caaggaggagagcccgtccgggattcccgggcaacaggagcacatcctccgagcccctcctgggtggaaactacc

SEQ ID NO: 18782 - DNA, 17 bp, Homo sapiens
  misc_feature 1..17: note = chr5:45695947-45695964
  misc_feature 1..17: note = hyper
  source 1..17: mol_type = genomic DNA
tcttcgaagccccccgc

SEQ ID NO: 18783 - DNA, 293 bp, Homo sapiens
  misc_feature 1..293: note = chr5:49736685-49736978
  misc_feature 1..293: note = hyper
  source 1..293: mol_type = genomic DNA
gttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggaggg

SEQ ID NO: 18784 - DNA, 158 bp, Homo sapiens; identical to SEQ ID NO: 7827
  misc_feature 1..158: note = chr5:49737098-49737256
  misc_feature 1..158: note = hyper
  source 1..158: mol_type = genomic DNA

SEQ ID NO: 18785 - DNA, 84 bp, Homo sapiens
  misc_feature 1..84: note = chr5:50263484-50263568
  misc_feature 1..84: note = hyper
  source 1..84: mol_type = genomic DNA
cctcgccccaattaacgccctacagccagtcagccttacacctgctggaaaaatcttggtggcagtggtgggaggtggtggttt

SEQ ID NO: 18786 - DNA, 39 bp, Homo sapiens
  misc_feature 1..39: note = chr5:50264603-50264642
  misc_feature 1..39: note = hyper
  source 1..39: mol_type = genomic DNA
taaagtgtccaggactggaactcacgtccctgaggcagg

SEQ ID NO: 18787 - DNA, 243 bp, Homo sapiens
  misc_feature 1..243: note = chr5:50265429-50265672
  misc_feature 1..243: note = hyper
  source 1..243: mol_type = genomic DNA
gtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccacca

SEQ ID NO: 18788 - DNA, 40 bp, Homo sapiens; identical to SEQ ID NO: 7832
  misc_feature 1..40: note = chr5:50683270-50683310
  misc_feature 1..40: note = hyper
  source 1..40: mol_type = genomic DNA

SEQ ID NO: 18789 - DNA, 229 bp, Homo sapiens; identical to SEQ ID NO: 7833
  misc_feature 1..229: note = chr5:50685846-50686075
  misc_feature 1..229: note = hyper
  source 1..229: mol_type = genomic DNA

SEQ ID NO: 18790 - skipped

SEQ ID NO: 18791 - DNA, 37 bp, Homo sapiens
  misc_feature 1..37: note = chr5:54516334-54516371
  misc_feature 1..37: note = hyper
  source 1..37: mol_type = genomic DNA
gtggctcaggttcaacgcgctccggctgcagtctgtg

SEQ ID NO: 18792 - DNA, 293 bp, Homo sapiens
  misc_feature 1..293: note = chr5:54527343-54527636
  misc_feature 1..293: note = hyper
  source 1..293: mol_type = genomic DNA
tcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaagg

SEQ ID NO: 18793 - DNA, 180 bp, Homo sapiens
  misc_feature 1..180: note = chr5:57878091-57878271
  misc_feature 1..180: note = hyper
  source 1..180: mol_type = genomic DNA
tttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtg

SEQ ID NO: 18794 - DNA, 165 bp, Homo sapiens
  misc_feature 1..165: note = chr5:57878375-57878540
  misc_feature 1..165: note = hyper
  source 1..165: mol_type = genomic DNA
ccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaa

SEQ ID NO: 18795 - DNA, 35 bp, Homo sapiens; identical to SEQ ID NO: 7841
  misc_feature 1..35: note = chr5:57879028-57879063
  misc_feature 1..35: note = hyper
  source 1..35: mol_type = genomic DNA

SEQ ID NO: 18796 - DNA, 149 bp, Homo sapiens; identical to SEQ ID NO: 7842
  misc_feature 1..149: note = chr5:58335677-58335826
  misc_feature 1..149: note = hyper
  source 1..149: mol_type = genomic DNA

SEQ ID NO: 18797 - DNA, 59 bp, Homo sapiens
  misc_feature 1..59: note = chr5:59188996-59189055
  misc_feature 1..59: note = hyper
  source 1..59: mol_type = genomic DNA
cctgagtccctggaacgaggagggccaggacatcctggatttcttcaggccgggccggt

SEQ ID NO: 18798 - DNA, 292 bp, Homo sapiens
  misc_feature 1..292: note = chr5:59189206-59189498
  misc_feature 1..292: note = hyper
  source 1..292: mol_type = genomic DNA
cagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgct

SEQ ID NO: 18799 - DNA, 81 bp, Homo sapiens
  misc_feature 1..81: note = chr5:59189948-59190029
  misc_feature 1..81: note = hyper
  source 1..81: mol_type = genomic DNA
accaaaaccactccagccagtcaggagtcagacctgtcctcttgatccttcccctcgccgtgcccgcgcctccctcctcca

SEQ ID NO: 18800 - DNA, 130 bp, Homo sapiens
  misc_feature 1..130: note = chr5:63801877-63802007
  misc_feature 1..130: note = hyper
  source 1..130: mol_type = genomic DNA
acaagcccttagagacgagggatcaaggcagccgattagagccaattgcttgctttggggacggccagtccttccaggcctggcgacagtggagggaggggaaagacgaaccgagtgccgctgcgggaag

SEQ ID NO: 18801 - DNA, 38 bp, Homo sapiens
  misc_feature 1..38: note = chr5:63986450-63986488
  misc_feature 1..38: note = hyper
  source 1..38: mol_type = genomic DNA
atgagcgaggccagccgactgtgctccggctactacag

SEQ ID NO: 18802 - DNA, 53 bp, Homo sapiens; identical to SEQ ID NO: 7852
  misc_feature 1..53: note = chr5:63986909-63986962
  misc_feature 1..53: note = hyper
  source 1..53: mol_type = genomic DNA

SEQ ID NO: 18803 - DNA, 132 bp, Homo sapiens; identical to SEQ ID NO: 7853
  misc_feature 1..132: note = chr5:67583945-67584077
  misc_feature 1..132: note = hyper
  source 1..132: mol_type = genomic DNA

SEQ ID NO: 18804 - DNA, 19 bp, Homo sapiens
  misc_feature 1..19: note = chr5:71014895-71014914
  misc_feature 1..19: note = hyper
  source 1..19: mol_type = genomic DNA
tctgcgctctagcccatct

SEQ ID NO: 18805 - DNA, 30 bp, Homo sapiens; identical to SEQ ID NO: 7856
  misc_feature 1..30: note = chr5:71403263-71403293
  misc_feature 1..30: note = hyper
  source 1..30: mol_type = genomic DNA

SEQ ID NO: 18806 - DNA, 30 bp, Homo sapiens; identical to SEQ ID NO: 7859
  misc_feature 1..30: note = chr5:71404812-71404842
  misc_feature 1..30: note = hyper
  source 1..30: mol_type = genomic DNA

SEQ ID NO: 18807 - DNA, 63 bp, Homo sapiens; identical to SEQ ID NO: 7860
  misc_feature 1..63: note = chr5:72416102-72416165
  misc_feature 1..63: note = hyper
  source 1..63: mol_type = genomic DNA

SEQ ID NO: 18808 - DNA, 15 bp, Homo sapiens
  misc_feature 1..15: note = chr5:72526051-72526066
  misc_feature 1..15: note = hyper
  source 1..15: mol_type = genomic DNA
tcgccccagactgtc

SEQ ID NO: 18809 - DNA, 18 bp, Homo sapiens
  misc_feature 1..18: note = chr5:72526395-72526413
  misc_feature 1..18: note = hyper
  source 1..18: mol_type = genomic DNA
gtgggcccaatgctccgg

SEQ ID NO: 18810 - skipped

SEQ ID NO: 18811 - DNA, 102 bp, Homo sapiens
  misc_feature 1..102: note = chr5:72595440-72595542
  misc_feature 1..102: note = hyper
  source 1..102: mol_type = genomic DNA
ttgtccaccttgccccgaaggcaagtctggatatgaaaagaaaaaggcgggcaacggaggagatttatttttcattttaactttcctctcccaggcttcctc

SEQ ID NO: 18812 - DNA, 30 bp, Homo sapiens; identical to SEQ ID NO: 7871
  misc_feature 1..30: note = chr5:72596861-72596891
  misc_feature 1..30: note = hyper
  source 1..30: mol_type = genomic DNA

SEQ ID NO: 18813 - DNA, 72 bp, Homo sapiens; identical to SEQ ID NO: 7872
  misc_feature 1..72: note = chr5:72598030-72598102
  misc_feature 1..72: note = hyper
  source 1..72: mol_type = genomic DNA

SEQ ID NO: 18814 - DNA, 20 bp, Homo sapiens
  misc_feature 1..20: note = chr5:72599059-72599079
  misc_feature 1..20: note = hyper
  source 1..20: mol_type = genomic DNA
cgaatgcagcgcccgggagt

SEQ ID NO: 18815 - DNA, 30 bp, Homo sapiens; identical to SEQ ID NO: 7875
  misc_feature 1..30: note = chr5:72608427-72608457
  misc_feature 1..30: note = hyper
  source 1..30: mol_type = genomic DNA

SEQ ID NO: 18816 - DNA, 40 bp, Homo sapiens; identical to SEQ ID NO: 7877
  misc_feature 1..40: note = chr5:72716058-72716098
  misc_feature 1..40: note = hyper
  source 1..40: mol_type = genomic DNA

SEQ ID NO: 18817 - DNA, 30 bp, Homo sapiens; identical to SEQ ID NO: 7879
  misc_feature 1..30: note = chr5:72733558-72733588
  misc_feature 1..30: note = hyper
  source 1..30: mol_type = genomic DNA

SEQ ID NO: 18818 - skipped

SEQ ID NO: 18819 - DNA, 232 bp, Homo sapiens; identical to SEQ ID NO: 7881
  misc_feature 1..232: note = chr5:72742850-72743082
  misc_feature 1..232: note = hyper
  source 1..232: mol_type = genomic DNA

SEQ ID NO: 18820 - DNA, 51 bp, Homo sapiens; identical to SEQ ID NO: 7882
  misc_feature 1..51: note = chr5:72743504-72743555
  misc_feature 1..51: note = hyper
  source 1..51: mol_type = genomic DNA

SEQ ID NO: 18821 - DNA, 171 bp, Homo sapiens; identical to SEQ ID NO: 7883
  misc_feature 1..171: note = chr5:72744287-72744458
  misc_feature 1..171: note = hyper
  source 1..171: mol_type = genomic DNA

SEQ ID NO: 18822 - DNA, 32 bp, Homo sapiens; identical to SEQ ID NO: 7884
  misc_feature 1..32: note = chr5:72744886-72744918
  misc_feature 1..32: note = hyper
  source 1..32: mol_type = genomic DNA

SEQ ID NO: 18823 - DNA, 53 bp, Homo sapiens; identical to SEQ ID NO: 7885
  misc_feature 1..53: note = chr5:74162540-74162593
  misc_feature 1..53: note = hyper
  source 1..53: mol_type = genomic DNA

SEQ ID NO: 18824 - DNA, 208 bp, Homo sapiens
  misc_feature 1..208: note = chr5:75378033-75378241
  misc_feature 1..208: note = hyper
  source 1..208: mol_type = genomic DNA
cgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaa

SEQ ID NO: 18825 - DNA, 148 bp, Homo sapiens; identical to SEQ ID NO: 7887
  misc_feature 1..148: note = chr5:75379107-75379255
  misc_feature 1..148: note = hyper
  source 1..148: mol_type = genomic DNA

SEQ ID NO: 18826 - DNA, 96 bp, Homo sapiens
  misc_feature 1..96: note = chr5:75380067-75380163
  misc_feature 1..96: note = hyper
  source 1..96: mol_type = genomic DNA
caggcgaagcagacccgaggctgtgaagctcagaggggagagggaccaatcgcagtaaataagctaccgaggtaatcttagatggcgatgagggca

SEQ ID NO: 18827 - DNA, 202 bp, Homo sapiens
  misc_feature 1..202: note = chr5:75380422-75380624
  misc_feature 1..202: note = hyper
  source 1..202: mol_type = genomic DNA
gggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcgg

SEQ ID NO: 18828 - DNA, 17 bp, Homo sapiens
  misc_feature 1..17: note = chr5:76011337-76011354
  misc_feature 1..17: note = hyper
  source 1..17: mol_type = genomic DNA
gacgtataaaagttcaa

SEQ ID NO: 18829 - DNA, 211 bp, Homo sapiens; identical to SEQ ID NO: 7894
  misc_feature 1..211: note = chr5:76506548-76506759
  misc_feature 1..211: note = hyper
  source 1..211: mol_type = genomic DNA

SEQ ID NO: 18830 - DNA, 275 bp, Homo sapiens
  misc_feature 1..275: note = chr5:76506760-76507035
  misc_feature 1..275: note = hyper
  source 1..275: mol_type = genomic DNA
cccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgc

SEQ ID NO: 18831 - DNA, 12 bp, Homo sapiens
  misc_feature 1..12: note = chr5:76507114-76507126
  misc_feature 1..12: note = hyper
  source 1..12: mol_type = genomic DNA
cgtgggggccgt

SEQ ID NO: 18832 - DNA, 133 bp, Homo sapiens; identical to SEQ ID NO: 7898
  misc_feature 1..133: note = chr5:76924754-76924887
  misc_feature 1..133: note = hyper
  source 1..133: mol_type = genomic DNA

SEQ ID NO: 18833 - DNA, 97 bp, Homo sapiens
  misc_feature 1..97: note = chr5:76925464-76925561
  misc_feature 1..97: note = hyper
  source 1..97: mol_type = genomic DNA
tgcaccgtgtctgtgcgcgcgcgtgtgtagcgtctgagcgtgagcgagagtgcgagtgtgtgtgtttctgcccacaaaccagtccattggtgtctga

SEQ ID NO: 18834 - DNA, 199 bp, Homo sapiens
  misc_feature 1..199: note = chr5:76925690-76925889
  misc_feature 1..199: note = hyper
  source 1..199: mol_type = genomic DNA
gtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaa

SEQ ID NO: 18835 - DNA, 326 bp, Homo sapiens; identical to SEQ ID NO: 7900
  misc_feature 1..326: note = chr5:76926106-76926432
  misc_feature 1..326: note = hyper
  source 1..326: mol_type = genomic DNA

SEQ ID NO: 18836 - DNA, 10 bp, Homo sapiens
  misc_feature 1..10: note = chr5:76928678-76928688
  misc_feature 1..10: note = hyper
  source 1..10: mol_type = genomic DNA
caattgagct

SEQ ID NO: 18837 - DNA, 34 bp, Homo sapiens
  misc_feature 1..34: note = chr5:76928906-76928940
  misc_feature 1..34: note = hyper
  source 1..34: mol_type = genomic DNA
tgcaagtgccagtgaatcccgaaatgtttgtttg

SEQ ID NO: 18838 - DNA, 20 bp, Homo sapiens
  misc_feature 1..20: note = chr5:76932282-76932302
  misc_feature 1..20: note = hyper
  source 1..20: mol_type = genomic DNA
tatttgtcaataatgcgagc

SEQ ID NO: 18839 - DNA, 210 bp, Homo sapiens
  misc_feature 1..210: note = chr5:76932332-76932542
  misc_feature 1..210: note = hyper
  source 1..210: mol_type = genomic DNA
cccgggggggcgctgaggttgccttctcaggcggaggaggcgaaccctgtagcccgacaacgccgggcttcgattttgaggagcttcttccgggatgtcgctatactggccggagacgggccttgcgtgtccattgggggatggcgatggggaccagtttccgggtagagaaggagataactcgatacaggaacgcacaggcagcctgaa

SEQ ID NO: 18840 - DNA, 30 bp, Homo sapiens; identical to SEQ ID NO: 7903
  misc_feature 1..30: note = chr5:76933489-76933519
  misc_feature 1..30: note = hyper
  source 1..30: mol_type = genomic DNA

SEQ ID NO: 18841 - DNA, 47 bp, Homo sapiens; identical to SEQ ID NO: 7904
  misc_feature 1..47: note = chr5:76934057-76934104
  misc_feature 1..47: note = hyper
  source 1..47: mol_type = genomic DNA

SEQ ID NO: 18842 - DNA, 30 bp, Homo sapiens; identical to SEQ ID NO: 7909
  misc_feature 1..30: note = chr5:76940379-76940409
  misc_feature 1..30: note = hyper
  source 1..30: mol_type = genomic DNA

SEQ ID NO: 18843 - DNA, 97 bp, Homo sapiens; identical to SEQ ID NO: 7910
  misc_feature 1..97: note = chr5:76940857-76940954
  misc_feature 1..97: note = hyper
  source 1..97: mol_type = genomic DNA

SEQ ID NO: 18844 - skipped

SEQ ID NO: 18845 - DNA, 172 bp, Homo sapiens
  misc_feature 1..172: note = chr5:76941326-76941498
  misc_feature 1..172: note = hyper
  source 1..172: mol_type = genomic DNA
tcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccaggggg

SEQ ID NO: 18846 - DNA, 389 bp, Homo sapiens; identical to SEQ ID NO: 7912
  misc_feature 1..389: note = chr5:76941512-76941901
  misc_feature 1..389: note = hyper
  source 1..389: mol_type = genomic DNA

SEQ ID NO: 18847 - DNA, 14 bp, Homo sapiens
  misc_feature 1..14: note = chr5:77147549-77147563
  misc_feature 1..14: note = hyper
  source 1..14: mol_type = genomic DNA
aagtgcgtgtgtag

SEQ ID NO: 18848 - DNA, 105 bp, Homo sapiens
  misc_feature 1..105: note = chr5:77148393-77148498
  misc_feature 1..105: note = hyper
  source 1..105: mol_type = genomic DNA
ggagctgacgctgaacgcctgaatgggcagcgcgccaacttcgctgctccaggaggggggtggggagggagaggaggaggaggaggatgaggagagaggggaggt

SEQ ID NO: 18849 - skipped

SEQ ID NO: 18850 - DNA, 196 bp, Homo sapiens; identical to SEQ ID NO: 7922
  misc_feature 1..196: note = chr5:79330939-79331135
  misc_feature 1..196: note = hyper
  source 1..196: mol_type = genomic DNA

SEQ ID NO: 18851 - DNA, 108 bp, Homo sapiens; identical to SEQ ID NO: 7923
  misc_feature 1..108: note = chr5:79331229-79331337
  misc_feature 1..108: note = hyper
  source 1..108: mol_type = genomic DNA

SEQ ID NO: 18852 - skipped

SEQ ID NO: 18853 - DNA, 36 bp, Homo sapiens
  misc_feature 1..36: note = chr5:79864862-79864898
  misc_feature 1..36: note = hyper
  source 1..36: mol_type = genomic DNA
acccctggaaccaggcgcgtttcctcagtttttcct

SEQ ID NO: 18854 - DNA, 367 bp, Homo sapiens
  misc_feature 1..367: note = chr5:79865078-79865445
  misc_feature 1..367: note = hyper
  source 1..367: mol_type = genomic DNA
gccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 18855 - DNA, 71 bp, Homo sapiens; identical to SEQ ID NO: 2602
  misc_feature 1..71: note = chr5:79865522-79865593
  misc_feature 1..71: note = hyper
  source 1..71: mol_type = genomic DNA

SEQ ID NO: 18856 - DNA, 41 bp, Homo sapiens
  misc_feature 1..41: note = chr5:80255775-80255816
  misc_feature 1..41: note = hyper
  source 1..41: mol_type = genomic DNA
ttttgtgcatatgtgcgcgcattgtgtttgtgtgcatttgt

SEQ ID NO: 18857 - DNA, 58 bp, Homo sapiens; identical to SEQ ID NO: 7929
  misc_feature 1..58: note = chr5:80256312-80256370
  misc_feature 1..58: note = hyper
  source 1..58: mol_type = genomic DNA

SEQ ID NO: 18858 - DNA, 91 bp, Homo sapiens; identical to SEQ ID NO: 7930
  misc_feature 1..91: note = chr5:80256428-80256519
  misc_feature 1..91: note = hyper
  source 1..91: mol_type = genomic DNA

SEQ ID NO: 18859 - DNA, 60 bp, Homo sapiens
  misc_feature 1..60: note = chr5:80689735-80689795
  misc_feature 1..60: note = hyper
  source 1..60: mol_type = genomic DNA
cccagcccccagccgccgccgctcccgcagccccggtcccgcgcctccccgcagccccgg

SEQ ID NO: 18860 - DNA, 56 bp, Homo sapiens
  misc_feature 1..56: note = chr5:80690062-80690118
  misc_feature 1..56: note = hyper
  source 1..56: mol_type = genomic DNA
aggtggtgggagctgcgagtgagggggcccgcactgtcatcccaggactatcgcga

SEQ ID NO: 18861 - DNA, 30 bp, Homo sapiens; identical to SEQ ID NO: 7933
  misc_feature 1..30: note = chr5:81075100-81075130
  misc_feature 1..30: note = hyper
  source 1..30: mol_type = genomic DNA

SEQ ID NO: 18862 - DNA, 37 bp, Homo sapiens; identical to SEQ ID NO: 7934
  misc_feature 1..37: note = chr5:82767171-82767208
  misc_feature 1..37: note = hyper
  source 1..37: mol_type = genomic DNA

SEQ ID NO: 18863 - DNA, 156 bp, Homo sapiens; identical to SEQ ID NO: 7936
  misc_feature 1..156: note = chr5:82768425-82768581
  misc_feature 1..156: note = hyper
  source 1..156: mol_type = genomic DNA

SEQ ID NO: 18864 - DNA, 110 bp, Homo sapiens; identical to SEQ ID NO: 7937
  misc_feature 1..110: note = chr5:82769171-82769281
  misc_feature 1..110: note = hyper
  source 1..110: mol_type = genomic DNA

SEQ ID NO: 18865 - DNA, 41 bp, Homo sapiens; identical to SEQ ID NO: 7938
  misc_feature 1..41: note = chr5:82769910-82769951
  misc_feature 1..41: note = hyper
  source 1..41: mol_type = genomic DNA

SEQ ID NO: 18866 - DNA, 18 bp, Homo sapiens
  misc_feature 1..18: note = chr5:83679177-83679195
  misc_feature 1..18: note = hyper
  source 1..18: mol_type = genomic DNA
ggacaagctgcacctcgc

SEQ ID NO: 18867 - DNA, 31 bp, Homo sapiens
  misc_feature 1..31: note = chr5:87956168-87956199
  misc_feature 1..31: note = hyper
  source 1..31: mol_type = genomic DNA
gcaagcgctcaccaacgccggccaccgagca

SEQ ID NO: 18868 - DNA, 142 bp, Homo sapiens
  misc_feature 1..142: note = chr5:87956964-87957106
  misc_feature 1..142: note = hyper
  source 1..142: mol_type = genomic DNA
gcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctt

SEQ ID NO: 18869 - DNA, 73 bp, Homo sapiens; identical to SEQ ID NO: 472
  misc_feature 1..73: note = chr5:87970041-87970114
  misc_feature 1..73: note = hyper
  source 1..73: mol_type = genomic DNA

SEQ ID NO: 18870 - DNA, 78 bp, Homo sapiens
  misc_feature 1..78: note = chr5:87970115-87970193
  misc_feature 1..78: note = hyper
  source 1..78: mol_type = genomic DNA
ggggtgcggggaggcggtgcaggaatccgtcccgccgagtgccgtcggcccctgtgggcctgtttgcgcgcctggggc

SEQ ID NO: 18871 - DNA, 35 bp, Homo sapiens
  misc_feature 1..35: note = chr5:87970872-87970907
  misc_feature 1..35: note = hyper
  source 1..35: mol_type = genomic DNA
gcaaaacaccaggccaaatccggcaaggcggcggc

SEQ ID NO: 18872 - DNA, 318 bp, Homo sapiens; identical to SEQ ID NO: 7951
  misc_feature 1..318: note = chr5:87971517-87971835
  misc_feature 1..318: note = hyper
  source 1..318: mol_type = genomic DNA

SEQ ID NO: 18873 - DNA, 20 bp, Homo sapiens
  misc_feature 1..20: note = chr5:87974084-87974104
  misc_feature 1..20: note = hyper
  source 1..20: mol_type = genomic DNA
aatctcccttattggcgcat

SEQ ID NO: 18874 - DNA, 151 bp, Homo sapiens
  misc_feature 1..151: note = chr5:87974307-87974458
  misc_feature 1..151: note = hyper
  source 1..151: mol_type = genomic DNA
ccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaac

SEQ ID NO: 18875 - DNA, 31 bp, Homo sapiens
  misc_feature 1..31: note = chr5:87979725-87979756
  misc_feature 1..31: note = hyper
  source 1..31: mol_type = genomic DNA
acttaaaagcccttgcgactccctctgaatt

SEQ ID NO: 18876 - DNA, 73 bp, Homo sapiens
  misc_feature 1..73: note = chr5:87979912-87979985
  misc_feature 1..73: note = hyper
  source 1..73: mol_type = genomic DNA
catcagcagctgatcagacatggtaatccaataatttttttgaatacacacaatttttcgttgaagttaattt

SEQ ID NO: 18877 - DNA, 30 bp, Homo sapiens; identical to SEQ ID NO: 7955
  misc_feature 1..30: note = chr5:87985488-87985518
  misc_feature 1..30: note = hyper
  source 1..30: mol_type = genomic DNA

SEQ ID NO: 18878 - DNA, 69 bp, Homo sapiens; identical to SEQ ID NO: 7956
  misc_feature 1..69: note = chr5:87985975-87986044
  misc_feature 1..69: note = hyper
  source 1..69: mol_type = genomic DNA

SEQ ID NO: 18879 - DNA, 124 bp, Homo sapiens; identical to SEQ ID NO: 474
  misc_feature 1..124: note = chr5:88185263-88185387
  misc_feature 1..124: note = hyper
  source 1..124: mol_type = genomic DNA

SEQ ID NO: 18880 - DNA, 82 bp, Homo sapiens
  misc_feature 1..82: note = chr5:88185388-88185470
  misc_feature 1..82: note = hyper
  source 1..82: mol_type = genomic DNA
acgagtgggcggccacgctggtttggcgcggggaaggaagggggtgtgccgacttgtatttagttgggggttgtggaagtca

SEQ ID NO: 18881 - DNA, 333 bp, Homo sapiens
  misc_feature 1..333: note = chr5:89854523-89854856
  misc_feature 1..333: note = hyper
  source 1..333: mol_type = genomic DNA
cctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccggg

SEQ ID NO: 18882 - skipped

SEQ ID NO: 18883 - DNA, 26 bp, Homo sapiens
  misc_feature 1..26: note = chr5:92915099-92915125
  misc_feature 1..26: note = hyper
  source 1..26: mol_type = genomic DNA
cgctagggtcacgccgggtcccaggg

SEQ ID NO: 18884 - DNA, 12 bp, Homo sapiens
  misc_feature 1..12: note = chr5:92940177-92940189
  misc_feature 1..12: note = hyper
  source 1..12: mol_type = genomic DNA
ggggtgggccgg

SEQ ID NO: 18885 - DNA, 73 bp, Homo sapiens; identical to SEQ ID NO: 7963
  misc_feature 1..73: note = chr5:94621061-94621134
  misc_feature 1..73: note = hyper
  source 1..73: mol_type = genomic DNA

SEQ ID NO: 18886 - DNA, 66 bp, Homo sapiens
  misc_feature 1..66: note = chr5:94955615-94955681
  misc_feature 1..66: note = hyper
  source 1..66: mol_type = genomic DNA
ggatgaggttctcagcgcccaggggtccgcggcttccgcgagggtagcgtcgggggccgctgcaga

SEQ ID NO: 18887 - DNA, 241 bp, Homo sapiens
  misc_feature 1..241: note = chr5:94955919-94956160
  misc_feature 1..241: note = hyper
  source 1..241: mol_type = genomic DNA
actttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaaca

SEQ ID NO: 18888 - DNA, 329 bp, Homo sapiens
  misc_feature 1..329: note = chr5:94956606-94956935
  misc_feature 1..329: note = hyper
  source 1..329: mol_type = genomic DNA
gcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgc

SEQ ID NO: 18889 - DNA, 92 bp, Homo sapiens
  misc_feature 1..92: note = chr5:94957000-94957092
  misc_feature 1..92: note = hyper
  source 1..92: mol_type = genomic DNA
cgatggccaacagcgctctcaatcccttcgtctacctcttcttccaggcgggcgactgccggctccggcgacagctgcggaagcggctgggc

SEQ ID NO: 18890 - DNA, 130 bp, Homo sapiens
  misc_feature 1..130: note = chr5:100236552-100236682
  misc_feature 1..130: note = hyper
  source 1..130: mol_type = genomic DNA
tcattctttccccctcgccgccggcgctctggcagcaggggataaccccggtgcgcgcctctcttcctgtttggtttactcaagcgcctgccccaacgccttctcagtcaagctgggaggaaactgcttc

SEQ ID NO: 18891 - DNA, 211 bp, Homo sapiens
  misc_feature 1..211: note = chr5:100236757-100236968
  misc_feature 1..211: note = hyper
  source 1..211: mol_type = genomic DNA
aacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctc

SEQ ID NO: 18892 - DNA, 59 bp, Homo sapiens; identical to SEQ ID NO: 7968
  misc_feature 1..59: note = chr5:100237658-100237717
  misc_feature 1..59: note = hyper
  source 1..59: mol_type = genomic DNA

SEQ ID NO: 18893 - DNA, 30 bp, Homo sapiens; identical to SEQ ID NO: 7969
  misc_feature 1..30: note = chr5:100238368-100238398
  misc_feature 1..30: note = hyper
  source 1..30: mol_type = genomic DNA

SEQ ID NO: 18894 - DNA, 573 bp, Homo sapiens
  misc_feature 1..573: note = chr5:100239151-100239724
  misc_feature 1..573: note = hyper
  source 1..573: mol_type = genomic DNA
acatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 18895 - DNA, 141 bp, Homo sapiens; identical to SEQ ID NO: 7974
  misc_feature 1..141: note = chr5:107005171-107005312
  misc_feature 1..141: note = hyper
  source 1..141: mol_type = genomic DNA

SEQ ID NO: 18896 - DNA, 479 bp, Homo sapiens; identical to SEQ ID NO: 7975
  misc_feature 1..479: note = chr5:110408719-110409198
  misc_feature 1..479: note = hyper
  source 1..479: mol_type = genomic DNA

SEQ ID NO: 18897 - DNA, 46 bp, Homo sapiens; identical to SEQ ID NO: 7976
  misc_feature 1..46: note = chr5:110560287-110560333
  misc_feature 1..46: note = hyper
  source 1..46: mol_type = genomic DNA

SEQ ID NO: 18898 - DNA, 62 bp, Homo sapiens
  misc_feature 1..62: note = chr5:112629674-112629736
  misc_feature 1..62: note = hyper
  source 1..62: mol_type = genomic DNA
attttaccgatcagggaaataaaagggtgtatataaattagtggaagcgggtgggaaggaac

SEQ ID NO: 18899 - DNA, 34 bp, Homo sapiens; identical to SEQ ID NO: 7978
  misc_feature 1..34: note = chr5:112824097-112824131
  misc_feature 1..34: note = hyper
  source 1..34: mol_type = genomic DNA

SEQ ID NO: 18900 - DNA, 229 bp, Homo sapiens; identical to SEQ ID NO: 7981
  misc_feature 1..229: note = chr5:113696982-113697211
  misc_feature 1..229: note = hyper
  source 1..229: mol_type = genomic DNA

SEQ ID NO: 18901 - DNA, 251 bp, Homo sapiens; identical to SEQ ID NO: 7982
  misc_feature 1..251: note = chr5:113697471-113697722
  misc_feature 1..251: note = hyper
  source 1..251: mol_type = genomic DNA

SEQ ID NO: 18902 - DNA, 87 bp, Homo sapiens; identical to SEQ ID NO: 7983
  misc_feature 1..87: note = chr5:113698053-113698140
  misc_feature 1..87: note = hyper
  source 1..87: mol_type = genomic DNA

SEQ ID NO: 18903 - skipped

SEQ ID NO: 18904 - DNA, 175 bp, Homo sapiens
  misc_feature 1..175: note = chr5:113698392-113698567
  misc_feature 1..175: note = hyper
  source 1..175: mol_type = genomic DNA
accaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgca

SEQ ID NO: 18905 - DNA, 156 bp, Homo sapiens; identical to SEQ ID NO: 7987
  misc_feature 1..156: note = chr5:113699401-113699557
  misc_feature 1..156: note = hyper
  source 1..156: mol_type = genomic DNA

SEQ ID NO: 18906 - DNA, 168 bp, Homo sapiens; identical to SEQ ID NO: 7990
  misc_feature 1..168: note = chr5:114515948-114516116
  misc_feature 1..168: note = hyper
  source 1..168: mol_type = genomic DNA

SEQ ID NO: 18907 - DNA, 82 bp, Homo sapiens
  misc_feature 1..82: note = chr5:115151185-115151267
  misc_feature 1..82: note = hyper
  source 1..82: mol_type = genomic DNA
cgaatatttaatctgcgaaacttggcagtggatttgaataaacccacagtcggggaagttagttaaattggtttgggaaagg

SEQ ID NO: 18908 - DNA, 39 bp, Homo sapiens
  misc_feature 1..39: note = chr5:115152638-115152677
  misc_feature 1..39: note = hyper
  source 1..39: mol_type = genomic DNA
cacctccgccgctgtggttcgcgacgctgggacgtagac

SEQ ID NO: 18909 - skipped

SEQ ID NO: 18910 - DNA, 204 bp, Homo sapiens
  misc_feature 1..204: note = chr5:115298781-115298985
  misc_feature 1..204: note = hyper
  source 1..204: mol_type = genomic DNA
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgt

SEQ ID NO: 18911 - DNA, 30 bp, Homo sapiens; identical to SEQ ID NO: 7998
  misc_feature 1..30: note = chr5:115911931-115911961
  misc_feature 1..30: note = hyper
  source 1..30: mol_type = genomic DNA

SEQ ID NO: 18912 - DNA, 30 bp, Homo sapiens; identical to SEQ ID NO: 7999
  misc_feature 1..30: note = chr5:119800264-119800294
  misc_feature 1..30: note = hyper
  source 1..30: mol_type = genomic DNA

SEQ ID NO: 18913 - DNA, 326 bp, Homo sapiens; identical to SEQ ID NO: 8000
  misc_feature 1..326: note = chr5:119800576-119800902
  misc_feature 1..326: note = hyper
  source 1..326: mol_type = genomic DNA

SEQ ID NO: 18914 - DNA, 143 bp, Homo sapiens
  misc_feature 1..143: note = chr5:119801156-119801299
  misc_feature 1..143: note = hyper
  source 1..143: mol_type = genomic DNA
tttcctatcccacttcggttcagccctactcccgcccgcccctagccccaggtgatccagatggaaagaagcagagaaggtgtcagggctgaggctgcgtaactcaggcggcggctccgggcgggggcgggggccgggctggg

SEQ ID NO: 18915 - DNA, 23 bp, Homo sapiens
  misc_feature 1..23: note = chr5:119801445-119801468
  misc_feature 1..23: note = hyper
  source 1..23: mol_type = genomic DNA
tagaacttcgaaggtggcggtgg

SEQ ID NO: 18916 - DNA, 81 bp, Homo sapiens; identical to SEQ ID NO: 8002
  misc_feature 1..81: note = chr5:121412825-121412906
  misc_feature 1..81: note = hyper
  source 1..81: mol_type = genomic DNA

SEQ ID NO: 18917 - DNA, 148 bp, Homo sapiens; identical to SEQ ID NO: 8003
  misc_feature 1..148: note = chr5:121413157-121413305
  misc_feature 1..148: note = hyper
  source 1..148: mol_type = genomic DNA

SEQ ID NO: 18918 - DNA, 55 bp, Homo sapiens; identical to SEQ ID NO: 8004
  misc_feature 1..55: note = chr5:121647480-121647535
  misc_feature 1..55: note = hyper
  source 1..55: mol_type = genomic DNA

SEQ ID NO: 18919 - DNA, 154 bp, Homo sapiens; identical to SEQ ID NO: 8007
  misc_feature 1..154: note = chr5:122423874-122424028
  misc_feature 1..154: note = hyper
  source 1..154: mol_type = genomic DNA

SEQ ID NO: 18920 - DNA, 78 bp, Homo sapiens; identical to SEQ ID NO: 8008
  misc_feature 1..78: note = chr5:122424436-122424514
  misc_feature 1..78: note = hyper
  source 1..78: mol_type = genomic DNA

SEQ ID NO: 18921 - DNA, 164 bp, Homo sapiens
  misc_feature 1..164: note = chr5:122425168-122425332
  misc_feature 1..164: note = hyper
  source 1..164: mol_type = genomic DNA
tcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacg

SEQ ID NO: 18922 - DNA, 79 bp, Homo sapiens; identical to SEQ ID NO: 8010
  misc_feature 1..79: note = chr5:122425562-122425641
  misc_feature 1..79: note = hyper
  source 1..79: mol_type = genomic DNA

SEQ ID NO: 18923 - DNA, 162 bp, Homo sapiens; identical to SEQ ID NO: 8011
  misc_feature 1..162: note = chr5:122425701-122425863
  misc_feature 1..162: note = hyper
  source 1..162: mol_type = genomic DNA

SEQ ID NO: 18924 - DNA, 182 bp, Homo sapiens; identical to SEQ ID NO: 8012
  misc_feature 1..182: note = chr5:122426164-122426346
  misc_feature 1..182: note = hyper
  source 1..182: mol_type = genomic DNA

SEQ ID NO: 18925 - DNA, 44 bp, Homo sapiens; identical to SEQ ID NO: 8013
  misc_feature 1..44: note = chr5:122426805-122426849
  misc_feature 1..44: note = hyper
  source 1..44: mol_type = genomic DNA

SEQ ID NO: 18926 - DNA, 80 bp, Homo sapiens; identical to SEQ ID NO: 8014
  misc_feature 1..80: note = chr5:122430755-122430835
  misc_feature 1..80: note = hyper
  source 1..80: mol_type = genomic DNA

SEQ ID NO: 18927 - skipped

SEQ ID NO: 18928 - DNA, 28 bp, Homo sapiens
  misc_feature 1..28: note = chr5:122434500-122434528
  misc_feature 1..28: note = hyper
  source 1..28: mol_type = genomic DNA
tccagaacagcaccccggtcccccaccc

SEQ ID NO: 18929 - DNA, 15 bp, Homo sapiens
  misc_feature 1..15: note = chr5:122434605-122434620
  misc_feature 1..15: note = hyper
  source 1..15: mol_type = genomic DNA
cgcccttggagtcct

SEQ ID NO: 18930 - DNA, 311 bp, Homo sapiens; identical to SEQ ID NO: 8018
  misc_feature 1..311: note = chr5:125930586-125930897
  misc_feature 1..311: note = hyper
  source 1..311: mol_type = genomic DNA

SEQ ID NO: 18931 - DNA, 265 bp, Homo sapiens
  misc_feature 1..265: note = chr5:127874183-127874448
  misc_feature 1..265: note = hyper
  source 1..265: mol_type = genomic DNA
tggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgt

SEQ ID NO: 18932 - DNA, 104 bp, Homo sapiens
  misc_feature 1..104: note = chr5:127874839-127874943
  misc_feature 1..104: note = hyper
  source 1..104: mol_type = genomic DNA
ggctgggagtttccagattgaaatgcgccctccaccaccaagagggagctcacgcggccgcggggggccgaggcagccagccggcgccgcggtcctggggagtc

SEQ ID NO: 18933 - DNA, 25 bp, Homo sapiens
  misc_feature 1..25: note = chr5:128300655-128300680
  misc_feature 1..25: note = hyper
  source 1..25: mol_type = genomic DNA
tggatgacctttgtgcgacactgtt

SEQ ID NO: 18934 - DNA, 193 bp, Homo sapiens; identical to SEQ ID NO: 8026
  misc_feature 1..193: note = chr5:128301033-128301226
  misc_feature 1..193: note = hyper
  source 1..193: mol_type = genomic DNA

SEQ ID NO: 18935 - DNA, 339 bp, Homo sapiens
  misc_feature 1..339: note = chr5:128795742-128796081
  misc_feature 1..339: note = hyper
  source 1..339: mol_type = genomic DNA
cagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgc

SEQ ID NO: 18936 - DNA, 220 bp, Homo sapiens
  misc_feature 1..220: note = chr5:128796244-128796464
  misc_feature 1..220: note = hyper
  source 1..220: mol_type = genomic DNA
gcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgat

SEQ ID NO: 18937 - DNA, 51 bp, Homo sapiens
  misc_feature 1..51: note = chr5:128796816-128796867
  misc_feature 1..51: note = hyper
  source 1..51: mol_type = genomic DNA
cgaggagtgggaagtcgtgtttcctgcgctctggcgccgggagccggtgga

SEQ ID NO: 18938 - DNA, 359 bp, Homo sapiens
  misc_feature 1..359: note = chr5:128796985-128797344
  misc_feature 1..359: note = hyper
  source 1..359: mol_type = genomic DNA
gtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatc

SEQ ID NO: 18939 - DNA, 84 bp, Homo sapiens
  misc_feature 1..84: note = chr5:128797386-128797470
  misc_feature 1..84: note = hyper
  source 1..84: mol_type = genomic DNA
caccggagctgtgctgcggcaccctggctcgctggcttctttcagcacctgtggaggtggcctggtaagcgccttctttcccta

SEQ ID NO: 18940 - DNA, 37 bp, Homo sapiens; identical to SEQ ID NO: 8030
  misc_feature 1..37: note = chr5:129241413-129241450
  misc_feature 1..37: note = hyper
  source 1..37: mol_type = genomic DNA

SEQ ID NO: 18941 - DNA, 338 bp, Homo sapiens; identical to SEQ ID NO: 8031
  misc_feature 1..338: note = chr5:131346877-131347215
  misc_feature 1..338: note = hyper
  source 1..338: mol_type = genomic DNA

SEQ ID NO: 18942 - DNA, 30 bp, Homo sapiens; identical to SEQ ID NO: 8032
  misc_feature 1..30: note = chr5:131593289-131593319
  misc_feature 1..30: note = hyper
  source 1..30: mol_type = genomic DNA

SEQ ID NO: 18943 - DNA, 136 bp, Homo sapiens
  misc_feature 1..136: note = chr5:131992157-131992293
  misc_feature 1..136: note = hyper
  source 1..136: mol_type = genomic DNA
cccccctatctccgcgggccatcgccgccgcaaccgccgcgccagcgccttctcccacgcgcgggggcgcccctgcccaccgctcccggcagggcttttggtggccatgggggataaggggcgttgactcacccgg

SEQ ID NO: 18944 - DNA, 65 bp, Homo sapiens; identical to SEQ ID NO: 8034
  misc_feature 1..65: note = chr5:132947112-132947177
  misc_feature 1..65: note = hyper
  source 1..65: mol_type = genomic DNA

SEQ ID NO: 18945 - DNA, 693 bp, Homo sapiens
  misc_feature 1..693: note = chr5:132947836-132948529
  misc_feature 1..693: note = hyper
  source 1..693: mol_type = genomic DNA
gggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 18946 - DNA, 107 bp, Homo sapiens; identical to SEQ ID NO: 8036
  misc_feature 1..107: note = chr5:133449736-133449843
  misc_feature 1..107: note = hyper
  source 1..107: mol_type = genomic DNA

SEQ ID NO: 18947 - DNA, 248 bp, Homo sapiens
  misc_feature 1..248: note = chr5:134375210-134375458
  misc_feature 1..248: note = hyper
  source 1..248: mol_type = genomic DNA
gcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttc

SEQ ID NO: 18948 - DNA, 252 bp, Homo sapiens
  misc_feature 1..252: note = chr5:134870528-134870780
  misc_feature 1..252: note = hyper
  source 1..252: mol_type = genomic DNA
cggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggct

SEQ ID NO: 18949 - DNA, 180 bp, Homo sapiens; identical to SEQ ID NO: 8045
  misc_feature 1..180: note = chr5:134914251-134914431
  misc_feature 1..180: note = hyper
  source 1..180: mol_type = genomic DNA

SEQ ID NO: 18950 - skipped

SEQ ID NO: 18951 - DNA, 37 bp, Homo sapiens; identical to SEQ ID NO: 8047
  misc_feature 1..37: note = chr5:135170325-135170362
  misc_feature 1..37: note = hyper
  source 1..37: mol_type = genomic DNA

SEQ ID NO: 18952 - DNA, 30 bp, Homo sapiens; identical to SEQ ID NO: 8048
  misc_feature 1..30: note = chr5:135171026-135171056
  misc_feature 1..30: note = hyper
  source 1..30: mol_type = genomic DNA

SEQ ID NO: 18953 - DNA, 93 bp, Homo sapiens
  misc_feature 1..93: note = chr5:135265767-135265860
  misc_feature 1..93: note = hyper
  source 1..93: mol_type = genomic DNA
gtgtggagtcacaggcaggtggccacggggaattagctgaagaccagcaggcaggaagcctcccacatgccacctaaggggcgctcccggaac

SEQ ID NO: 18954 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 18955 - DNA, 182 bp, Homo sapiens
  misc_feature 1..182: note = chr5:135265932-135266114
  misc_feature 1..182: note = hyper
  source 1..182: mol_type = genomic DNA
ccatcgccgcggcctgctgggggaggcggcctttgaggagcgggcgcgaggcggggccaggcggggcggggccttgggcggctgcggtctgcgcggacccccgtgcctaggcgctcctgtgcctccagtgcgcggagccggcctcgctcgggcgtgttcctgcgccgaccggacggccggac

SEQ ID NO: 18956 - DNA, 15 bp, Homo sapiens
  misc_feature 1..15: note = chr5:135266672-135266687
  misc_feature 1..15: note = hyper
  source 1..15: mol_type = genomic DNA
cgagtgtgcctttta

SEQ ID NO: 18957 - DNA, 49 bp, Homo sapiens; identical to SEQ ID NO: 8053
  misc_feature 1..49: note = chr5:135527945-135527994
  misc_feature 1..49: note = hyper
  source 1..49: mol_type = genomic DNA

SEQ ID NO: 18958 - DNA, 421 bp, Homo sapiens
  misc_feature 1..421: note = chr5:135528233-135528654
  misc_feature 1..421: note = hyper
  source 1..421: mol_type = genomic DNA
ccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctga

SEQ ID NO: 18959 - DNA, 17 bp, Homo sapiens
  misc_feature 1..17: note = chr5:136834033-136834050
  misc_feature 1..17: note = hyper
  source 1..17: mol_type = genomic DNA
cccagggccgggtggcg

SEQ ID NO: 18960 - DNA, 53 bp, Homo sapiens; identical to SEQ ID NO: 8057
  misc_feature 1..53: note = chr5:136834828-136834881
  misc_feature 1..53: note = hyper
  source 1..53: mol_type = genomic DNA

SEQ ID NO: 18961-18962 - skipped (2 entries)

SEQ ID NO: 18963 - DNA, 86 bp, Homo sapiens; identical to SEQ ID NO: 8060
  misc_feature 1..86: note = chr5:137577679-137577765
  misc_feature 1..86: note = hyper
  source 1..86: mol_type = genomic DNA

SEQ ID NO: 18964 - skipped

SEQ ID NO: 18965 - DNA, 44 bp, Homo sapiens; identical to SEQ ID NO: 8062
  misc_feature 1..44: note = chr5:139175833-139175877
  misc_feature 1..44: note = hyper
  source 1..44: mol_type = genomic DNA

SEQ ID NO: 18966 - DNA, 21 bp, Homo sapiens
  misc_feature 1..21: note = chr5:139175929-139175950
  misc_feature 1..21: note = hyper
  source 1..21: mol_type = genomic DNA
cgtgtgcgtggggggtgccag

SEQ ID NO: 18967 - DNA, 11 bp, Homo sapiens
  misc_feature 1..11: note = chr5:139227762-139227773
  misc_feature 1..11: note = hyper
  source 1..11: mol_type = genomic DNA
cgacagcgagt

SEQ ID NO: 18968 - DNA, 12 bp, Homo sapiens
  misc_feature 1..12: note = chr5:139227909-139227921
  misc_feature 1..12: note = hyper
  source 1..12: mol_type = genomic DNA
ggtctcgtactc

SEQ ID NO: 18969 - DNA, 305 bp, Homo sapiens
  misc_feature 1..305: note = chr5:139525423-139525728
  misc_feature 1..305: note = hyper
  source 1..305: mol_type = genomic DNA
cagttcccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggc

SEQ ID NO: 18970 - DNA, 93 bp, Homo sapiens; identical to SEQ ID NO: 8066
  misc_feature 1..93: note = chr5:140012165-140012258
  misc_feature 1..93: note = hyper
  source 1..93: mol_type = genomic DNA

SEQ ID NO: 18971 - DNA, 173 bp, Homo sapiens
  misc_feature 1..173: note = chr5:140305805-140305978
  misc_feature 1..173: note = hyper
  source 1..173: mol_type = genomic DNA
cctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccaca

SEQ ID NO: 18972 - DNA, 30 bp, Homo sapiens; identical to SEQ ID NO: 8071
  misc_feature 1..30: note = chr5:140345497-140345527
  misc_feature 1..30: note = hyper
  source 1..30: mol_type = genomic DNA

SEQ ID NO: 18973 - DNA, 30 bp, Homo sapiens; identical to SEQ ID NO: 8072
  misc_feature 1..30: note = chr5:140346719-140346749
  misc_feature 1..30: note = hyper
  source 1..30: mol_type = genomic DNA

SEQ ID NO: 18974 - DNA, 30 bp, Homo sapiens; identical to SEQ ID NO: 8074
  misc_feature 1..30: note = chr5:140593316-140593346
  misc_feature 1..30: note = hyper
  source 1..30: mol_type = genomic DNA

SEQ ID NO: 18975 - DNA, 15 bp, Homo sapiens
  misc_feature 1..15: note = chr5:140614383-140614398
  misc_feature 1..15: note = hyper
  source 1..15: mol_type = genomic DNA
cgagcagctggaccg

SEQ ID NO: 18976 - DNA, 182 bp, Homo sapiens
  misc_feature 1..182: note = chr5:140777487-140777669
  misc_feature 1..182: note = hyper
  source 1..182: mol_type = genomic DNA
cgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggt

SEQ ID NO: 18977 - DNA, 97 bp, Homo sapiens; identical to SEQ ID NO: 8079
  misc_feature 1..97: note = chr5:140797493-140797590
  misc_feature 1..97: note = hyper
  source 1..97: mol_type = genomic DNA

SEQ ID NO: 18978 - DNA, 16 bp, Homo sapiens
  misc_feature 1..16: note = chr5:140801246-140801262
  misc_feature 1..16: note = hyper
  source 1..16: mol_type = genomic DNA
gcgatttgctcttcct

SEQ ID NO: 18979 - DNA, 11 bp, Homo sapiens
  misc_feature 1..11: note = chr5:140856622-140856633
  misc_feature 1..11: note = hyper
  source 1..11: mol_type = genomic DNA
gacaccaaact

SEQ ID NO: 18980 - DNA, 317 bp, Homo sapiens
  misc_feature 1..317: note = chr5:141262718-141263035
  misc_feature 1..317: note = hyper
  source 1..317: mol_type = genomic DNA
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagca

SEQ ID NO: 18981 - DNA, 36 bp, Homo sapiens; identical to SEQ ID NO: 8085
  misc_feature 1..36: note = chr5:141293999-141294035
  misc_feature 1..36: note = hyper
  source 1..36: mol_type = genomic DNA

SEQ ID NO: 18982 - DNA, 10 bp, Homo sapiens
  misc_feature 1..10: note = chr5:141931330-141931340
  misc_feature 1..10: note = hyper
  source 1..10: mol_type = genomic DNA
ctcacttctc

SEQ ID NO: 18983 - DNA, 101 bp, Homo sapiens; identical to SEQ ID NO: 8088
  misc_feature 1..101: note = chr5:142781774-142781875
  misc_feature 1..101: note = hyper
  source 1..101: mol_type = genomic DNA

SEQ ID NO: 18984 - DNA, 136 bp, Homo sapiens; identical to SEQ ID NO: 8089
  misc_feature 1..136: note = chr5:143584941-143585077
  misc_feature 1..136: note = hyper
  source 1..136: mol_type = genomic DNA

SEQ ID NO: 18985 - skipped

SEQ ID NO: 18986 - DNA, 181 bp, Homo sapiens
  misc_feature 1..181: note = chr5:145716994-145717175
  misc_feature 1..181: note = hyper
  source 1..181: mol_type = genomic DNA
cggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggt

SEQ ID NO: 18987 - DNA, 187 bp, Homo sapiens; identical to SEQ ID NO: 8093
  misc_feature 1..187: note = chr5:145717842-145718029
  misc_feature 1..187: note = hyper
  source 1..187: mol_type = genomic DNA

SEQ ID NO: 18988 - DNA, 12 bp, Homo sapiens
  misc_feature 1..12: note = chr5:145719925-145719937
  misc_feature 1..12: note = hyper
  source 1..12: mol_type = genomic DNA
ccttaaaaagaa

SEQ ID NO: 18989 - DNA, 280 bp, Homo sapiens; identical to SEQ ID NO: 2659
  misc_feature 1..280: note = chr5:145720018-145720298
  misc_feature 1..280: note = hyper
  source 1..280: mol_type = genomic DNA

SEQ ID NO: 18990 - DNA, 161 bp, Homo sapiens; identical to SEQ ID NO: 8100
  misc_feature 1..161: note = chr5:145723309-145723470
  misc_feature 1..161: note = hyper
  source 1..161: mol_type = genomic DNA

SEQ ID NO: 18991 - DNA, 82 bp, Homo sapiens
  misc_feature 1..82: note = chr5:145724420-145724502
  misc_feature 1..82: note = hyper
  source 1..82: mol_type = genomic DNA
tgagaagcttggccccggtcagcggctccaggagcccggaacctcctccctggcggaatcccgggcaccattcagccttttc

SEQ ID NO: 18992 - DNA, 34 bp, Homo sapiens; identical to SEQ ID NO: 8102
  misc_feature 1..34: note = chr5:145724804-145724838
  misc_feature 1..34: note = hyper
  source 1..34: mol_type = genomic DNA

SEQ ID NO: 18993 - DNA, 183 bp, Homo sapiens
  misc_feature 1..183: note = chr5:146257602-146257785
  misc_feature 1..183: note = hyper
  source 1..183: mol_type = genomic DNA
ttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagag

SEQ ID NO: 18994 - DNA, 30 bp, Homo sapiens; identical to SEQ ID NO: 8106
  misc_feature 1..30: note = chr5:146258370-146258400
  misc_feature 1..30: note = hyper
  source 1..30: mol_type = genomic DNA

SEQ ID NO: 18995 - DNA, 309 bp, Homo sapiens; identical to SEQ ID NO: 8107
  misc_feature 1..309: note = chr5:146888874-146889183
  misc_feature 1..309: note = hyper
  source 1..309: mol_type = genomic DNA

SEQ ID NO: 18996 - DNA, 160 bp, Homo sapiens; identical to SEQ ID NO: 8110
  misc_feature 1..160: note = chr5:148206272-148206432
  misc_feature 1..160: note = hyper
  source 1..160: mol_type = genomic DNA

SEQ ID NO: 18997 - DNA, 299 bp, Homo sapiens; identical to SEQ ID NO: 8111
  misc_feature 1..299: note = chr5:148651823-148652122
  misc_feature 1..299: note = hyper
  source 1..299: mol_type = genomic DNA

SEQ ID NO: 18998 - DNA, 71 bp, Homo sapiens; identical to SEQ ID NO: 8112
  misc_feature 1..71: note = chr5:149569700-149569771
  misc_feature 1..71: note = hyper
  source 1..71: mol_type = genomic DNA

SEQ ID NO: 18999 - DNA, 13 bp, Homo sapiens
  misc_feature 1..13: note = chr5:149682061-149682074
  misc_feature 1..13: note = hyper
  source 1..13: mol_type = genomic DNA
gtccagtgtctgg

SEQ ID NO: 19000 - DNA, 138 bp, Homo sapiens
  misc_feature 1..138: note = chr5:150399985-150400123
  misc_feature 1..138: note = hyper
  source 1..138: mol_type = genomic DNA
tgcttatgtcactgtcgccccgggacggggaggtggggagctgagggcaagtcgcgcccgcccctgaaatcccagccgcctagcgattggctgcaagggtctcggcttggccgcggattggtcacacccgagggcttg

SEQ ID NO: 19001 - DNA, 206 bp, Homo sapiens
  misc_feature 1..206: note = chr5:150400203-150400409
  misc_feature 1..206: note = hyper
  source 1..206: mol_type = genomic DNA
ccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaat

SEQ ID NO: 19002 - skipped

SEQ ID NO: 19003 - DNA, 147 bp, Homo sapiens
  misc_feature 1..147: note = chr5:151304224-151304371
  misc_feature 1..147: note = hyper
  source 1..147: mol_type = genomic DNA
ggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctg

SEQ ID NO: 19004 - DNA, 238 bp, Homo sapiens
  misc_feature 1..238: note = chr5:151304401-151304639
  misc_feature 1..238: note = hyper
  source 1..238: mol_type = genomic DNA
cctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttga

SEQ ID NO: 19005 - DNA, 33 bp, Homo sapiens; identical to SEQ ID NO: 8118
  misc_feature 1..33: note = chr5:151304708-151304741
  misc_feature 1..33: note = hyper
  source 1..33: mol_type = genomic DNA

SEQ ID NO: 19006 - DNA, 97 bp, Homo sapiens; identical to SEQ ID NO: 2664
  misc_feature 1..97: note = chr5:152870193-152870290
  misc_feature 1..97: note = hyper
  source 1..97: mol_type = genomic DNA

SEQ ID NO: 19007 - DNA, 27 bp, Homo sapiens
  misc_feature 1..27: note = chr5:153853277-153853304
  misc_feature 1..27: note = hyper
  source 1..27: mol_type = genomic DNA
gcccgcgtggcctctcggcccctgcta

SEQ ID NO: 19008 - DNA, 34 bp, Homo sapiens
  misc_feature 1..34: note = chr5:153853386-153853420
  misc_feature 1..34: note = hyper
  source 1..34: mol_type = genomic DNA
cgaggccctgccccggagctgcctgaggtctcct

SEQ ID NO: 19009 - DNA, 41 bp, Homo sapiens
  misc_feature 1..41: note = chr5:153853478-153853519
  misc_feature 1..41: note = hyper
  source 1..41: mol_type = genomic DNA
agcctcacgggtctcccctcctccttcgcagtgagcgccgc

SEQ ID NO: 19010 - DNA, 36 bp, Homo sapiens; identical to SEQ ID NO: 8126
  misc_feature 1..36: note = chr5:153856624-153856660
  misc_feature 1..36: note = hyper
  source 1..36: mol_type = genomic DNA

SEQ ID NO: 19011 - DNA, 109 bp, Homo sapiens
  misc_feature 1..109: note = chr5:153856996-153857105
  misc_feature 1..109: note = hyper
  source 1..109: mol_type = genomic DNA
ggctggagcatgcaagccccaggactcaccagctcccttttccgcttgctctcacggccgccatccgccttcttgagttcagccttgaaggcctcgggatcgccagact

SEQ ID NO: 19012 - DNA, 30 bp, Homo sapiens; identical to SEQ ID NO: 8128
  misc_feature 1..30: note = chr5:153857851-153857881
  misc_feature 1..30: note = hyper
  source 1..30: mol_type = genomic DNA

SEQ ID NO: 19013 - DNA, 17 bp, Homo sapiens
  misc_feature 1..17: note = chr5:153858878-153858895
  misc_feature 1..17: note = hyper
  source 1..17: mol_type = genomic DNA
agactgcacagcatccg

SEQ ID NO: 19014 - DNA, 18 bp, Homo sapiens
  misc_feature 1..18: note = chr5:153858916-153858934
  misc_feature 1..18: note = hyper
  source 1..18: mol_type = genomic DNA
cgacgtccggcatctctc

SEQ ID NO: 19015 - DNA, 23 bp, Homo sapiens
  misc_feature 1..23: note = chr5:153863394-153863417
  misc_feature 1..23: note = hyper
  source 1..23: mol_type = genomic DNA
gagagatgtctgcttcgggacgc

SEQ ID NO: 19016 - skipped

SEQ ID NO: 19017 - DNA, 53 bp, Homo sapiens; identical to SEQ ID NO: 8136
  misc_feature 1..53: note = chr5:153990970-153991023
  misc_feature 1..53: note = hyper
  source 1..53: mol_type = genomic DNA

SEQ ID NO: 19018 - DNA, 406 bp, Homo sapiens
  misc_feature 1..406: note = chr5:155107388-155107794
  misc_feature 1..406: note = hyper
  source 1..406: mol_type = genomic DNA
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcac

SEQ ID NO: 19019 - DNA, 86 bp, Homo sapiens
  misc_feature 1..86: note = chr5:155108763-155108849
  misc_feature 1..86: note = hyper
  source 1..86: mol_type = genomic DNA
aaaggggctccctagagcagatcgctgacttcctcaccaacgtgccatttggggcttttcagccgcccgcgcgttaagctagctcc

SEQ ID NO: 19020 - DNA, 240 bp, Homo sapiens; identical to SEQ ID NO: 8140
  misc_feature 1..240: note = chr5:155109207-155109447
  misc_feature 1..240: note = hyper
  source 1..240: mol_type = genomic DNA

SEQ ID NO: 19021 - DNA, 259 bp, Homo sapiens; identical to SEQ ID NO: 8141
  misc_feature 1..259: note = chr5:156887194-156887453
  misc_feature 1..259: note = hyper
  source 1..259: mol_type = genomic DNA

SEQ ID NO: 19022 - DNA, 15 bp, Homo sapiens
  misc_feature 1..15: note = chr5:157001843-157001858
  misc_feature 1..15: note = hyper
  source 1..15: mol_type = genomic DNA
cgcttcacagaaggg

SEQ ID NO: 19023 - DNA, 18 bp, Homo sapiens
  misc_feature 1..18: note = chr5:157098344-157098362
  misc_feature 1..18: note = hyper
  source 1..18: mol_type = genomic DNA
cacttcttccagacccgt

SEQ ID NO: 19024 - DNA, 40 bp, Homo sapiens
  misc_feature 1..40: note = chr5:157098619-157098659
  misc_feature 1..40: note = hyper
  source 1..40: mol_type = genomic DNA
gcaatgacacagccgactaggccctcggtcacctgtgacc

SEQ ID NO: 19025 - skipped

SEQ ID NO: 19026 - DNA, 24 bp, Homo sapiens
  misc_feature 1..24: note = chr5:158478764-158478788
  misc_feature 1..24: note = hyper
  source 1..24: mol_type = genomic DNA
agccgatcccgctttgcagttgtg

SEQ ID NO: 19027-19028 - skipped (2 entries)

SEQ ID NO: 19029 - DNA, 88 bp, Homo sapiens; identical to SEQ ID NO: 8149
  misc_feature 1..88: note = chr5:158533565-158533653
  misc_feature 1..88: note = hyper
  source 1..88: mol_type = genomic DNA

SEQ ID NO: 19030 - DNA, 23 bp, Homo sapiens
  misc_feature 1..23: note = chr5:159399072-159399095
  misc_feature 1..23: note = hyper
  source 1..23: mol_type = genomic DNA
tcgcctgggcggctgcgcctaca

SEQ ID NO: 19031 - DNA, 262 bp, Homo sapiens; identical to SEQ ID NO: 8151
  misc_feature 1..262: note = chr5:160973528-160973790
  misc_feature 1..262: note = hyper
  source 1..262: mol_type = genomic DNA

SEQ ID NO: 19032 - DNA, 40 bp, Homo sapiens; identical to SEQ ID NO: 8152
  misc_feature 1..40: note = chr5:160974819-160974859
  misc_feature 1..40: note = hyper
  source 1..40: mol_type = genomic DNA

SEQ ID NO: 19033 - DNA, 235 bp, Homo sapiens; identical to SEQ ID NO: 8153
  misc_feature 1..235: note = chr5:160975112-160975347
  misc_feature 1..235: note = hyper
  source 1..235: mol_type = genomic DNA

SEQ ID NO: 19034 - DNA, 100 bp, Homo sapiens; identical to SEQ ID NO: 8154
  misc_feature 1..100: note = chr5:160975348-160975448
  misc_feature 1..100: note = hyper
  source 1..100: mol_type = genomic DNA

SEQ ID NO: 19035 - DNA, 180 bp, Homo sapiens
  misc_feature 1..180: note = chr5:160975754-160975934
  misc_feature 1..180: note = hyper
  source 1..180: mol_type = genomic DNA
aactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcc

SEQ ID NO: 19036 - DNA, 15 bp, Homo sapiens
  misc_feature 1..15: note = chr5:160975955-160975970
  misc_feature 1..15: note = hyper
  source 1..15: mol_type = genomic DNA
cggaagtagctccac

SEQ ID NO: 19037 - DNA, 30 bp, Homo sapiens; identical to SEQ ID NO: 8157
  misc_feature 1..30: note = chr5:161274605-161274635
  misc_feature 1..30: note = hyper
  source 1..30: mol_type = genomic DNA

SEQ ID NO: 19038 - DNA, 30 bp, Homo sapiens; identical to SEQ ID NO: 8158
  misc_feature 1..30: note = chr5:162931253-162931283
  misc_feature 1..30: note = hyper
  source 1..30: mol_type = genomic DNA

SEQ ID NO: 19039 - DNA, 79 bp, Homo sapiens; identical to SEQ ID NO: 8159
  misc_feature 1..79: note = chr5:162931522-162931601
  misc_feature 1..79: note = hyper
  source 1..79: mol_type = genomic DNA

SEQ ID NO: 19040 - DNA, 37 bp, Homo sapiens; identical to SEQ ID NO: 8160
  misc_feature 1..37: note = chr5:166405784-166405821
  misc_feature 1..37: note = hyper
  source 1..37: mol_type = genomic DNA

SEQ ID NO: 19041 - DNA, 30 bp, Homo sapiens; identical to SEQ ID NO: 8161
  misc_feature 1..30: note = chr5:166406285-166406315
  misc_feature 1..30: note = hyper
  source 1..30: mol_type = genomic DNA

SEQ ID NO: 19042 - DNA, 87 bp, Homo sapiens
  misc_feature 1..87: note = chr5:167956090-167956177
  misc_feature 1..87: note = hyper
  source 1..87: mol_type = genomic DNA
tggcacagccaggaccgacgctgatgcttacctccccctctcctgcagcagagacgcccccgtccctgtggcccagggaagtgccag

SEQ ID NO: 19043 - DNA, 42 bp, Homo sapiens; identical to SEQ ID NO: 8164
  misc_feature 1..42: note = chr5:168727504-168727546
  misc_feature 1..42: note = hyper
  source 1..42: mol_type = genomic DNA

SEQ ID NO: 19044 - DNA, 82 bp, Homo sapiens; identical to SEQ ID NO: 8166
  misc_feature 1..82: note = chr5:168727994-168728076
  misc_feature 1..82: note = hyper
  source 1..82: mol_type = genomic DNA

SEQ ID NO: 19045 - DNA, 35 bp, Homo sapiens; identical to SEQ ID NO: 8167
  misc_feature 1..35: note = chr5:168728077-168728112
  misc_feature 1..35: note = hyper
  source 1..35: mol_type = genomic DNA

SEQ ID NO: 19046 - DNA, 30 bp, Homo sapiens; identical to SEQ ID NO: 8168
  misc_feature 1..30: note = chr5:168728323-168728353
  misc_feature 1..30: note = hyper
  source 1..30: mol_type = genomic DNA

SEQ ID NO: 19047 - DNA, 63 bp, Homo sapiens; identical to SEQ ID NO: 8169
  misc_feature 1..63: note = chr5:169064022-169064085
  misc_feature 1..63: note = hyper
  source 1..63: mol_type = genomic DNA

SEQ ID NO: 19048 - DNA, 32 bp, Homo sapiens
  misc_feature 1..32: note = chr5:169064295-169064327
  misc_feature 1..32: note = hyper
  source 1..32: mol_type = genomic DNA
ttccccacgggaggacgcgaggccccggccca

SEQ ID NO: 19049 - DNA, 38 bp, Homo sapiens; identical to SEQ ID NO: 8172
  misc_feature 1..38: note = chr5:169931409-169931447
  misc_feature 1..38: note = hyper
  source 1..38: mol_type = genomic DNA

SEQ ID NO: 19050 - DNA, 253 bp, Homo sapiens
  misc_feature 1..253: note = chr5:170108034-170108287
  misc_feature 1..253: note = hyper
  source 1..253: mol_type = genomic DNA
ccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccga

SEQ ID NO: 19051 - DNA, 40 bp, Homo sapiens
  misc_feature 1..40: note = chr5:170108372-170108412
  misc_feature 1..40: note = hyper
  source 1..40: mol_type = genomic DNA
tgaaatgtggtgcgcctggggagtgcgggagccaggaagt

SEQ ID NO: 19052 - DNA, 23 bp, Homo sapiens
  misc_feature 1..23: note = chr5:170735131-170735154
  misc_feature 1..23: note = hyper
  source 1..23: mol_type = genomic DNA
ggaagaaaatgattccgcttgtc

SEQ ID NO: 19053 - DNA, 25 bp, Homo sapiens
  misc_feature 1..25: note = chr5:170735206-170735231
  misc_feature 1..25: note = hyper
  source 1..25: mol_type = genomic DNA
tgccctgggccgggtagacagtcac

SEQ ID NO: 19054 - DNA, 256 bp, Homo sapiens
  misc_feature 1..256: note = chr5:170737479-170737735
  misc_feature 1..256: note = hyper
  source 1..256: mol_type = genomic DNA
ttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccacccccgccccaaacacacag

SEQ ID NO: 19055 - DNA, 342 bp, Homo sapiens
  misc_feature 1..342: note = chr5:170739481-170739823
  misc_feature 1..342: note = hyper
  source 1..342: mol_type = genomic DNA
tccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccgga

SEQ ID NO: 19056 - skipped

SEQ ID NO: 19057 - DNA, 30 bp, Homo sapiens; identical to SEQ ID NO: 8190
  misc_feature 1..30: note = chr5:170745324-170745354
  misc_feature 1..30: note = hyper
  source 1..30: mol_type = genomic DNA

SEQ ID NO: 19058 - DNA, 28 bp, Homo sapiens
  misc_feature 1..28: note = chr5:172655851-172655879
  misc_feature 1..28: note = hyper
  source 1..28: mol_type = genomic DNA
cgctgggcctgagctcggaatgcttccc

SEQ ID NO: 19059 - DNA, 146 bp, Homo sapiens
  misc_feature 1..146: note = chr5:172661684-172661830
  misc_feature 1..146: note = hyper
  source 1..146: mol_type = genomic DNA
tggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaa

SEQ ID NO: 19060 - DNA, 157 bp, Homo sapiens; identical to SEQ ID NO: 8198
  misc_feature 1..157: note = chr5:172662041-172662198
  misc_feature 1..157: note = hyper
  source 1..157: mol_type = genomic DNA

SEQ ID NO: 19061 - DNA, 81 bp, Homo sapiens
  misc_feature 1..81: note = chr5:172664487-172664568
  misc_feature 1..81: note = hyper
  source 1..81: mol_type = genomic DNA
ctgctggccaggcggctcgcgatgacagtttgaaagattagtgtgagcggacgcctgaaatattaccgtttaatgggggac

SEQ ID NO: 19062 - DNA, 49 bp, Homo sapiens
  misc_feature 1..49: note = chr5:172665812-172665861
  misc_feature 1..49: note = hyper
  source 1..49: mol_type = genomic DNA
cctccgcctccgcctccgcgctgggcccctccgccgcccggcttccttc

SEQ ID NO: 19063 - DNA, 50 bp, Homo sapiens
  misc_feature 1..50: note = chr5:172670933-172670983
  misc_feature 1..50: note = hyper
  source 1..50: mol_type = genomic DNA
ccaccccttctgccccgacggctgcaaaccgcttcagccaaaacgggcgg

SEQ ID NO: 19064 - DNA, 64 bp, Homo sapiens
  misc_feature 1..64: note = chr5:172671018-172671082
  misc_feature 1..64: note = hyper
  source 1..64: mol_type = genomic DNA
ctcggagtcccgtcgctggaggtcacagctgggaaaatcaggtgacattcgagtcagatggaca

SEQ ID NO: 19065 - DNA, 92 bp, Homo sapiens; identical to SEQ ID NO: 8204
  misc_feature 1..92: note = chr5:172672801-172672893
  misc_feature 1..92: note = hyper
  source 1..92: mol_type = genomic DNA

SEQ ID NO: 19066 - DNA, 26 bp, Homo sapiens
  misc_feature 1..26: note = chr5:172754563-172754589
  misc_feature 1..26: note = hyper
  source 1..26: mol_type = genomic DNA
aaagttctgggatgtcgggcatcttt

SEQ ID NO: 19067 - DNA, 211 bp, Homo sapiens
  misc_feature 1..211: note = chr5:172754621-172754832
  misc_feature 1..211: note = hyper
  source 1..211: mol_type = genomic DNA
ggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttc

SEQ ID NO: 19068 - DNA, 671 bp, Homo sapiens
  misc_feature 1..671: note = chr5:172756377-172757048
  misc_feature 1..671: note = hyper
  source 1..671: mol_type = genomic DNA
caaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccagg

SEQ ID NO: 19069 - DNA, 55 bp, Homo sapiens; identical to SEQ ID NO: 8210
  misc_feature 1..55: note = chr5:174119987-174120042
  misc_feature 1..55: note = hyper
  source 1..55: mol_type = genomic DNA

SEQ ID NO: 19070 - DNA, 95 bp, Homo sapiens
  misc_feature 1..95: note = chr5:174147428-174147523
  misc_feature 1..95: note = hyper
  source 1..95: mol_type = genomic DNA
ctctctgcgcctggacgacttcatctgtggaatggggagaaagctcaggctttagggggccttcagtaatctgcatcgtgcttttggcaaaagct

SEQ ID NO: 19071 - DNA, 37 bp, Homo sapiens; identical to SEQ ID NO: 8213
  misc_feature 1..37: note = chr5:174162509-174162546
  misc_feature 1..37: note = hyper
  source 1..37: mol_type = genomic DNA

SEQ ID NO: 19072 - DNA, 30 bp, Homo sapiens; identical to SEQ ID NO: 8214
  misc_feature 1..30: note = chr5:174162799-174162829
  misc_feature 1..30: note = hyper
  source 1..30: mol_type = genomic DNA

SEQ ID NO: 19073 - DNA, 120 bp, Homo sapiens; identical to SEQ ID NO: 8215
  misc_feature 1..120: note = chr5:174178667-174178787
  misc_feature 1..120: note = hyper
  source 1..120: mol_type = genomic DNA

SEQ ID NO: 19074 - DNA, 388 bp, Homo sapiens
  misc_feature 1..388: note = chr5:174870786-174871174
  misc_feature 1..388: note = hyper
  source 1..388: mol_type = genomic DNA
gcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcacc

SEQ ID NO: 19075 - DNA, 381 bp, Homo sapiens
  misc_feature 1..381: note = chr5:174871497-174871878
  misc_feature 1..381: note = hyper
  source 1..381: mol_type = genomic DNA
acccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtg

SEQ ID NO: 19076 - DNA, 73 bp, Homo sapiens
  misc_feature 1..73: note = chr5:175085074-175085147
  misc_feature 1..73: note = hyper
  source 1..73: mol_type = genomic DNA
catccctgcccggagcgcagccggcgcgggcgcgggaccgaggcgaaccgggtgcggagccaatacccgcggc

SEQ ID NO: 19077 - DNA, 106 bp, Homo sapiens
  misc_feature 1..106: note = chr5:175085209-175085315
  misc_feature 1..106: note = hyper
  source 1..106: mol_type = genomic DNA
ggcgggcttggggacccggcgtgggctggcggagccgcccgaggggctgctcgggatccccggcggccgtcgtggccccgaacccgggttcgagcctcggccccac

SEQ ID NO: 19078 - DNA, 30 bp, Homo sapiens; identical to SEQ ID NO: 2706
  misc_feature 1..30: note = chr5:175223920-175223950
  misc_feature 1..30: note = hyper
  source 1..30: mol_type = genomic DNA

SEQ ID NO: 19079 - DNA, 92 bp, Homo sapiens; identical to SEQ ID NO: 8220
  misc_feature 1..92: note = chr5:175224643-175224735
  misc_feature 1..92: note = hyper
  source 1..92: mol_type = genomic DNA

SEQ ID NO: 19080 - DNA, 40 bp, Homo sapiens; identical to SEQ ID NO: 8222
  misc_feature 1..40: note = chr5:175298910-175298950
  misc_feature 1..40: note = hyper
  source 1..40: mol_type = genomic DNA

SEQ ID NO: 19081 - DNA, 161 bp, Homo sapiens; identical to SEQ ID NO: 8224
  misc_feature 1..161: note = chr5:175299980-175300141
  misc_feature 1..161: note = hyper
  source 1..161: mol_type = genomic DNA

SEQ ID NO: 19082 - DNA, 29 bp, Homo sapiens
  misc_feature 1..29: note = chr5:175300142-175300171
  misc_feature 1..29: note = hyper
  source 1..29: mol_type = genomic DNA
cagggatagaccaaggcttcccgcagaat

SEQ ID NO: 19083 - DNA, 135 bp, Homo sapiens
  misc_feature 1..135: note = chr5:175300216-175300351
  misc_feature 1..135: note = hyper
  source 1..135: mol_type = genomic DNA
cggcaacctgctggacctcagcactcccgcaggcatatggcaaaacatacacacacacacaccctgcacacacgcacgcactcacacgatgtctaagtccagagttgcacacacggggtcatactttcaacgcac

SEQ ID NO: 19084 - DNA, 31 bp, Homo sapiens
  misc_feature 1..31: note = chr5:175300381-175300412
  misc_feature 1..31: note = hyper
  source 1..31: mol_type = genomic DNA
ttcaacccggcacacacgtcctcaggatcta

SEQ ID NO: 19085 - DNA, 42 bp, Homo sapiens; identical to SEQ ID NO: 8227
  misc_feature 1..42: note = chr5:175488184-175488226
  misc_feature 1..42: note = hyper
  source 1..42: mol_type = genomic DNA

SEQ ID NO: 19086 - DNA, 180 bp, Homo sapiens; identical to SEQ ID NO: 8228
  misc_feature 1..180: note = chr5:175560567-175560747
  misc_feature 1..180: note = hyper
  source 1..180: mol_type = genomic DNA

SEQ ID NO: 19087 - DNA, 11 bp, Homo sapiens
  misc_feature 1..11: note = chr5:175621379-175621390
  misc_feature 1..11: note = hyper
  source 1..11: mol_type = genomic DNA
tctccaagctg

SEQ ID NO: 19088 - DNA, 101 bp, Homo sapiens; identical to SEQ ID NO: 8230
  misc_feature 1..101: note = chr5:175792208-175792309
  misc_feature 1..101: note = hyper
  source 1..101: mol_type = genomic DNA

SEQ ID NO: 19089 - skipped

SEQ ID NO: 19090 - DNA, 30 bp, Homo sapiens; identical to SEQ ID NO: 8234
  misc_feature 1..30: note = chr5:176038550-176038580
  misc_feature 1..30: note = hyper
  source 1..30: mol_type = genomic DNA

SEQ ID NO: 19091 - DNA, 57 bp, Homo sapiens
  misc_feature 1..57: note = chr5:176046306-176046363
  misc_feature 1..57: note = hyper
  source 1..57: mol_type = genomic DNA
gagagagggcctctgcggcaagagggcaggggcggggcctcgcgcagggactgccta

SEQ ID NO: 19092 - DNA, 24 bp, Homo sapiens
  misc_feature 1..24: note = chr5:176046554-176046578
  misc_feature 1..24: note = hyper
  source 1..24: mol_type = genomic DNA
cggcgccttcgtgggggtgggagg

SEQ ID NO: 19093 - DNA, 458 bp, Homo sapiens; identical to SEQ ID NO: 2708
  misc_feature 1..458: note = chr5:176056505-176056963
  misc_feature 1..458: note = hyper
  source 1..458: mol_type = genomic DNA

SEQ ID NO: 19094 - DNA, 103 bp, Homo sapiens; identical to SEQ ID NO: 8237
  misc_feature 1..103: note = chr5:176057411-176057514
  misc_feature 1..103: note = hyper
  source 1..103: mol_type = genomic DNA

SEQ ID NO: 19095 - DNA, 95 bp, Homo sapiens; identical to SEQ ID NO: 2711
  misc_feature 1..95: note = chr5:177411327-177411422
  misc_feature 1..95: note = hyper
  source 1..95: mol_type = genomic DNA

SEQ ID NO: 19096 - DNA, 15 bp, Homo sapiens
  misc_feature 1..15: note = chr5:177411507-177411522
  misc_feature 1..15: note = hyper
  source 1..15: mol_type = genomic DNA
cgcggagatgggcca

SEQ ID NO: 19097 - DNA, 77 bp, Homo sapiens
  misc_feature 1..77: note = chr5:177412141-177412218
  misc_feature 1..77: note = hyper
  source 1..77: mol_type = genomic DNA
atcgtaaacggggcaacttccaactctgccagttttaagcttctagagtatctcctcggcggagcgcggtggctcac

SEQ ID NO: 19098 - DNA, 197 bp, Homo sapiens; identical to SEQ ID NO: 8249
  misc_feature 1..197: note = chr5:178450910-178451107
  misc_feature 1..197: note = hyper
  source 1..197: mol_type = genomic DNA

SEQ ID NO: 19099 - DNA, 26 bp, Homo sapiens
  misc_feature 1..26: note = chr5:178487398-178487424
  misc_feature 1..26: note = hyper
  source 1..26: mol_type = genomic DNA
cggggacagctcgcggcctttcgggg

SEQ ID NO: 19100 - DNA, 30 bp, Homo sapiens; identical to SEQ ID NO: 8252
  misc_feature 1..30: note = chr5:178487700-178487730
  misc_feature 1..30: note = hyper
  source 1..30: mol_type = genomic DNA

SEQ ID NO: 19101 - DNA, 81 bp, Homo sapiens; identical to SEQ ID NO: 8253
  misc_feature 1..81: note = chr5:178594307-178594388
  misc_feature 1..81: note = hyper
  source 1..81: mol_type = genomic DNA

SEQ ID NO: 19102 - DNA, 100 bp, Homo sapiens; identical to SEQ ID NO: 2716
  misc_feature 1..100: note = chr5:178770805-178770905
  misc_feature 1..100: note = hyper
  source 1..100: mol_type = genomic DNA

SEQ ID NO: 19103 - DNA, 116 bp, Homo sapiens
  misc_feature 1..116: note = chr5:178771198-178771314
  misc_feature 1..116: note = hyper
  source 1..116: mol_type = genomic DNA
cggagccccagtgcctcagagacccgccggcaagccacgcccccccagaccccgccccactgcgaagggaaggggcattccgccaggcgaccccagaagccagcctgcacctcccc

SEQ ID NO: 19104 - skipped

SEQ ID NO: 19105 - DNA, 21 bp, Homo sapiens
  misc_feature 1..21: note = chr5:178772184-178772205
  misc_feature 1..21: note = hyper
  source 1..21: mol_type = genomic DNA
acctacctggggggtcggcgg

SEQ ID NO: 19106 - DNA, 331 bp, Homo sapiens
  misc_feature 1..331: note = chr5:178772272-178772603
  misc_feature 1..331: note = hyper
  source 1..331: mol_type = genomic DNA
cagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacc

SEQ ID NO: 19107 - DNA, 58 bp, Homo sapiens; identical to SEQ ID NO: 2722
  misc_feature 1..58: note = chr5:178772778-178772836
  misc_feature 1..58: note = hyper
  source 1..58: mol_type = genomic DNA

SEQ ID NO: 19108 - skipped

SEQ ID NO: 19109 - DNA, 22 bp, Homo sapiens
  misc_feature 1..22: note = chr5:179244320-179244342
  misc_feature 1..22: note = hyper
  source 1..22: mol_type = genomic DNA
gggcgttcgtcctccatccctc

SEQ ID NO: 19110 - DNA, 135 bp, Homo sapiens; identical to SEQ ID NO: 8263
  misc_feature 1..135: note = chr5:179779648-179779783
  misc_feature 1..135: note = hyper
  source 1..135: mol_type = genomic DNA

SEQ ID NO: 19111 - DNA, 173 bp, Homo sapiens; identical to SEQ ID NO: 8264
  misc_feature 1..173: note = chr5:179779840-179780013
  misc_feature 1..173: note = hyper
  source 1..173: mol_type = genomic DNA

SEQ ID NO: 19112 - DNA, 69 bp, Homo sapiens
  misc_feature 1..69: note = chr5:179780035-179780104
  misc_feature 1..69: note = hyper
  source 1..69: mol_type = genomic DNA
cgggtgaggggcagccaggcccggccgacgacagcccctcggtaggggcccggggcagatcggcgcccc

SEQ ID NO: 19113 - DNA, 118 bp, Homo sapiens
  misc_feature 1..118: note = chr5:179780144-179780262
  misc_feature 1..118: note = hyper
  source 1..118: mol_type = genomic DNA
agaggctgcggcgccgggacccgcggacggcgtggaggaggcggctcgggcgggcgcggcactcaccgcacatcgtggctgcttctcgggctccttcgcggctcgagggggtctgccc

SEQ ID NO: 19114 - DNA, 178 bp, Homo sapiens
  misc_feature 1..178: note = chr5:179780528-179780706
  misc_feature 1..178: note = hyper
  source 1..178: mol_type = genomic DNA
gtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacgggg

SEQ ID NO: 19115 - DNA, 242 bp, Homo sapiens
  misc_feature 1..242: note = chr5:179780985-179781227
  misc_feature 1..242: note = hyper
  source 1..242: mol_type = genomic DNA
ccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcact

SEQ ID NO: 19116 - DNA, 126 bp, Homo sapiens
  misc_feature 1..126: note = chr5:180017198-180017324
  misc_feature 1..126: note = hyper
  source 1..126: mol_type = genomic DNA
ttgtcctcaggtgtagatgctccagtctcggctcagccaaacactgtcagggccccctggaaagcagaagccgagcttgagtgcccccagccctgccaccaagaactcaggcgggggcgcggcagc

SEQ ID NO: 19117 - DNA, 72 bp, Homo sapiens
  misc_feature 1..72: note = chr5:180017536-180017608
  misc_feature 1..72: note = hyper
  source 1..72: mol_type = genomic DNA
agttttgaggctggccgggaagggatgcccgcgcaggaagggcacccggggtgcccactttaccagcagggc

SEQ ID NO: 19118 - DNA, 199 bp, Homo sapiens
  misc_feature 1..199: note = chr5:180017933-180018132
  misc_feature 1..199: note = hyper
  source 1..199: mol_type = genomic DNA
gcgccctgcccggctccccgaccgcccctccctcctgcgccgaggcctgccaggtgcgagcccccgggacacaggcgggtctggggaggcggccccgccaggagacgctgcagggtcaccggagtggcctgagggtggcggaaggaccggtgaactctgtgcagggtccgggacaggcccccaagggaggggacactcg

SEQ ID NO: 19119 - DNA, 112 bp, Homo sapiens
  misc_feature 1..112: note = chr5:180018498-180018610
  misc_feature 1..112: note = hyper
  source 1..112: mol_type = genomic DNA
tgcccgggcaaggccacgaggcttcttatacccggtcctcgcccctccagcgccggcctcgcccgcgctcctgagaaagccctgcccgctccgctcacggccgtgccctggc

SEQ ID NO: 19120 - DNA, 32 bp, Homo sapiens
  misc_feature 1..32: note = chr5:180075814-180075846
  misc_feature 1..32: note = hyper
  source 1..32: mol_type = genomic DNA
ctgtcccctcaaatccggggacccctggcctt

SEQ ID NO: 19121 - DNA, 141 bp, Homo sapiens
  misc_feature 1..141: note = chr5:180076317-180076458
  misc_feature 1..141: note = hyper
  source 1..141: mol_type = genomic DNA
ccgaggtcccgcgccccaagcgccgtgctcccctcaggcgtccgcgcaccagggccaccgtgtcccccgcccgtacccggcggagcggtctcagcgcccgccccaggtgcgcggtaccccctccccggccagccccacgct

SEQ ID NO: 19122 - DNA, 35 bp, Homo sapiens
  misc_feature 1..35: note = chr5:180076532-180076567
  misc_feature 1..35: note = hyper
  source 1..35: mol_type = genomic DNA
cgccccgctgcatctccggccgctgcgcgtgggtc

SEQ ID NO: 19123 - DNA, 202 bp, Homo sapiens
  misc_feature 1..202: note = chr5:180076602-180076804
  misc_feature 1..202: note = hyper
  source 1..202: mol_type = genomic DNA
ccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcggg

SEQ ID NO: 19124 - DNA, 30 bp, Homo sapiens; identical to SEQ ID NO: 8275
  misc_feature 1..30: note = chr5:180100685-180100715
  misc_feature 1..30: note = hyper
  source 1..30: mol_type = genomic DNA

SEQ ID NO: 19125 - DNA, 39 bp, Homo sapiens; identical to SEQ ID NO: 8277
  misc_feature 1..39: note = chr5:180527793-180527832
  misc_feature 1..39: note = hyper
  source 1..39: mol_type = genomic DNA

SEQ ID NO: 19126 - DNA, 135 bp, Homo sapiens; identical to SEQ ID NO: 2732
  misc_feature 1..135: note = chr5:180531170-180531305
  misc_feature 1..135: note = hyper
  source 1..135: mol_type = genomic DNA

SEQ ID NO: 19127 - DNA, 45 bp, Homo sapiens; identical to SEQ ID NO: 8288
  misc_feature 1..45: note = chr6:1314017-1314062
  misc_feature 1..45: note = hyper
  source 1..45: mol_type = genomic DNA

SEQ ID NO: 19128 - DNA, 23 bp, Homo sapiens
  misc_feature 1..23: note = chr6:1378199-1378222
  misc_feature 1..23: note = hyper
  source 1..23: mol_type = genomic DNA
catattggaggaagtcggccggc

SEQ ID NO: 19129 - DNA, 123 bp, Homo sapiens; identical to SEQ ID NO: 8290
  misc_feature 1..123: note = chr6:1379267-1379390
  misc_feature 1..123: note = hyper
  source 1..123: mol_type = genomic DNA

SEQ ID NO: 19130 - DNA, 363 bp, Homo sapiens; identical to SEQ ID NO: 8291
  misc_feature 1..363: note = chr6:1383078-1383441
  misc_feature 1..363: note = hyper
  source 1..363: mol_type = genomic DNA

SEQ ID NO: 19131 - DNA, 54 bp, Homo sapiens
  misc_feature 1..54: note = chr6:1385170-1385224
  misc_feature 1..54: note = hyper
  source 1..54: mol_type = genomic DNA
tgcggaaatggggtgaggccggtcttcgcttgagggtctcgtagattggacccc

SEQ ID NO: 19132 - DNA, 63 bp, Homo sapiens; identical to SEQ ID NO: 8297
  misc_feature 1..63: note = chr6:1389953-1390016
  misc_feature 1..63: note = hyper
  source 1..63: mol_type = genomic DNA

SEQ ID NO: 19133 - DNA, 283 bp, Homo sapiens
  misc_feature 1..283: note = chr6:1391035-1391318
  misc_feature 1..283: note = hyper
  source 1..283: mol_type = genomic DNA
tggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagag

SEQ ID NO: 19134 - DNA, 27 bp, Homo sapiens
  misc_feature 1..27: note = chr6:1391379-1391406
  misc_feature 1..27: note = hyper
  source 1..27: mol_type = genomic DNA
agctgggcgcaccgcttctaggcctcc

SEQ ID NO: 19135 - DNA, 30 bp, Homo sapiens; identical to SEQ ID NO: 8300
  misc_feature 1..30: note = chr6:1605320-1605350
  misc_feature 1..30: note = hyper
  source 1..30: mol_type = genomic DNA

SEQ ID NO: 19136 - DNA, 347 bp, Homo sapiens; identical to SEQ ID NO: 8301
  misc_feature 1..347: note = chr6:1611408-1611755
  misc_feature 1..347: note = hyper
  source 1..347: mol_type = genomic DNA

SEQ ID NO: 19137 - DNA, 440 bp, Homo sapiens; identical to SEQ ID NO: 8303
  misc_feature 1..440: note = chr6:2903077-2903517
  misc_feature 1..440: note = hyper
  source 1..440: mol_type = genomic DNA

SEQ ID NO: 19138 - DNA, 18 bp, Homo sapiens
  misc_feature 1..18: note = chr6:3229011-3229029
  misc_feature 1..18: note = hyper
  source 1..18: mol_type = genomic DNA
tttcttatcttccatcgc

SEQ ID NO: 19139 - DNA, 39 bp, Homo sapiens; identical to SEQ ID NO: 8305
  misc_feature 1..39: note = chr6:3231729-3231768
  misc_feature 1..39: note = hyper
  source 1..39: mol_type = genomic DNA

SEQ ID NO: 19140 - DNA, 41 bp, Homo sapiens; identical to SEQ ID NO: 8306
  misc_feature 1..41: note = chr6:4775411-4775452
  misc_feature 1..41: note = hyper
  source 1..41: mol_type = genomic DNA

SEQ ID NO: 19141 - DNA, 179 bp, Homo sapiens; identical to SEQ ID NO: 8307
  misc_feature 1..179: note = chr6:5086150-5086329
  misc_feature 1..179: note = hyper
  source 1..179: mol_type = genomic DNA

SEQ ID NO: 19142 - DNA, 30 bp, Homo sapiens; identical to SEQ ID NO: 8308
  misc_feature 1..30: note = chr6:5851769-5851799
  misc_feature 1..30: note = hyper
  source 1..30: mol_type = genomic DNA

SEQ ID NO: 19143 - DNA, 638 bp, Homo sapiens; identical to SEQ ID NO: 8309
  misc_feature 1..638: note = chr6:5996066-5996704
  misc_feature 1..638: note = hyper
  source 1..638: mol_type = genomic DNA

SEQ ID NO: 19144 - DNA, 57 bp, Homo sapiens
  misc_feature 1..57: note = chr6:5996989-5997046
  misc_feature 1..57: note = hyper
  source 1..57: mol_type = genomic DNA
aaacgaaaccaacaaaatgcaactattttccaaaaccccgagcgtttgctggtgggt

SEQ ID NO: 19145 - DNA, 36 bp, Homo sapiens; identical to SEQ ID NO: 8311
  misc_feature 1..36: note = chr6:5997581-5997617
  misc_feature 1..36: note = hyper
  source 1..36: mol_type = genomic DNA

SEQ ID NO: 19146 - DNA, 18 bp, Homo sapiens
  misc_feature 1..18: note = chr6:6003269-6003287
  misc_feature 1..18: note = hyper
  source 1..18: mol_type = genomic DNA
aagcctcaggcttggcgc

SEQ ID NO: 19147 - DNA, 275 bp, Homo sapiens
  misc_feature 1..275: note = chr6:6007318-6007593
  misc_feature 1..275: note = hyper
  source 1..275: mol_type = genomic DNA
accttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcacc

SEQ ID NO: 19148 - DNA, 30 bp, Homo sapiens; identical to SEQ ID NO: 8319
  misc_feature 1..30: note = chr6:6009468-6009498
  misc_feature 1..30: note = hyper
  source 1..30: mol_type = genomic DNA

SEQ ID NO: 19149 - DNA, 95 bp, Homo sapiens; identical to SEQ ID NO: 8320
  misc_feature 1..95: note = chr6:6546546-6546641
  misc_feature 1..95: note = hyper
  source 1..95: mol_type = genomic DNA

SEQ ID NO: 19150 - DNA, 296 bp, Homo sapiens; identical to SEQ ID NO: 8321
  misc_feature 1..296: note = chr6:6546926-6547222
  misc_feature 1..296: note = hyper
  source 1..296: mol_type = genomic DNA

SEQ ID NO: 19151 - DNA, 123 bp, Homo sapiens; identical to SEQ ID NO: 8322
  misc_feature 1..123: note = chr6:7726824-7726947
  misc_feature 1..123: note = hyper
  source 1..123: mol_type = genomic DNA

SEQ ID NO: 19152 - DNA, 377 bp, Homo sapiens
  misc_feature 1..377: note = chr6:7727322-7727699
  misc_feature 1..377: note = hyper
  source 1..377: mol_type = genomic DNA
ggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagc

SEQ ID NO: 19153 - DNA, 696 bp, Homo sapiens
  misc_feature 1..696: note = chr6:7728142-7728838
  misc_feature 1..696: note = hyper
  source 1..696: mol_type = genomic DNA
tccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgctt

SEQ ID NO: 19154 - DNA, 142 bp, Homo sapiens; identical to SEQ ID NO: 8328
  misc_feature 1..142: note = chr6:10383858-10384000
  misc_feature 1..142: note = hyper
  source 1..142: mol_type = genomic DNA

SEQ ID NO: 19155 - DNA, 30 bp, Homo sapiens; identical to SEQ ID NO: 8329
  misc_feature 1..30: note = chr6:10384438-10384468
  misc_feature 1..30: note = hyper
  source 1..30: mol_type = genomic DNA

SEQ ID NO: 19156 - DNA, 59 bp, Homo sapiens; identical to SEQ ID NO: 8334
  misc_feature 1..59: note = chr6:10391337-10391396
  misc_feature 1..59: note = hyper
  source 1..59: mol_type = genomic DNA

SEQ ID NO: 19157 - DNA, 30 bp, Homo sapiens; identical to SEQ ID NO: 8335
  misc_feature 1..30: note = chr6:10411311-10411341
  misc_feature 1..30: note = hyper
  source 1..30: mol_type = genomic DNA

SEQ ID NO: 19158 - DNA, 44 bp, Homo sapiens; identical to SEQ ID NO: 8336
  misc_feature 1..44: note = chr6:10411992-10412036
  misc_feature 1..44: note = hyper
  source 1..44: mol_type = genomic DNA

SEQ ID NO: 19159 - skipped

SEQ ID NO: 19160 - DNA, 26 bp, Homo sapiens
  misc_feature 1..26: note = chr6:10419506-10419532
  misc_feature 1..26: note = hyper
  source 1..26: mol_type = genomic DNA
gctctcctgggcgctgccaggcgcgc

SEQ ID NO: 19161 - DNA, 38 bp, Homo sapiens; identical to SEQ ID NO: 8345
  misc_feature 1..38: note = chr6:10420118-10420156
  misc_feature 1..38: note = hyper
  source 1..38: mol_type = genomic DNA

SEQ ID NO: 19162 - DNA, 26 bp, Homo sapiens
  misc_feature 1..26: note = chr6:10422635-10422661
  misc_feature 1..26: note = hyper
  source 1..26: mol_type = genomic DNA
cgctgccaccacgaagcaggttcact

SEQ ID NO: 19163 - DNA, 141 bp, Homo sapiens; identical to SEQ ID NO: 8349
  misc_feature 1..141: note = chr6:10423946-10424087
  misc_feature 1..141: note = hyper
  source 1..141: mol_type = genomic DNA

SEQ ID NO: 19164 - skipped

SEQ ID NO: 19165 - DNA, 35 bp, Homo sapiens; identical to SEQ ID NO: 8354
  misc_feature 1..35: note = chr6:10886917-10886952
  misc_feature 1..35: note = hyper
  source 1..35: mol_type = genomic DNA

SEQ ID NO: 19166 - DNA, 184 bp, Homo sapiens
  misc_feature 1..184: note = chr6:11043878-11044062
  misc_feature 1..184: note = hyper
  source 1..184: mol_type = genomic DNA
cccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttc

SEQ ID NO: 19167 - DNA, 18 bp, Homo sapiens
  misc_feature 1..18: note = chr6:12750364-12750382
  misc_feature 1..18: note = hyper
  source 1..18: mol_type = genomic DNA
gggcgaggttggctggcg

SEQ ID NO: 19168 - DNA, 101 bp, Homo sapiens; identical to SEQ ID NO: 8361
  misc_feature 1..101: note = chr6:13013581-13013682
  misc_feature 1..101: note = hyper
  source 1..101: mol_type = genomic DNA

SEQ ID NO: 19169 - DNA, 36 bp, Homo sapiens; identical to SEQ ID NO: 8362
  misc_feature 1..36: note = chr6:13013897-13013933
  misc_feature 1..36: note = hyper
  source 1..36: mol_type = genomic DNA

SEQ ID NO: 19170 - DNA, 147 bp, Homo sapiens; identical to SEQ ID NO: 8363
  misc_feature 1..147: note = chr6:13925376-13925523
  misc_feature 1..147: note = hyper
  source 1..147: mol_type = genomic DNA

SEQ ID NO: 19171 - DNA, 30 bp, Homo sapiens; identical to SEQ ID NO: 8364
  misc_feature 1..30: note = chr6:18122697-18122727
  misc_feature 1..30: note = hyper
  source 1..30: mol_type = genomic DNA

SEQ ID NO: 19172 - DNA, 347 bp, Homo sapiens; identical to SEQ ID NO: 8365
  misc_feature 1..347: note = chr6:18277573-18277920
  misc_feature 1..347: note = hyper
  source 1..347: mol_type = genomic DNA

SEQ ID NO: 19173 - DNA, 102 bp, Homo sapiens; identical to SEQ ID NO: 2771
  misc_feature 1..102: note = chr6:19691895-19691997
  misc_feature 1..102: note = hyper
  source 1..102: mol_type = genomic DNA

SEQ ID NO: 19174 - DNA, 23 bp, Homo sapiens
  misc_feature 1..23: note = chr6:21665043-21665066
  misc_feature 1..23: note = hyper
  source 1..23: mol_type = genomic DNA
gtgaagcgcggggcgggggaggc

SEQ ID NO: 19175 - DNA, 113 bp, Homo sapiens; identical to SEQ ID NO: 8369
  misc_feature 1..113: note = chr6:21665754-21665867
  misc_feature 1..113: note = hyper
  source 1..113: mol_type = genomic DNA

SEQ ID NO: 19176 - DNA, 32 bp, Homo sapiens; identical to SEQ ID NO: 8370
  misc_feature 1..32: note = chr6:24126437-24126469
  misc_feature 1..32: note = hyper
  source 1..32: mol_type = genomic DNA

SEQ ID NO: 19177 - DNA, 63 bp, Homo sapiens
  misc_feature 1..63: note = chr6:24494766-24494829
  misc_feature 1..63: note = hyper
  source 1..63: mol_type = genomic DNA
gggcaggcaccagcgcatctatggaccgcgcacaaattccggggatgccgaatttgggggatg

SEQ ID NO: 19178 - DNA, 30 bp, Homo sapiens; identical to SEQ ID NO: 8372
  misc_feature 1..30: note = chr6:26020909-26020939
  misc_feature 1..30: note = hyper
  source 1..30: mol_type = genomic DNA

SEQ ID NO: 19179 - DNA, 51 bp, Homo sapiens; identical to SEQ ID NO: 8373
  misc_feature 1..51: note = chr6:26087615-26087666
  misc_feature 1..51: note = hyper
  source 1..51: mol_type = genomic DNA

SEQ ID NO: 19180 - DNA, 66 bp, Homo sapiens; identical to SEQ ID NO: 8374
  misc_feature 1..66: note = chr6:26088186-26088252
  misc_feature 1..66: note = hyper
  source 1..66: mol_type = genomic DNA

SEQ ID NO: 19181 - DNA, 30 bp, Homo sapiens; identical to SEQ ID NO: 8375
  misc_feature 1..30: note = chr6:26172122-26172152
  misc_feature 1..30: note = hyper
  source 1..30: mol_type = genomic DNA

SEQ ID NO: 19182 - DNA, 74 bp, Homo sapiens
  misc_feature 1..74: note = chr6:26184021-26184095
  misc_feature 1..74: note = hyper
  source 1..74: mol_type = genomic DNA
gcatgcctgagccagcgaaatccgctcccgccccgaagaagggctccaagaaggccgtgaccaaggcgcagaag

SEQ ID NO: 19183 - DNA, 38 bp, Homo sapiens; identical to SEQ ID NO: 8379
  misc_feature 1..38: note = chr6:26199182-26199220
  misc_feature 1..38: note = hyper
  source 1..38: mol_type = genomic DNA

SEQ ID NO: 19184 - DNA, 25 bp, Homo sapiens
  misc_feature 1..25: note = chr6:26200129-26200154
  misc_feature 1..25: note = hyper
  source 1..25: mol_type = genomic DNA
gcaccaaggccgtcaccaagtacac

SEQ ID NO: 19185 - DNA, 71 bp, Homo sapiens; identical to SEQ ID NO: 8381
  misc_feature 1..71: note = chr6:26205142-26205213
  misc_feature 1..71: note = hyper
  source 1..71: mol_type = genomic DNA

SEQ ID NO: 19186 - DNA, 30 bp, Homo sapiens; identical to SEQ ID NO: 8382
  misc_feature 1..30: note = chr6:26205682-26205712
  misc_feature 1..30: note = hyper
  source 1..30: mol_type = genomic DNA

SEQ ID NO: 19187 - DNA, 449 bp, Homo sapiens; identical to SEQ ID NO: 8383
  misc_feature 1..449: note = chr6:26234025-26234474
  misc_feature 1..449: note = hyper
  source 1..449: mol_type = genomic DNA

SEQ ID NO: 19188 - DNA, 30 bp, Homo sapiens; identical to SEQ ID NO: 8384
  misc_feature 1..30: note = chr6:26234702-26234732
  misc_feature 1..30: note = hyper
  source 1..30: mol_type = genomic DNA

SEQ ID NO: 19189 - DNA, 122 bp, Homo sapiens; identical to SEQ ID NO: 8385
  misc_feature 1..122: note = chr6:26234942-26235064
  misc_feature 1..122: note = hyper
  source 1..122: mol_type = genomic DNA

SEQ ID NO: 19190 - DNA, 41 bp, Homo sapiens; identical to SEQ ID NO: 2776
  misc_feature 1..41: note = chr6:26250098-26250139
  misc_feature 1..41: note = hyper
  source 1..41: mol_type = genomic DNA

SEQ ID NO: 19191 - DNA, 269 bp, Homo sapiens
  misc_feature 1..269: note = chr6:26250199-26250468
  misc_feature 1..269: note = hyper
  source 1..269: mol_type = genomic DNA
ggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttg

SEQ ID NO: 19192 - DNA, 14 bp, Homo sapiens
  misc_feature 1..14: note = chr6:26250826-26250840
  misc_feature 1..14: note = hyper
  source 1..14: mol_type = genomic DNA
gtgccataggaatg

SEQ ID NO: 19193 - DNA, 175 bp, Homo sapiens
  misc_feature 1..175: note = chr6:26251641-26251816
  misc_feature 1..175: note = hyper
  source 1..175: mol_type = genomic DNA
ttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaa

SEQ ID NO: 19194 - DNA, 35 bp, Homo sapiens
  misc_feature 1..35: note = chr6:26271371-26271406
  misc_feature 1..35: note = hyper
  source 1..35: mol_type = genomic DNA
tcttgaagtcctgagcgatttctcgcaccaggcgt

SEQ ID NO: 19195 - DNA, 92 bp, Homo sapiens
  misc_feature 1..92: note = chr6:26272617-26272709
  misc_feature 1..92: note = hyper
  source 1..92: mol_type = genomic DNA
gcaccgcctccaggtacaccggcgcaccggcccggacccgcttggcgtagttgcccttgcggaggaggcggtgcactcggcccacagaaaac

SEQ ID NO: 19196 - DNA, 159 bp, Homo sapiens; identical to SEQ ID NO: 8394
  misc_feature 1..159: note = chr6:26273111-26273270
  misc_feature 1..159: note = hyper
  source 1..159: mol_type = genomic DNA

SEQ ID NO: 19197 - DNA, 180 bp, Homo sapiens; identical to SEQ ID NO: 8395
  misc_feature 1..180: note = chr6:26273570-26273750
  misc_feature 1..180: note = hyper
  source 1..180: mol_type = genomic DNA

SEQ ID NO: 19198 - DNA, 101 bp, Homo sapiens; identical to SEQ ID NO: 8396
  misc_feature 1..101: note = chr6:26322530-26322631
  misc_feature 1..101: note = hyper
  source 1..101: mol_type = genomic DNA

SEQ ID NO: 19199 - DNA, 30 bp, Homo sapiens; identical to SEQ ID NO: 8399
  misc_feature 1..30: note = chr6:26331781-26331811
  misc_feature 1..30: note = hyper
  source 1..30: mol_type = genomic DNA

SEQ ID NO: 19200 - skipped

SEQ ID NO: 19201 - DNA, 122 bp, Homo sapiens
  misc_feature 1..122: note = chr6:26550872-26550994
  misc_feature 1..122: note = hyper
  source 1..122: mol_type = genomic DNA
taggcttgggagttccgcgcctctcggtgtcgcctggggggcgtgctccggttggcgcactgattcccagttgggtaggggaggcttgactgagctcccacccggaatttcaccttagacct

SEQ ID NO: 19202 - DNA, 25 bp, Homo sapiens
  misc_feature 1..25: note = chr6:26551034-26551059
  misc_feature 1..25: note = hyper
  source 1..25: mol_type = genomic DNA
ctagtcctctttagtggagttccgg

SEQ ID NO: 19203 - DNA, 166 bp, Homo sapiens; identical to SEQ ID NO: 8404
  misc_feature 1..166: note = chr6:26577722-26577888
  misc_feature 1..166: note = hyper
  source 1..166: mol_type = genomic DNA

SEQ ID NO: 19204 - DNA, 15 bp, Homo sapiens
  misc_feature 1..15: note = chr6:27064667-27064682
  misc_feature 1..15: note = hyper
  source 1..15: mol_type = genomic DNA
gctggctcccaggtg

SEQ ID NO: 19205 - DNA, 70 bp, Homo sapiens
  misc_feature 1..70: note = chr6:27065198-27065268
  misc_feature 1..70: note = hyper
  source 1..70: mol_type = genomic DNA
aacacccaagtccagccaacttccctttcaactctcctggaattcaggtccctggcgttggagaggaaaa

SEQ ID NO: 19206 - DNA, 275 bp, Homo sapiens; identical to SEQ ID NO: 8408
  misc_feature 1..275: note = chr6:27100686-27100961
  misc_feature 1..275: note = hyper
  source 1..275: mol_type = genomic DNA

SEQ ID NO: 19207 - skipped

SEQ ID NO: 19208 - DNA, 64 bp, Homo sapiens
  misc_feature 1..64: note = chr6:27228395-27228459
  misc_feature 1..64: note = hyper
  source 1..64: mol_type = genomic DNA
aagttgttgttgtttgagaccaagtgagccaccgcacccagccaagaatcggctgtttaagaaa

SEQ ID NO: 19209 - DNA, 16 bp, Homo sapiens
  misc_feature 1..16: note = chr6:27243064-27243080
  misc_feature 1..16: note = hyper
  source 1..16: mol_type = genomic DNA
acgctgggtgcagctc

SEQ ID NO: 19210 - DNA, 15 bp, Homo sapiens
  misc_feature 1..15: note = chr6:27247724-27247739
  misc_feature 1..15: note = hyper
  source 1..15: mol_type = genomic DNA
cgaaccaagtccttg

SEQ ID NO: 19211 - DNA, 18 bp, Homo sapiens
  misc_feature 1..18: note = chr6:27256079-27256097
  misc_feature 1..18: note = hyper
  source 1..18: mol_type = genomic DNA
cctttctaggaatcccgg

SEQ ID NO: 19212 - DNA, 59 bp, Homo sapiens
  misc_feature 1..59: note = chr6:27256173-27256232
  misc_feature 1..59: note = hyper
  source 1..59: mol_type = genomic DNA
agagattgtcagttatccaactgtcaatagagccgccgctccagcgagtttaatttagg

SEQ ID NO: 19213 - DNA, 50 bp, Homo sapiens
  misc_feature 1..50: note = chr6:27279795-27279845
  misc_feature 1..50: note = hyper
  source 1..50: mol_type = genomic DNA
gtggggcagggtgggcgcggtggacgaactgaacccgatgaacttggtga

SEQ ID NO: 19214 - DNA, 508 bp, Homo sapiens
  misc_feature 1..508: note = chr6:27280012-27280520
  misc_feature 1..508: note = hyper
  source 1..508: mol_type = genomic DNA
ctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcagga

SEQ ID NO: 19215 - DNA, 33 bp, Homo sapiens; identical to SEQ ID NO: 8419
  misc_feature 1..33: note = chr6:27471362-27471395
  misc_feature 1..33: note = hyper
  source 1..33: mol_type = genomic DNA

SEQ ID NO: 19216 - DNA, 36 bp, Homo sapiens
  misc_feature 1..36: note = chr6:27534341-27534377
  misc_feature 1..36: note = hyper
  source 1..36: mol_type = genomic DNA
aaaacgctgcgctccctccggcgagggacaagagca

SEQ ID NO: 19217 - DNA, 30 bp, Homo sapiens; identical to SEQ ID NO: 8425
  misc_feature 1..30: note = chr6:27572883-27572913
  misc_feature 1..30: note = hyper
  source 1..30: mol_type = genomic DNA

SEQ ID NO: 19218 - DNA, 201 bp, Homo sapiens
  misc_feature 1..201: note = chr6:27573392-27573593
  misc_feature 1..201: note = hyper
  source 1..201: mol_type = genomic DNA
agggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaa

SEQ ID NO: 19219 - DNA, 66 bp, Homo sapiens
  misc_feature 1..66: note = chr6:27598672-27598738
  misc_feature 1..66: note = hyper
  source 1..66: mol_type = genomic DNA
agagatgctggactgcgaatgcaggcgcgctgcaggcgaggctgggagggccgccaggagcgctgc

SEQ ID NO: 19220 - DNA, 20 bp, Homo sapiens
  misc_feature 1..20: note = chr6:27635245-27635265
  misc_feature 1..20: note = hyper
  source 1..20: mol_type = genomic DNA
aagaatgaaaaacatcgaag

SEQ ID NO: 19221 - DNA, 30 bp, Homo sapiens; identical to SEQ ID NO: 8430
  misc_feature 1..30: note = chr6:27636385-27636415
  misc_feature 1..30: note = hyper
  source 1..30: mol_type = genomic DNA

SEQ ID NO: 19222 - DNA, 15 bp, Homo sapiens
  misc_feature 1..15: note = chr6:27647697-27647712
  misc_feature 1..15: note = hyper
  source 1..15: mol_type = genomic DNA
acctgtcttaaagtt

SEQ ID NO: 19223 - DNA, 34 bp, Homo sapiens; identical to SEQ ID NO: 8432
  misc_feature 1..34: note = chr6:27648814-27648848
  misc_feature 1..34: note = hyper
  source 1..34: mol_type = genomic DNA

SEQ ID NO: 19224 - DNA, 239 bp, Homo sapiens; identical to SEQ ID NO: 8433
  misc_feature 1..239: note = chr6:27661759-27661998
  misc_feature 1..239: note = hyper
  source 1..239: mol_type = genomic DNA

SEQ ID NO: 19225 - DNA, 225 bp, Homo sapiens; identical to SEQ ID NO: 8434
  misc_feature 1..225: note = chr6:27774914-27775139
  misc_feature 1..225: note = hyper
  source 1..225: mol_type = genomic DNA

SEQ ID NO: 19226 - DNA, 120 bp, Homo sapiens; identical to SEQ ID NO: 8435
  misc_feature 1..120: note = chr6:27782468-27782588
  misc_feature 1..120: note = hyper
  source 1..120: mol_type = genomic DNA

SEQ ID NO: 19227 - DNA, 64 bp, Homo sapiens; identical to SEQ ID NO: 8436
  misc_feature 1..64: note = chr6:27834196-27834260
  misc_feature 1..64: note = hyper
  source 1..64: mol_type = genomic DNA

SEQ ID NO: 19228 - DNA, 19 bp, Homo sapiens
  misc_feature 1..19: note = chr6:27834835-27834854
  misc_feature 1..19: note = hyper
  source 1..19: mol_type = genomic DNA
tcttcggagtcttcttcac

SEQ ID NO: 19229 - DNA, 37 bp, Homo sapiens
  misc_feature 1..37: note = chr6:27839689-27839726
  misc_feature 1..37: note = hyper
  source 1..37: mol_type = genomic DNA
ctctcccctcggatgcggcgcgcaagctggatgtctt

SEQ ID NO: 19230 - DNA, 461 bp, Homo sapiens
  misc_feature 1..461: note = chr6:27840082-27840543
  misc_feature 1..461: note = hyper
  source 1..461: mol_type = genomic DNA
gttcgtgccatggctaagtagacgtacctactcaacacaaatgagagaaaaaaactgatcatcccggtatttatagctgccctcgcgttctgattggacagtagactgtgccatgccacgtctcacacacggaattggctcccagtttaatctgctagtgaaagggagacattccgcctctgttttgggtcaagaaacgtaaaatggttttgctagctaaagaaaaacaaaaacggaaacaaaaaaaaatcccccaaaagtctaggatttttcatgcatcaaaatcctgtttaaatataagcttgataaatctaaacttgccttgcactattttaattacgaggtgtcattactgatttgacaaaaagttaaagaacgtaaaggaaaagtgaaactagagtaaatttgtaaatggaggcattgaaggggatatgaaattcgagcgttgtggtatgccagta

SEQ ID NO: 19231 - DNA, 49 bp, Homo sapiens; identical to SEQ ID NO: 8440
  misc_feature 1..49: note = chr6:27858327-27858376
  misc_feature 1..49: note = hyper
  source 1..49: mol_type = genomic DNA

SEQ ID NO: 19232 - DNA, 70 bp, Homo sapiens
  misc_feature 1..70: note = chr6:28176212-28176282
  misc_feature 1..70: note = hyper
  source 1..70: mol_type = genomic DNA
agcttagagcatggggtcgcaaccacccagagccttcagaccagtgagcactttccgcacaggtttgaat

SEQ ID NO: 19233 - DNA, 55 bp, Homo sapiens
  misc_feature 1..55: note = chr6:28367054-28367109
  misc_feature 1..55: note = hyper
  source 1..55: mol_type = genomic DNA
gcttccctctaacctcgtggtctgtgattataatctgaagtgaggaaggcccagg

SEQ ID NO: 19234 - DNA, 41 bp, Homo sapiens
  misc_feature 1..41: note = chr6:28367774-28367815
  misc_feature 1..41: note = hyper
  source 1..41: mol_type = genomic DNA
tgatcttaagacagggaaatcccttgcgtctccattcactt

SEQ ID NO: 19235 - DNA, 39 bp, Homo sapiens
  misc_feature 1..39: note = chr6:28411353-28411392
  misc_feature 1..39: note = hyper
  source 1..39: mol_type = genomic DNA
ctctgtggtcgtcactctgaatcccgtctgtagtcttaa

SEQ ID NO: 19236 - DNA, 28 bp, Homo sapiens
  misc_feature 1..28: note = chr6:28415091-28415119
  misc_feature 1..28: note = hyper
  source 1..28: mol_type = genomic DNA
cgttcccctttatcggctctattgccag

SEQ ID NO: 19237 - DNA, 30 bp, Homo sapiens; identical to SEQ ID NO: 8452
  misc_feature 1..30: note = chr6:28457825-28457855
  misc_feature 1..30: note = hyper
  source 1..30: mol_type = genomic DNA

SEQ ID NO: 19238 - DNA, 76 bp, Homo sapiens; identical to SEQ ID NO: 8453
  misc_feature 1..76: note = chr6:34433517-34433593
  misc_feature 1..76: note = hyper
  source 1..76: mol_type = genomic DNA

SEQ ID NO: 19239 - DNA, 71 bp, Homo sapiens; identical to SEQ ID NO: 8454
  misc_feature 1..71: note = chr6:35181353-35181424
  misc_feature 1..71: note = hyper
  source 1..71: mol_type = genomic DNA

SEQ ID NO: 19240 - DNA, 53 bp, Homo sapiens; identical to SEQ ID NO: 8456
  misc_feature 1..53: note = chr6:36806954-36807007
  misc_feature 1..53: note = hyper
  source 1..53: mol_type = genomic DNA

SEQ ID NO: 19241 - DNA, 127 bp, Homo sapiens; identical to SEQ ID NO: 8457
  misc_feature 1..127: note = chr6:36808176-36808303
  misc_feature 1..127: note = hyper
  source 1..127: mol_type = genomic DNA

SEQ ID NO: 19242 - DNA, 272 bp, Homo sapiens
  misc_feature 1..272: note = chr6:37664187-37664459
  misc_feature 1..272: note = hyper
  source 1..272: mol_type = genomic DNA
agtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttg

SEQ ID NO: 19243 - DNA, 27 bp, Homo sapiens
  misc_feature 1..27: note = chr6:37673293-37673320
  misc_feature 1..27: note = hyper
  source 1..27: mol_type = genomic DNA
aaagggggtggggggcgggaaatctgg

SEQ ID NO: 19244 - DNA, 80 bp, Homo sapiens; identical to SEQ ID NO: 8460
  misc_feature 1..80: note = chr6:39016550-39016630
  misc_feature 1..80: note = hyper
  source 1..80: mol_type = genomic DNA

SEQ ID NO: 19245 - DNA, 251 bp, Homo sapiens; identical to SEQ ID NO: 8461
  misc_feature 1..251: note = chr6:39016678-39016929
  misc_feature 1..251: note = hyper
  source 1..251: mol_type = genomic DNA

SEQ ID NO: 19246 - DNA, 173 bp, Homo sapiens
  misc_feature 1..173: note = chr6:39281133-39281306
  misc_feature 1..173: note = hyper
  source 1..173: mol_type = genomic DNA
tccgaagactcggagtaaagcgggttcagccagagagcggccctgcgtccgccctcctctcgaacccgggtctgcgcacgtcgagccccctctctgcgttgagggtggccccgaccagcacgcctcgggcccaatccacccaccctccgggacaaacgcgccttcccccaggc

SEQ ID NO: 19247 - DNA, 208 bp, Homo sapiens
  misc_feature 1..208: note = chr6:39281616-39281824
  misc_feature 1..208: note = hyper
  source 1..208: mol_type = genomic DNA
ctcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatc

SEQ ID NO: 19248 - DNA, 99 bp, Homo sapiens
  misc_feature 1..99: note = chr6:39281875-39281974
  misc_feature 1..99: note = hyper
  source 1..99: mol_type = genomic DNA
agcgccgggcggtccagacacgtgaagttctgcaacagctcccacttgtcgcgctggaagctgcggctggagtcctgcgccgcgcggccctccagcgtc

SEQ ID NO: 19249 - DNA, 30 bp, Homo sapiens; identical to SEQ ID NO: 8464
  misc_feature 1..30: note = chr6:39902189-39902219
  misc_feature 1..30: note = hyper
  source 1..30: mol_type = genomic DNA

SEQ ID NO: 19250 - DNA, 64 bp, Homo sapiens
  misc_feature 1..64: note = chr6:40554589-40554653
  misc_feature 1..64: note = hyper
  source 1..64: mol_type = genomic DNA
agttcccggttccctcgggtgcgttcagccccgcgccgagctcccgcggacacccgggatcgca

SEQ ID NO: 19251 - DNA, 38 bp, Homo sapiens
  misc_feature 1..38: note = chr6:40554699-40554737
  misc_feature 1..38: note = hyper
  source 1..38: mol_type = genomic DNA
ccccggctgggtggcaccgaggccggctccgcggggcg

SEQ ID NO: 19252 - DNA, 27 bp, Homo sapiens
  misc_feature 1..27: note = chr6:41337045-41337072
  misc_feature 1..27: note = hyper
  source 1..27: mol_type = genomic DNA
gccagggagtggaaacgccggaggtcc

SEQ ID NO: 19253 - DNA, 81 bp, Homo sapiens
  misc_feature 1..81: note = chr6:41337128-41337209
  misc_feature 1..81: note = hyper
  source 1..81: mol_type = genomic DNA
ccgggaccctatccatgtcccattccgggcaccttcctcaaaagtaggggtgggaggggcataagccggtcaagtatttcc

SEQ ID NO: 19254 - DNA, 126 bp, Homo sapiens
  misc_feature 1..126: note = chr6:41339838-41339964
  misc_feature 1..126: note = hyper
  source 1..126: mol_type = genomic DNA
gaacttttctctcctccttcttccctcgctctgcctctctcggggcggtctccggggactgtctctcacatccattctcctctcctccttgatttatgctgcagagtggaacgaccttccctgacc

SEQ ID NO: 19255 - DNA, 28 bp, Homo sapiens
  misc_feature 1..28: note = chr6:41342779-41342807
  misc_feature 1..28: note = hyper
  source 1..28: mol_type = genomic DNA
gggtccttcaaaaagcgccactttggag

SEQ ID NO: 19256 - DNA, 187 bp, Homo sapiens
  misc_feature 1..187: note = chr6:41342837-41343024
  misc_feature 1..187: note = hyper
  source 1..187: mol_type = genomic DNA
tcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttc

SEQ ID NO: 19257 - DNA, 32 bp, Homo sapiens; identical to SEQ ID NO: 8472
  misc_feature 1..32: note = chr6:41343650-41343682
  misc_feature 1..32: note = hyper
  source 1..32: mol_type = genomic DNA

SEQ ID NO: 19258 - DNA, 27 bp, Homo sapiens
  misc_feature 1..27: note = chr6:41606542-41606569
  misc_feature 1..27: note = hyper
  source 1..27: mol_type = genomic DNA
ccagcgcagccccgggcccaggtagga

SEQ ID NO: 19259 - DNA, 31 bp, Homo sapiens
  misc_feature 1..31: note = chr6:42879523-42879554
  misc_feature 1..31: note = hyper
  source 1..31: mol_type = genomic DNA
tagggacacctgccccgctccctccccctcc

SEQ ID NO: 19260 - DNA, 63 bp, Homo sapiens
  misc_feature 1..63: note = chr6:43613067-43613130
  misc_feature 1..63: note = hyper
  source 1..63: mol_type = genomic DNA
gaggcccccgggacgggctccccagagggtggctacctggaggcagggcggggtgggcgggtc

SEQ ID NO: 19261 - DNA, 57 bp, Homo sapiens; identical to SEQ ID NO: 8480
  misc_feature 1..57: note = chr6:45387985-45388042
  misc_feature 1..57: note = hyper
  source 1..57: mol_type = genomic DNA

SEQ ID NO: 19262 - DNA, 30 bp, Homo sapiens; identical to SEQ ID NO: 8481
  misc_feature 1..30: note = chr6:45388359-45388389
  misc_feature 1..30: note = hyper
  source 1..30: mol_type = genomic DNA

SEQ ID NO: 19263 - DNA, 369 bp, Homo sapiens; identical to SEQ ID NO: 8482
  misc_feature 1..369: note = chr6:45391172-45391541
  misc_feature 1..369: note = hyper
  source 1..369: mol_type = genomic DNA

SEQ ID NO: 19264 - DNA, 388 bp, Homo sapiens
  misc_feature 1..388: note = chr6:46702594-46702982
  misc_feature 1..388: note = hyper
  source 1..388: mol_type = genomic DNA
gagagaaaaaaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcgactcagcgagcccaccccggccggtcgccgctccggggtcccgacctccagcgcggcgaccgtgcccttcctcccactcccgcctcgcccccggggcccctcctcactcaggcgcggcgcggagctgctcgcgggaactggggtccctgggcgcgttccaccgcgcaccaacg

SEQ ID NO: 19265 - DNA, 227 bp, Homo sapiens
  misc_feature 1..227: note = chr6:46703123-46703350
  misc_feature 1..227: note = hyper
  source 1..227: mol_type = genomic DNA
gcctagcgcggccttgtggccccgaccctctcctcccctggtgatgctggaggaggtaccggggaggagcgtgtgtggccccggcctctcactagcagcggcggctcccgacgctagcctgctcgagcgcacccagcaccctccccaagaccatggcccgcacctggacccgcggttaacttagcccgccgcggagagagccaggcaatgcctgggtggtgtcgtgc

SEQ ID NO: 19266 - DNA, 89 bp, Homo sapiens
  misc_feature 1..89: note = chr6:46703436-46703525
  misc_feature 1..89: note = hyper
  source 1..89: mol_type = genomic DNA
caccgtgttctctgaatacactgaattactccgagcatctatagttggcaatgccctgcgcattttccgcactccgatacactttacac

SEQ ID NO: 19267 - skipped

SEQ ID NO: 19268 - DNA, 95 bp, Homo sapiens
  misc_feature 1..95: note = chr6:50681604-50681699
  misc_feature 1..95: note = hyper
  source 1..95: mol_type = genomic DNA
aggagctatctgatccgggcaaaaccattacaatttagatatctacctatagaacattttttttttcctttaaaaattggaaaatacaagaagtt

SEQ ID NO: 19269 - DNA, 122 bp, Homo sapiens
  misc_feature 1..122: note = chr6:50681942-50682064
  misc_feature 1..122: note = hyper
  source 1..122: mol_type = genomic DNA
tgtctttcgggggaagttaaggaaggaaaggggagaaagttcgttatgacatctgtcgccagggagggcaactctctgccacgttaagaaacatttgccataatgagcgggaaaacataatc

SEQ ID NO: 19270 - DNA, 211 bp, Homo sapiens
  misc_feature 1..211: note = chr6:50682448-50682659
  misc_feature 1..211: note = hyper
  source 1..211: mol_type = genomic DNA
cgcggccccggagtcagttgcaaacctggatcccaacgccaagctccctgcacaagttgggcaggggctgtgtgtgtgtctgtgtgtgtgtgtctgtgcgtgtgtgtgcgtgtgtggtgtcacccgcacctatatagggtgggggattttttttccgctctctcgactgtgaggacgaggccgcccacccccagttcgcctgtttgcaaag

SEQ ID NO: 19271 - DNA, 49 bp, Homo sapiens; identical to SEQ ID NO: 8491
  misc_feature 1..49: note = chr6:50690631-50690680
  misc_feature 1..49: note = hyper
  source 1..49: mol_type = genomic DNA

SEQ ID NO: 19272 - DNA, 174 bp, Homo sapiens
  misc_feature 1..174: note = chr6:50691909-50692083
  misc_feature 1..174: note = hyper
  source 1..174: mol_type = genomic DNA
ctcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatc

SEQ ID NO: 19273 - DNA, 31 bp, Homo sapiens
  misc_feature 1..31: note = chr6:50692481-50692512
  misc_feature 1..31: note = hyper
  source 1..31: mol_type = genomic DNA
tgtgtgtgtgtgtcggcggggggacctgtct

SEQ ID NO: 19274 - DNA, 26 bp, Homo sapiens
  misc_feature 1..26: note = chr6:50788352-50788378
  misc_feature 1..26: note = hyper
  source 1..26: mol_type = genomic DNA
tccttaacaggcgggataatggtaaa

SEQ ID NO: 19275 - DNA, 10 bp, Homo sapiens
  misc_feature 1..10: note = chr6:50791177-50791187
  misc_feature 1..10: note = hyper
  source 1..10: mol_type = genomic DNA
cccaaggacc

SEQ ID NO: 19276 - DNA, 25 bp, Homo sapiens
  misc_feature 1..25: note = chr6:50803867-50803892
  misc_feature 1..25: note = hyper
  source 1..25: mol_type = genomic DNA
cgtcccaggccgtttgtctctgctc

SEQ ID NO: 19277 - DNA, 30 bp, Homo sapiens; identical to SEQ ID NO: 8504
  misc_feature 1..30: note = chr6:50811838-50811868
  misc_feature 1..30: note = hyper
  source 1..30: mol_type = genomic DNA

SEQ ID NO: 19278 - DNA, 214 bp, Homo sapiens
  misc_feature 1..214: note = chr6:50818706-50818920
  misc_feature 1..214: note = hyper
  source 1..214: mol_type = genomic DNA
taggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtca

SEQ ID NO: 19279 - skipped

SEQ ID NO: 19280 - DNA, 82 bp, Homo sapiens
  misc_feature 1..82: note = chr6:55443946-55444028
  misc_feature 1..82: note = hyper
  source 1..82: mol_type = genomic DNA
gcgcccctccggtgcactggctgtgaggaccagagctgttctgcgcactgcggcggcgccgagagggcggggagtggggcgt

SEQ ID NO: 19281 - DNA, 89 bp, Homo sapiens
  misc_feature 1..89: note = chr6:56112173-56112262
  misc_feature 1..89: note = hyper
  source 1..89: mol_type = genomic DNA
tgtctccttacctggcgcagtgtccaggctcggggttgccgtcgcagccagctgagtgttgcgccagggggacaggtatgttccaggca

SEQ ID NO: 19282 - DNA, 55 bp, Homo sapiens; identical to SEQ ID NO: 8509
  misc_feature 1..55: note = chr6:56716640-56716695
  misc_feature 1..55: note = hyper
  source 1..55: mol_type = genomic DNA

SEQ ID NO: 19283 - DNA, 280 bp, Homo sapiens
  misc_feature 1..280: note = chr6:56818937-56819217
  misc_feature 1..280: note = hyper
  source 1..280: mol_type = genomic DNA
taaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttga

SEQ ID NO: 19284 - DNA, 59 bp, Homo sapiens; identical to SEQ ID NO: 8511
  misc_feature 1..59: note = chr6:56820782-56820841
  misc_feature 1..59: note = hyper
  source 1..59: mol_type = genomic DNA

SEQ ID NO: 19285 - DNA, 19 bp, Homo sapiens
  misc_feature 1..19: note = chr6:58147428-58147447
  misc_feature 1..19: note = hyper
  source 1..19: mol_type = genomic DNA
gaaaaccgcatctcccgaa

SEQ ID NO: 19286 - DNA, 31 bp, Homo sapiens
  misc_feature 1..31: note = chr6:58147480-58147511
  misc_feature 1..31: note = hyper
  source 1..31: mol_type = genomic DNA
tctcttgtcattctccgggatgtaaaagact

SEQ ID NO: 19287 - DNA, 28 bp, Homo sapiens
  misc_feature 1..28: note = chr6:58147762-58147790
  misc_feature 1..28: note = hyper
  source 1..28: mol_type = genomic DNA
acaggcccggcggcggagccctgctccc

SEQ ID NO: 19288 - DNA, 68 bp, Homo sapiens
  misc_feature 1..68: note = chr6:62996146-62996214
  misc_feature 1..68: note = hyper
  source 1..68: mol_type = genomic DNA
aaccactcattggtggtggtgccaggagaggcggggcgctggcagaaggccgcgggctctcattgggc

SEQ ID NO: 19289 - DNA, 181 bp, Homo sapiens; identical to SEQ ID NO: 563
  misc_feature 1..181: note = chr6:62996215-62996396
  misc_feature 1..181: note = hyper
  source 1..181: mol_type = genomic DNA

SEQ ID NO: 19290 - DNA, 30 bp, Homo sapiens; identical to SEQ ID NO: 8518
  misc_feature 1..30: note = chr6:69345066-69345096
  misc_feature 1..30: note = hyper
  source 1..30: mol_type = genomic DNA

SEQ ID NO: 19291 - DNA, 30 bp, Homo sapiens; identical to SEQ ID NO: 8519
  misc_feature 1..30: note = chr6:69345341-69345371
  misc_feature 1..30: note = hyper
  source 1..30: mol_type = genomic DNA

SEQ ID NO: 19292 - DNA, 174 bp, Homo sapiens; identical to SEQ ID NO: 8520
  misc_feature 1..174: note = chr6:69942843-69943017
  misc_feature 1..174: note = hyper
  source 1..174: mol_type = genomic DNA

SEQ ID NO: 19293 - DNA, 45 bp, Homo sapiens
  misc_feature 1..45: note = chr6:70993015-70993060
  misc_feature 1..45: note = hyper
  source 1..45: mol_type = genomic DNA
ccctgccgccgcacaggcgaggactgagcacgcagctctgcctcc

SEQ ID NO: 19294 - DNA, 190 bp, Homo sapiens; identical to SEQ ID NO: 8524
  misc_feature 1..190: note = chr6:71666491-71666681
  misc_feature 1..190: note = hyper
  source 1..190: mol_type = genomic DNA

SEQ ID NO: 19295 - DNA, 90 bp, Homo sapiens
  misc_feature 1..90: note = chr6:71666698-71666788
  misc_feature 1..90: note = hyper
  source 1..90: mol_type = genomic DNA
cgcagcggaagcctgctctcagtcccttgctcttgtcttctcagaacctctccggatccagcagcaagatcccaaagcaaggaaagaaag

SEQ ID NO: 19296 - DNA, 21 bp, Homo sapiens
  misc_feature 1..21: note = chr6:72129768-72129789
  misc_feature 1..21: note = hyper
  source 1..21: mol_type = genomic DNA
ccgcagcccgaggtgcgggag

SEQ ID NO: 19297 - DNA, 22 bp, Homo sapiens
  misc_feature 1..22: note = chr6:72130023-72130045
  misc_feature 1..22: note = hyper
  source 1..22: mol_type = genomic DNA
gggggctgggcgagccgggaga

SEQ ID NO: 19298 - DNA, 60 bp, Homo sapiens
  misc_feature 1..60: note = chr6:72596060-72596120
  misc_feature 1..60: note = hyper
  source 1..60: mol_type = genomic DNA
tgtaggggtagcggccggggcacgcgtggctcggacccggggagtgggcgggtgggtgcc

SEQ ID NO: 19299 - skipped

SEQ ID NO: 19300 - DNA, 30 bp, Homo sapiens; identical to SEQ ID NO: 8533
  misc_feature 1..30: note = chr6:73330633-73330663
  misc_feature 1..30: note = hyper
  source 1..30: mol_type = genomic DNA

SEQ ID NO: 19301 - DNA, 211 bp, Homo sapiens
  misc_feature 1..211: note = chr6:73331304-73331515
  misc_feature 1..211: note = hyper
  source 1..211: mol_type = genomic DNA
cggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagc

SEQ ID NO: 19302 - DNA, 681 bp, Homo sapiens; identical to SEQ ID NO: 8540
  misc_feature 1..681: note = chr6:74019413-74020094
  misc_feature 1..681: note = hyper
  source 1..681: mol_type = genomic DNA

SEQ ID NO: 19303 - DNA, 63 bp, Homo sapiens; identical to SEQ ID NO: 8541
  misc_feature 1..63: note = chr6:74405916-74405979
  misc_feature 1..63: note = hyper
  source 1..63: mol_type = genomic DNA

SEQ ID NO: 19304 - DNA, 30 bp, Homo sapiens; identical to SEQ ID NO: 8542
  misc_feature 1..30: note = chr6:75914569-75914599
  misc_feature 1..30: note = hyper
  source 1..30: mol_type = genomic DNA

SEQ ID NO: 19305 - DNA, 72 bp, Homo sapiens; identical to SEQ ID NO: 8543
  misc_feature 1..72: note = chr6:75915049-75915121
  misc_feature 1..72: note = hyper
  source 1..72: mol_type = genomic DNA

SEQ ID NO: 19306 - DNA, 36 bp, Homo sapiens; identical to SEQ ID NO: 8544
  misc_feature 1..36: note = chr6:75915170-75915206
  misc_feature 1..36: note = hyper
  source 1..36: mol_type = genomic DNA

SEQ ID NO: 19307 - DNA, 90 bp, Homo sapiens; identical to SEQ ID NO: 8545
  misc_feature 1..90: note = chr6:75915711-75915801
  misc_feature 1..90: note = hyper
  source 1..90: mol_type = genomic DNA

SEQ ID NO: 19308 - DNA, 153 bp, Homo sapiens; identical to SEQ ID NO: 8546
  misc_feature 1..153: note = chr6:75916306-75916459
  misc_feature 1..153: note = hyper
  source 1..153: mol_type = genomic DNA

SEQ ID NO: 19309 - DNA, 30 bp, Homo sapiens; identical to SEQ ID NO: 8549
  misc_feature 1..30: note = chr6:78176103-78176133
  misc_feature 1..30: note = hyper
  source 1..30: mol_type = genomic DNA

SEQ ID NO: 19310 - DNA, 14 bp, Homo sapiens
  misc_feature 1..14: note = chr6:78176820-78176834
  misc_feature 1..14: note = hyper
  source 1..14: mol_type = genomic DNA
ggaggaaccaaaga

SEQ ID NO: 19311 - DNA, 42 bp, Homo sapiens; identical to SEQ ID NO: 8552
  misc_feature 1..42: note = chr6:79620753-79620795
  misc_feature 1..42: note = hyper
  source 1..42: mol_type = genomic DNA

SEQ ID NO: 19312 - DNA, 257 bp, Homo sapiens
  misc_feature 1..257: note = chr6:80656673-80656930
  misc_feature 1..257: note = hyper
  source 1..257: mol_type = genomic DNA
cagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctac

SEQ ID NO: 19313 - DNA, 53 bp, Homo sapiens
  misc_feature 1..53: note = chr6:80657180-80657233
  misc_feature 1..53: note = hyper
  source 1..53: mol_type = genomic DNA
ccaagcggaaggcgtcgtcaaggttcccgggagaaagacgaggaggtggagga

SEQ ID NO: 19314 - DNA, 70 bp, Homo sapiens; identical to SEQ ID NO: 8554
  misc_feature 1..70: note = chr6:80657499-80657569
  misc_feature 1..70: note = hyper
  source 1..70: mol_type = genomic DNA

SEQ ID NO: 19315 - skipped

SEQ ID NO: 19316 - DNA, 31 bp, Homo sapiens
  misc_feature 1..31: note = chr6:84418281-84418312
  misc_feature 1..31: note = hyper
  source 1..31: mol_type = genomic DNA
gccgaggcccatcgcccgggccccttccccc

SEQ ID NO: 19317 - DNA, 74 bp, Homo sapiens
  misc_feature 1..74: note = chr6:84418570-84418644
  misc_feature 1..74: note = hyper
  source 1..74: mol_type = genomic DNA
ctgagcggcgccgcccgccgcaggatgagcggagcccgggccgccgagggaagccgcgccggtggatgtgtgcg

SEQ ID NO: 19318 - DNA, 55 bp, Homo sapiens
  misc_feature 1..55: note = chr6:84419102-84419157
  misc_feature 1..55: note = hyper
  source 1..55: mol_type = genomic DNA
ggcacgcactgggctcgcgcaccacgcacacctgcccgccgactgcggggggagc

SEQ ID NO: 19319 - DNA, 53 bp, Homo sapiens
  misc_feature 1..53: note = chr6:84562820-84562873
  misc_feature 1..53: note = hyper
  source 1..53: mol_type = genomic DNA
cggaaattggctgctcgggcgaatgttgtttttctccgcagccatgtgtcgaa

SEQ ID NO: 19320 - DNA, 43 bp, Homo sapiens
  misc_feature 1..43: note = chr6:84563242-84563285
  misc_feature 1..43: note = hyper
  source 1..43: mol_type = genomic DNA
gcgctgctctgcgcctcccagcttcccccgtctctccctcctg

SEQ ID NO: 19321 - DNA, 73 bp, Homo sapiens
  misc_feature 1..73: note = chr6:84563416-84563489
  misc_feature 1..73: note = hyper
  source 1..73: mol_type = genomic DNA
cgcaggcttctggagaccctgggtggacgccggaggcaagaaagaagaggagacgccgaaccacgccgcggag

SEQ ID NO: 19322 - DNA, 311 bp, Homo sapiens
  misc_feature 1..311: note = chr6:84563542-84563853
  misc_feature 1..311: note = hyper
  source 1..311: mol_type = genomic DNA
gaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaa

SEQ ID NO: 19323 - DNA, 30 bp, Homo sapiens; identical to SEQ ID NO: 8564
  misc_feature 1..30: note = chr6:85471966-85471996
  misc_feature 1..30: note = hyper
  source 1..30: mol_type = genomic DNA

SEQ ID NO: 19324 - skipped

SEQ ID NO: 19325 - DNA, 225 bp, Homo sapiens
  misc_feature 1..225: note = chr6:85473703-85473928
  misc_feature 1..225: note = hyper
  source 1..225: mol_type = genomic DNA
aacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctc

SEQ ID NO: 19326 - DNA, 109 bp, Homo sapiens
  misc_feature 1..109: note = chr6:85474485-85474594
  misc_feature 1..109: note = hyper
  source 1..109: mol_type = genomic DNA
gatgtgccagccacacggacgctgaactctgtctctctgacgtccgtagctgagtccagccccgtagtctccagctttcctcaccaggacctggaaaggcggaagttcc

SEQ ID NO: 19327 - DNA, 110 bp, Homo sapiens
  misc_feature 1..110: note = chr6:85477028-85477138
  misc_feature 1..110: note = hyper
  source 1..110: mol_type = genomic DNA
gggcgtcgaatctctcttgggcatgggagggaaagacattccgagttggctgggcggagtggcagccttgagagtgacgagtgacagcaaagcctcgtcctagcaaggcc

SEQ ID NO: 19328 - DNA, 29 bp, Homo sapiens
  misc_feature 1..29: note = chr6:85483316-85483345
  misc_feature 1..29: note = hyper
  source 1..29: mol_type = genomic DNA
tcagggagcgcggaacgcgggtttctgtt

SEQ ID NO: 19329 - DNA, 13 bp, Homo sapiens
  misc_feature 1..13: note = chr6:85484920-85484933
  misc_feature 1..13: note = hyper
  source 1..13: mol_type = genomic DNA
agatagactaagt

SEQ ID NO: 19330 - DNA, 83 bp, Homo sapiens; identical to SEQ ID NO: 8575
  misc_feature 1..83: note = chr6:86159807-86159890
  misc_feature 1..83: note = hyper
  source 1..83: mol_type = genomic DNA

SEQ ID NO: 19331 - DNA, 130 bp, Homo sapiens
  misc_feature 1..130: note = chr6:87861962-87862092
  misc_feature 1..130: note = hyper
  source 1..130: mol_type = genomic DNA
gcgccccgatagtggcgcacgctctccgccatccccgggcctcgcgctttcacctcgcgtgctggggcgagggcggggctgcggggtgtactgggtcgggggtaggaaggacctgccaggccttagccct

SEQ ID NO: 19332 - DNA, 30 bp, Homo sapiens; identical to SEQ ID NO: 8577
  misc_feature 1..30: note = chr6:88875485-88875515
  misc_feature 1..30: note = hyper
  source 1..30: mol_type = genomic DNA

SEQ ID NO: 19333 - DNA, 103 bp, Homo sapiens; identical to SEQ ID NO: 8578
  misc_feature 1..103: note = chr6:88875796-88875899
  misc_feature 1..103: note = hyper
  source 1..103: mol_type = genomic DNA

SEQ ID NO: 19334 - DNA, 175 bp, Homo sapiens; identical to SEQ ID NO: 2852
  misc_feature 1..175: note = chr6:88876302-88876477
  misc_feature 1..175: note = hyper
  source 1..175: mol_type = genomic DNA

SEQ ID NO: 19335 - DNA, 111 bp, Homo sapiens; identical to SEQ ID NO: 2853
  misc_feature 1..111: note = chr6:88876630-88876741
  misc_feature 1..111: note = hyper
  source 1..111: mol_type = genomic DNA

SEQ ID NO: 19336 - DNA, 221 bp, Homo sapiens
  misc_feature 1..221: note = chr6:88876742-88876963
  misc_feature 1..221: note = hyper
  source 1..221: mol_type = genomic DNA
ccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggact

SEQ ID NO: 19337 - DNA, 155 bp, Homo sapiens; identical to SEQ ID NO: 8583
  misc_feature 1..155: note = chr6:90143450-90143605
  misc_feature 1..155: note = hyper
  source 1..155: mol_type = genomic DNA

SEQ ID NO: 19338 - DNA, 350 bp, Homo sapiens; identical to SEQ ID NO: 8584
  misc_feature 1..350: note = chr6:91004829-91005179
  misc_feature 1..350: note = hyper
  source 1..350: mol_type = genomic DNA

SEQ ID NO: 19339 - DNA, 106 bp, Homo sapiens; identical to SEQ ID NO: 8585
  misc_feature 1..106: note = chr6:91005208-91005314
  misc_feature 1..106: note = hyper
  source 1..106: mol_type = genomic DNA

SEQ ID NO: 19340 - DNA, 629 bp, Homo sapiens
  misc_feature 1..629: note = chr6:91320320-91320949
  misc_feature 1..629: note = hyper
  source 1..629: mol_type = genomic DNA
ttatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcag

SEQ ID NO: 19341 - DNA, 43 bp, Homo sapiens; identical to SEQ ID NO: 8587
  misc_feature 1..43: note = chr6:94126380-94126423
  misc_feature 1..43: note = hyper
  source 1..43: mol_type = genomic DNA

SEQ ID NO: 19342 - DNA, 110 bp, Homo sapiens; identical to SEQ ID NO: 8588
  misc_feature 1..110: note = chr6:94126643-94126753
  misc_feature 1..110: note = hyper
  source 1..110: mol_type = genomic DNA

SEQ ID NO: 19343 - DNA, 36 bp, Homo sapiens; identical to SEQ ID NO: 8589
  misc_feature 1..36: note = chr6:94127088-94127124
  misc_feature 1..36: note = hyper
  source 1..36: mol_type = genomic DNA

SEQ ID NO: 19344 - DNA, 116 bp, Homo sapiens
  misc_feature 1..116: note = chr6:94127544-94127660
  misc_feature 1..116: note = hyper
  source 1..116: mol_type = genomic DNA
gggttcagcatctatacaggttgcagatgtggaaagtggggtcagaaggtcaggctgaaagaaggactagaatttggcgccgggtttgaggggggcttgagcgaactaagaggagt

SEQ ID NO: 19345 - DNA, 39 bp, Homo sapiens; identical to SEQ ID NO: 8591
  misc_feature 1..39: note = chr6:94128439-94128478
  misc_feature 1..39: note = hyper
  source 1..39: mol_type = genomic DNA

SEQ ID NO: 19346 - DNA, 36 bp, Homo sapiens; identical to SEQ ID NO: 8592
  misc_feature 1..36: note = chr6:94128713-94128749
  misc_feature 1..36: note = hyper
  source 1..36: mol_type = genomic DNA

SEQ ID NO: 19347 - DNA, 37 bp, Homo sapiens
  misc_feature 1..37: note = chr6:94129182-94129219
  misc_feature 1..37: note = hyper
  source 1..37: mol_type = genomic DNA
cgatcggctgctccacgtttagctttttttaatttcc

SEQ ID NO: 19348 - DNA, 149 bp, Homo sapiens
  misc_feature 1..149: note = chr6:94129257-94129406
  misc_feature 1..149: note = hyper
  source 1..149: mol_type = genomic DNA
caagtctccgactgcagaccggccgcttgctccacactccaataatatcaattagggggggagggggcggggctccgagctgagagcctccgccactcgggctgagtggcaggcacagccggcctgccaggaggcgattcccagggcca

SEQ ID NO: 19349 - DNA, 32 bp, Homo sapiens; identical to SEQ ID NO: 8594
  misc_feature 1..32: note = chr6:94129782-94129814
  misc_feature 1..32: note = hyper
  source 1..32: mol_type = genomic DNA

SEQ ID NO: 19350 - DNA, 93 bp, Homo sapiens; identical to SEQ ID NO: 8595
  misc_feature 1..93: note = chr6:96463220-96463313
  misc_feature 1..93: note = hyper
  source 1..93: mol_type = genomic DNA

SEQ ID NO: 19351 - DNA, 30 bp, Homo sapiens; identical to SEQ ID NO: 8598
  misc_feature 1..30: note = chr6:99273871-99273901
  misc_feature 1..30: note = hyper
  source 1..30: mol_type = genomic DNA

SEQ ID NO: 19352 - DNA, 128 bp, Homo sapiens
  misc_feature 1..128: note = chr6:99279612-99279740
  misc_feature 1..128: note = hyper
  source 1..128: mol_type = genomic DNA
ctcagagccgcggtgcgagcccagcctggcccgcccggtgattggccgcgcttgggggtgggggtggggtgcagagactgaggccccgggtaggctatttctttgtgtactcccggggatttattggg

SEQ ID NO: 19353 - DNA, 41 bp, Homo sapiens
  misc_feature 1..41: note = chr6:99280516-99280557
  misc_feature 1..41: note = hyper
  source 1..41: mol_type = genomic DNA
cggccagagtggccccgcgcttgcgctgggacggagcgaca

SEQ ID NO: 19354 - DNA, 93 bp, Homo sapiens
  misc_feature 1..93: note = chr6:99281385-99281478
  misc_feature 1..93: note = hyper
  source 1..93: mol_type = genomic DNA
taccagcggtaggagcacggggaatcgcgcacgcaggccctccgcgcggcttcccggagcggcctttggcgactgcgccgcccctacaaggcc

SEQ ID NO: 19355 - DNA, 95 bp, Homo sapiens; identical to SEQ ID NO: 8605
  misc_feature 1..95: note = chr6:99282778-99282873
  misc_feature 1..95: note = hyper
  source 1..95: mol_type = genomic DNA

SEQ ID NO: 19356 - DNA, 98 bp, Homo sapiens; identical to SEQ ID NO: 8606
  misc_feature 1..98: note = chr6:99283408-99283506
  misc_feature 1..98: note = hyper
  source 1..98: mol_type = genomic DNA

SEQ ID NO: 19357 - DNA, 75 bp, Homo sapiens
  misc_feature 1..75: note = chr6:99290398-99290473
  misc_feature 1..75: note = hyper
  source 1..75: mol_type = genomic DNA
cctagctcggccgcgcggggaggagagagacagggaaaggagcggggcactccctgcactcccagccccggcctt

SEQ ID NO: 19358 - DNA, 104 bp, Homo sapiens
  misc_feature 1..104: note = chr6:99292417-99292521
  misc_feature 1..104: note = hyper
  source 1..104: mol_type = genomic DNA
ggctcctttaagcatatttccgtgaatctgtttcttgtgctttaatgttactattaattgataagatcagctcatcaaacatactatttcgatagggaattgta

SEQ ID NO: 19359 - DNA, 21 bp, Homo sapiens
  misc_feature 1..21: note = chr6:100038661-100038682
  misc_feature 1..21: note = hyper
  source 1..21: mol_type = genomic DNA
cttcctcccactgtgcgagct

SEQ ID NO: 19360 - DNA, 190 bp, Homo sapiens
  misc_feature 1..190: note = chr6:100038964-100039154
  misc_feature 1..190: note = hyper
  source 1..190: mol_type = genomic DNA
tctaagaaggcataaactcggcctgagacgtgggggggagacactgcagagaagaggccaagttccagcgcagaaggggggttccgcggggccctgggattgaggagacaggagcgagccttccctttccgtcctctcaggaaaacagcctgacctgctggcacgtccacccccaacagaagagggaccc

SEQ ID NO: 19361 - DNA, 19 bp, Homo sapiens
  misc_feature 1..19: note = chr6:100054917-100054936
  misc_feature 1..19: note = hyper
  source 1..19: mol_type = genomic DNA
gagccgccagagcgccagc

SEQ ID NO: 19362 - DNA, 52 bp, Homo sapiens; identical to SEQ ID NO: 8620
  misc_feature 1..52: note = chr6:100055281-100055333
  misc_feature 1..52: note = hyper
  source 1..52: mol_type = genomic DNA

SEQ ID NO: 19363 - DNA, 235 bp, Homo sapiens
  misc_feature 1..235: note = chr6:100061076-100061311
  misc_feature 1..235: note = hyper
  source 1..235: mol_type = genomic DNA
gtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgagg

SEQ ID NO: 19364 - DNA, 33 bp, Homo sapiens
  misc_feature 1..33: note = chr6:100061419-100061452
  misc_feature 1..33: note = hyper
  source 1..33: mol_type = genomic DNA
ggcggcggccgctcacggcgacccctaccggga

SEQ ID NO: 19365 - DNA, 190 bp, Homo sapiens
  misc_feature 1..190: note = chr6:100061988-100062178
  misc_feature 1..190: note = hyper
  source 1..190: mol_type = genomic DNA
cggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcac

SEQ ID NO: 19366 - DNA, 84 bp, Homo sapiens
  misc_feature 1..84: note = chr6:100062586-100062670
  misc_feature 1..84: note = hyper
  source 1..84: mol_type = genomic DNA
cgaccagagcgaccccgaggttgggggcggcggggagcgcgacttgtaacgagtcttcccgggaaggggcggggtgaggacaga

SEQ ID NO: 19367 - DNA, 34 bp, Homo sapiens
  misc_feature 1..34: note = chr6:100062910-100062944
  misc_feature 1..34: note = hyper
  source 1..34: mol_type = genomic DNA
cctgaaccgcccaggcggtctgctcttggtgttc

SEQ ID NO: 19368 - DNA, 20 bp, Homo sapiens
  misc_feature 1..20: note = chr6:100063068-100063088
  misc_feature 1..20: note = hyper
  source 1..20: mol_type = genomic DNA
tttcacgttagcatttcatt

SEQ ID NO: 19369 - DNA, 39 bp, Homo sapiens; identical to SEQ ID NO: 8624
  misc_feature 1..39: note = chr6:100067144-100067183
  misc_feature 1..39: note = hyper
  source 1..39: mol_type = genomic DNA

SEQ ID NO: 19370 - DNA, 30 bp, Homo sapiens; identical to SEQ ID NO: 8625
  misc_feature 1..30: note = chr6:100067397-100067427
  misc_feature 1..30: note = hyper
  source 1..30: mol_type = genomic DNA

SEQ ID NO: 19371 - skipped

SEQ ID NO: 19372 - DNA, 132 bp, Homo sapiens
  misc_feature 1..132: note = chr6:100441966-100442098
  misc_feature 1..132: note = hyper
  source 1..132: mol_type = genomic DNA
caggttgggagccagccccacctccatttccaaagcgggggtccaggcacaggaacagccaaacgcccgaaccagcggggttacctttgccacttcatccaatccgagcatcgggtgcgtcgtgctcttttc

SEQ ID NO: 19373 - DNA, 43 bp, Homo sapiens
  misc_feature 1..43: note = chr6:100906016-100906059
  misc_feature 1..43: note = hyper
  source 1..43: mol_type = genomic DNA
gcccgagttggagccagccgcgaaaagacggcagaaacccaag

SEQ ID NO: 19374 - DNA, 18 bp, Homo sapiens
  misc_feature 1..18: note = chr6:100912403-100912421
  misc_feature 1..18: note = hyper
  source 1..18: mol_type = genomic DNA
gggtgggaggcgccgcgg

SEQ ID NO: 19375 - DNA, 30 bp, Homo sapiens; identical to SEQ ID NO: 8634
  misc_feature 1..30: note = chr6:100915720-100915750
  misc_feature 1..30: note = hyper
  source 1..30: mol_type = genomic DNA

SEQ ID NO: 19376 - DNA, 238 bp, Homo sapiens; identical to SEQ ID NO: 8636
  misc_feature 1..238: note = chr6:101841128-101841366
  misc_feature 1..238: note = hyper
  source 1..238: mol_type = genomic DNA

SEQ ID NO: 19377 - DNA, 54 bp, Homo sapiens; identical to SEQ ID NO: 8637
  misc_feature 1..54: note = chr6:101841599-101841653
  misc_feature 1..54: note = hyper
  source 1..54: mol_type = genomic DNA

SEQ ID NO: 19378 - DNA, 24 bp, Homo sapiens
  misc_feature 1..24: note = chr6:105401596-105401620
  misc_feature 1..24: note = hyper
  source 1..24: mol_type = genomic DNA
cggccgcctggggagcgacctgcc

SEQ ID NO: 19379 - DNA, 55 bp, Homo sapiens
  misc_feature 1..55: note = chr6:105404519-105404574
  misc_feature 1..55: note = hyper
  source 1..55: mol_type = genomic DNA
taaatatgaaattagcgttccaagcaggtttactgccatggaatagctgaattct

SEQ ID NO: 19380 - DNA, 264 bp, Homo sapiens
  misc_feature 1..264: note = chr6:105405772-105406036
  misc_feature 1..264: note = hyper
  source 1..264: mol_type = genomic DNA
gcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaat

SEQ ID NO: 19381 - DNA, 30 bp, Homo sapiens; identical to SEQ ID NO: 8644
  misc_feature 1..30: note = chr6:105406435-105406465
  misc_feature 1..30: note = hyper
  source 1..30: mol_type = genomic DNA

SEQ ID NO: 19382 - DNA, 83 bp, Homo sapiens; identical to SEQ ID NO: 587
  misc_feature 1..83: note = chr6:105584133-105584216
  misc_feature 1..83: note = hyper
  source 1..83: mol_type = genomic DNA

SEQ ID NO: 19383 - DNA, 47 bp, Homo sapiens
  misc_feature 1..47: note = chr6:105584217-105584264
  misc_feature 1..47: note = hyper
  source 1..47: mol_type = genomic DNA
ctctcccggggccctctgacctcgctccttaaaggaggagggtccgt

SEQ ID NO: 19384 - DNA, 13 bp, Homo sapiens
  misc_feature 1..13: note = chr6:105585554-105585567
  misc_feature 1..13: note = hyper
  source 1..13: mol_type = genomic DNA
ggggtcaggcctc

SEQ ID NO: 19385 - DNA, 420 bp, Homo sapiens; identical to SEQ ID NO: 8649
  misc_feature 1..420: note = chr6:105627657-105628077
  misc_feature 1..420: note = hyper
  source 1..420: mol_type = genomic DNA

SEQ ID NO: 19386 - DNA, 47 bp, Homo sapiens; identical to SEQ ID NO: 8652
  misc_feature 1..47: note = chr6:106434211-106434258
  misc_feature 1..47: note = hyper
  source 1..47: mol_type = genomic DNA

SEQ ID NO: 19387 - DNA, 141 bp, Homo sapiens
  misc_feature 1..141: note = chr6:106442979-106443120
  misc_feature 1..141: note = hyper
  source 1..141: mol_type = genomic DNA
cctcatcctcctccccattcccttgccttcttttaggtcttcggttcgtgacaagtgcataggttaggcttgcacggaagagggtcggggcaggtgccagctcagggcacctacccggcgttgtcacgttccctttgggat

SEQ ID NO: 19388 - DNA, 75 bp, Homo sapiens
  misc_feature 1..75: note = chr6:106960833-106960908
  misc_feature 1..75: note = hyper
  source 1..75: mol_type = genomic DNA
tggagcttctgacgccgacggcttgaagcccaggaaccatttcggcgtgggcaggtcgacagtgaccactaaagt

SEQ ID NO: 19389 - DNA, 34 bp, Homo sapiens; identical to SEQ ID NO: 8655
  misc_feature 1..34: note = chr6:108434966-108435000
  misc_feature 1..34: note = hyper
  source 1..34: mol_type = genomic DNA

SEQ ID NO: 19390 - DNA, 261 bp, Homo sapiens
  misc_feature 1..261: note = chr6:108436526-108436787
  misc_feature 1..261: note = hyper
  source 1..261: mol_type = genomic DNA
cagggctttggatgccggggattttgaggacccattcaaagctccgagggggcggaggctcaagcaagccagggaaaaggtcccctaagcctcagagcctgggctgcgccccagacaaagtgcctaatgcagagtaggctcttaataggtttgcattggatctaaacgaaagctagtgaaattcgtacatgattctaatgagagatgacggccaggtgttctcagcagcccctggccctcacggggcgacctgaaagttcc

SEQ ID NO: 19391 - DNA, 15 bp, Homo sapiens
  misc_feature 1..15: note = chr6:108438142-108438157
  misc_feature 1..15: note = hyper
  source 1..15: mol_type = genomic DNA
gcagcccaactgggg

SEQ ID NO: 19392 - DNA, 53 bp, Homo sapiens; identical to SEQ ID NO: 8659
  misc_feature 1..53: note = chr6:108438779-108438832
  misc_feature 1..53: note = hyper
  source 1..53: mol_type = genomic DNA

SEQ ID NO: 19393 - DNA, 13 bp, Homo sapiens
  misc_feature 1..13: note = chr6:108440078-108440091
  misc_feature 1..13: note = hyper
  source 1..13: mol_type = genomic DNA
cctcatattcttg

SEQ ID NO: 19394 - skipped

SEQ ID NO: 19395 - DNA, 416 bp, Homo sapiens
  misc_feature 1..416: note = chr6:108478874-108479290
  misc_feature 1..416: note = hyper
  source 1..416: mol_type = genomic DNA
gtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctg

SEQ ID NO: 19396 - DNA, 31 bp, Homo sapiens
  misc_feature 1..31: note = chr6:108479665-108479696
  misc_feature 1..31: note = hyper
  source 1..31: mol_type = genomic DNA
ggcccatgatctggagcgctcaacttgggag

SEQ ID NO: 19397 - DNA, 37 bp, Homo sapiens
  misc_feature 1..37: note = chr6:108484872-108484909
  misc_feature 1..37: note = hyper
  source 1..37: mol_type = genomic DNA
gagtagaaggcagcccgcactaaggctccaggcttat

SEQ ID NO: 19398 - DNA, 152 bp, Homo sapiens
  misc_feature 1..152: note = chr6:108485513-108485665
  misc_feature 1..152: note = hyper
  source 1..152: mol_type = genomic DNA
aaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctc

SEQ ID NO: 19399 - DNA, 102 bp, Homo sapiens
  misc_feature 1..102: note = chr6:108485905-108486007
  misc_feature 1..102: note = hyper
  source 1..102: mol_type = genomic DNA
ggtcgcggcgccccactaaggaggacacaggctctggtgtgtgtggtgtgcgagaccccgagctcgaggccgagccaaggctgggcagaaagttgcaatcac

SEQ ID NO: 19400 - DNA, 150 bp, Homo sapiens
  misc_feature 1..150: note = chr6:108486008-108486158
  misc_feature 1..150: note = hyper
  source 1..150: mol_type = genomic DNA
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtc

SEQ ID NO: 19401 - DNA, 38 bp, Homo sapiens; identical to SEQ ID NO: 8666
  misc_feature 1..38: note = chr6:108487419-108487457
  misc_feature 1..38: note = hyper
  source 1..38: mol_type = genomic DNA

SEQ ID NO: 19402 - DNA, 28 bp, Homo sapiens
  misc_feature 1..28: note = chr6:108488416-108488444
  misc_feature 1..28: note = hyper
  source 1..28: mol_type = genomic DNA
atgctttgcaccccgtttctagctattt

SEQ ID NO: 19403 - DNA, 18 bp, Homo sapiens
  misc_feature 1..18: note = chr6:108490960-108490978
  misc_feature 1..18: note = hyper
  source 1..18: mol_type = genomic DNA
cacaatctcccctcccgc

SEQ ID NO: 19404 - DNA, 19 bp, Homo sapiens
  misc_feature 1..19: note = chr6:108492251-108492270
  misc_feature 1..19: note = hyper
  source 1..19: mol_type = genomic DNA
tcaagtttgtctcctcgcg

SEQ ID NO: 19405 - DNA, 90 bp, Homo sapiens
  misc_feature 1..90: note = chr6:108492451-108492541
  misc_feature 1..90: note = hyper
  source 1..90: mol_type = genomic DNA
gctcattgtaggaaactgacacttgctcaaggaaaaaaagtttgggtataaaatcacttcattatttgcttttaccgcagcttcggtgct

SEQ ID NO: 19406 - DNA, 257 bp, Homo sapiens
  misc_feature 1..257: note = chr6:108495951-108496208
  misc_feature 1..257: note = hyper
  source 1..257: mol_type = genomic DNA
ctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatg

SEQ ID NO: 19407 - DNA, 39 bp, Homo sapiens; identical to SEQ ID NO: 8676
  misc_feature 1..39: note = chr6:110299546-110299585
  misc_feature 1..39: note = hyper
  source 1..39: mol_type = genomic DNA

SEQ ID NO: 19408 - DNA, 183 bp, Homo sapiens
  misc_feature 1..183: note = chr6:110678940-110679123
  misc_feature 1..183: note = hyper
  source 1..183: mol_type = genomic DNA
atagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctgg

SEQ ID NO: 19409 - DNA, 252 bp, Homo sapiens
  misc_feature 1..252: note = chr6:110679414-110679666
  misc_feature 1..252: note = hyper
  source 1..252: mol_type = genomic DNA
ccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctgga

SEQ ID NO: 19410 - DNA, 103 bp, Homo sapiens; identical to SEQ ID NO: 8679
  misc_feature 1..103: note = chr6:111409667-111409770
  misc_feature 1..103: note = hyper
  source 1..103: mol_type = genomic DNA

SEQ ID NO: 19411 - DNA, 30 bp, Homo sapiens; identical to SEQ ID NO: 8680
  misc_feature 1..30: note = chr6:114663242-114663272
  misc_feature 1..30: note = hyper
  source 1..30: mol_type = genomic DNA

SEQ ID NO: 19412 - DNA, 55 bp, Homo sapiens; identical to SEQ ID NO: 2904
  misc_feature 1..55: note = chr6:117586007-117586062
  misc_feature 1..55: note = hyper
  source 1..55: mol_type = genomic DNA

SEQ ID NO: 19413 - DNA, 36 bp, Homo sapiens; identical to SEQ ID NO: 8684
  misc_feature 1..36: note = chr6:117586401-117586437
  misc_feature 1..36: note = hyper
  source 1..36: mol_type = genomic DNA

SEQ ID NO: 19414 - DNA, 30 bp, Homo sapiens; identical to SEQ ID NO: 8685
  misc_feature 1..30: note = chr6:117587193-117587223
  misc_feature 1..30: note = hyper
  source 1..30: mol_type = genomic DNA

SEQ ID NO: 19415 - DNA, 25 bp, Homo sapiens
  misc_feature 1..25: note = chr6:117587577-117587602
  misc_feature 1..25: note = hyper
  source 1..25: mol_type = genomic DNA
ttttcctttgcgaagttctgggagc

SEQ ID NO: 19416 - DNA, 205 bp, Homo sapiens
  misc_feature 1..205: note = chr6:117591206-117591411
  misc_feature 1..205: note = hyper
  source 1..205: mol_type = genomic DNA
gcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtt

SEQ ID NO: 19417 - DNA, 75 bp, Homo sapiens; identical to SEQ ID NO: 8688
  misc_feature 1..75: note = chr6:117591753-117591828
  misc_feature 1..75: note = hyper
  source 1..75: mol_type = genomic DNA

SEQ ID NO: 19418 - DNA, 39 bp, Homo sapiens; identical to SEQ ID NO: 8689
  misc_feature 1..39: note = chr6:117592099-117592138
  misc_feature 1..39: note = hyper
  source 1..39: mol_type = genomic DNA

SEQ ID NO: 19419 - DNA, 81 bp, Homo sapiens
  misc_feature 1..81: note = chr6:118228151-118228232
  misc_feature 1..81: note = hyper
  source 1..81: mol_type = genomic DNA
aactccacagggaggatctattcccagcccccttatccccctaaaaaacacccaaaccaaaacaatcaccacaacctagac

SEQ ID NO: 19420 - DNA, 96 bp, Homo sapiens
  misc_feature 1..96: note = chr6:118228651-118228747
  misc_feature 1..96: note = hyper
  source 1..96: mol_type = genomic DNA
gcggcggcggcggcacgggcgcgagggtgcgcgcactgggactggagaggagtgagtggcgggctgggcggcggcggccgtagccgcgggtgcctc

SEQ ID NO: 19421 - DNA, 41 bp, Homo sapiens
  misc_feature 1..41: note = chr6:118228828-118228869
  misc_feature 1..41: note = hyper
  source 1..41: mol_type = genomic DNA
aaccggcacacgatgcacccggctgcgttctgatcgccgcc

SEQ ID NO: 19422 - DNA, 284 bp, Homo sapiens
  misc_feature 1..284: note = chr6:118228870-118229154
  misc_feature 1..284: note = hyper
  source 1..284: mol_type = genomic DNA
cgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcc

SEQ ID NO: 19423 - skipped

SEQ ID NO: 19424 - DNA, 45 bp, Homo sapiens; identical to SEQ ID NO: 8696
  misc_feature 1..45: note = chr6:119399159-119399204
  misc_feature 1..45: note = hyper
  source 1..45: mol_type = genomic DNA

SEQ ID NO: 19425 - DNA, 40 bp, Homo sapiens
  misc_feature 1..40: note = chr6:121758632-121758672
  misc_feature 1..40: note = hyper
  source 1..40: mol_type = genomic DNA
ttcccgagaatgaggcggggcggctcaaggggaaagggca

SEQ ID NO: 19426 - DNA, 35 bp, Homo sapiens; identical to SEQ ID NO: 2910
  misc_feature 1..35: note = chr6:123316972-123317007
  misc_feature 1..35: note = hyper
  source 1..35: mol_type = genomic DNA

SEQ ID NO: 19427 - DNA, 125 bp, Homo sapiens
  misc_feature 1..125: note = chr6:123317589-123317714
  misc_feature 1..125: note = hyper
  source 1..125: mol_type = genomic DNA
cttctctcccgaaggcgaaaatggcagggccaggcgagaacctgggacagcggtggccctagccctgcgatcctcacccctcctgctaggagaggctgcgggctgcccgcggacgatgtggccgc

SEQ ID NO: 19428 - DNA, 82 bp, Homo sapiens
  misc_feature 1..82: note = chr6:123317715-123317797
  misc_feature 1..82: note = hyper
  source 1..82: mol_type = genomic DNA
gctgctcccgagcgcatcttcggcccgggtccccgccgccacccctcttctctgctccttccatcccgcccagaggagttga

SEQ ID NO: 19429 - DNA, 38 bp, Homo sapiens
  misc_feature 1..38: note = chr6:123317833-123317871
  misc_feature 1..38: note = hyper
  source 1..38: mol_type = genomic DNA
ggctgatggatgccagggagtgccgcattgcttagcga

SEQ ID NO: 19430 - DNA, 121 bp, Homo sapiens
  misc_feature 1..121: note = chr6:124124311-124124432
  misc_feature 1..121: note = hyper
  source 1..121: mol_type = genomic DNA
ccgctctggatgcctcggttgcacccctgttccatgaccccagcttccttccctaaccctcctcttggtcccttctcccccgagcgcgcgcgcacacacacactcggttcgctcccgcgga

SEQ ID NO: 19431 - DNA, 137 bp, Homo sapiens
  misc_feature 1..137: note = chr6:124124466-124124603
  misc_feature 1..137: note = hyper
  source 1..137: mol_type = genomic DNA
aaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttg

SEQ ID NO: 19432 - DNA, 47 bp, Homo sapiens; identical to SEQ ID NO: 8703
  misc_feature 1..47: note = chr6:125282746-125282793
  misc_feature 1..47: note = hyper
  source 1..47: mol_type = genomic DNA

SEQ ID NO: 19433 - DNA, 269 bp, Homo sapiens; identical to SEQ ID NO: 8704
  misc_feature 1..269: note = chr6:125283133-125283402
  misc_feature 1..269: note = hyper
  source 1..269: mol_type = genomic DNA

SEQ ID NO: 19434 - DNA, 206 bp, Homo sapiens
  misc_feature 1..206: note = chr6:125283925-125284131
  misc_feature 1..206: note = hyper
  source 1..206: mol_type = genomic DNA
gtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctg

SEQ ID NO: 19435 - DNA, 33 bp, Homo sapiens; identical to SEQ ID NO: 8706
  misc_feature 1..33: note = chr6:125475551-125475584
  misc_feature 1..33: note = hyper
  source 1..33: mol_type = genomic DNA

SEQ ID NO: 19436 - DNA, 94 bp, Homo sapiens; identical to SEQ ID NO: 8707
  misc_feature 1..94: note = chr6:125684588-125684682
  misc_feature 1..94: note = hyper
  source 1..94: mol_type = genomic DNA

SEQ ID NO: 19437 - DNA, 24 bp, Homo sapiens
  misc_feature 1..24: note = chr6:126068068-126068092
  misc_feature 1..24: note = hyper
  source 1..24: mol_type = genomic DNA
cgttccctcattctttctcttttc

SEQ ID NO: 19438 - DNA, 33 bp, Homo sapiens; identical to SEQ ID NO: 8709
  misc_feature 1..33: note = chr6:126069106-126069139
  misc_feature 1..33: note = hyper
  source 1..33: mol_type = genomic DNA

SEQ ID NO: 19439 - DNA, 225 bp, Homo sapiens; identical to SEQ ID NO: 8710
  misc_feature 1..225: note = chr6:126069350-126069575
  misc_feature 1..225: note = hyper
  source 1..225: mol_type = genomic DNA

SEQ ID NO: 19440 - DNA, 51 bp, Homo sapiens; identical to SEQ ID NO: 8711
  misc_feature 1..51: note = chr6:126069805-126069856
  misc_feature 1..51: note = hyper
  source 1..51: mol_type = genomic DNA

SEQ ID NO: 19441 - DNA, 42 bp, Homo sapiens; identical to SEQ ID NO: 8712
  misc_feature 1..42: note = chr6:126071276-126071318
  misc_feature 1..42: note = hyper
  source 1..42: mol_type = genomic DNA

SEQ ID NO: 19442 - DNA, 23 bp, Homo sapiens
  misc_feature 1..23: note = chr6:127439250-127439273
  misc_feature 1..23: note = hyper
  source 1..23: mol_type = genomic DNA
gggagagggtagttgcgcgccgg

SEQ ID NO: 19443 - DNA, 58 bp, Homo sapiens
  misc_feature 1..58: note = chr6:127439321-127439379
  misc_feature 1..58: note = hyper
  source 1..58: mol_type = genomic DNA
cggccaccgacagccgggtgcgcctagcttgaggccgcggagaggagccgaactggga

SEQ ID NO: 19444 - DNA, 34 bp, Homo sapiens
  misc_feature 1..34: note = chr6:127439453-127439487
  misc_feature 1..34: note = hyper
  source 1..34: mol_type = genomic DNA
tctggaggggctcttcgcacgcactgctttcccc

SEQ ID NO: 19445 - DNA, 147 bp, Homo sapiens
  misc_feature 1..147: note = chr6:127439838-127439985
  misc_feature 1..147: note = hyper
  source 1..147: mol_type = genomic DNA
acgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccg

SEQ ID NO: 19446 - DNA, 65 bp, Homo sapiens
  misc_feature 1..65: note = chr6:127440127-127440192
  misc_feature 1..65: note = hyper
  source 1..65: mol_type = genomic DNA
ggataatttgaaagtacaatagttggtttccctgtccacccgccccacttcgcttgccatcacag

SEQ ID NO: 19447 - DNA, 431 bp, Homo sapiens
  misc_feature 1..431: note = chr6:127441123-127441554
  misc_feature 1..431: note = hyper
  source 1..431: mol_type = genomic DNA
tccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctc

SEQ ID NO: 19448 - DNA, 175 bp, Homo sapiens
  misc_feature 1..175: note = chr6:127442104-127442279
  misc_feature 1..175: note = hyper
  source 1..175: mol_type = genomic DNA
ctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccac

SEQ ID NO: 19449 - DNA, 329 bp, Homo sapiens; identical to SEQ ID NO: 8721
  misc_feature 1..329: note = chr6:127836715-127837044
  misc_feature 1..329: note = hyper
  source 1..329: mol_type = genomic DNA

SEQ ID NO: 19450 - DNA, 223 bp, Homo sapiens; identical to SEQ ID NO: 8722
  misc_feature 1..223: note = chr6:127837399-127837622
  misc_feature 1..223: note = hyper
  source 1..223: mol_type = genomic DNA

SEQ ID NO: 19451 - DNA, 12 bp, Homo sapiens
  misc_feature 1..12: note = chr6:127840681-127840693
  misc_feature 1..12: note = hyper
  source 1..12: mol_type = genomic DNA
cccacagagatc

SEQ ID NO: 19452 - DNA, 105 bp, Homo sapiens
  misc_feature 1..105: note = chr6:130686429-130686534
  misc_feature 1..105: note = hyper
  source 1..105: mol_type = genomic DNA
ctcatcgaagacccccgtgcttcagttccctctgtcttccatttcccccgcccatggttctcgcccccccaagccgttctccggaaccccttgccgggccggcgg

SEQ ID NO: 19453 - DNA, 136 bp, Homo sapiens
  misc_feature 1..136: note = chr6:130687057-130687193
  misc_feature 1..136: note = hyper
  source 1..136: mol_type = genomic DNA
ccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 19454 - DNA, 120 bp, Homo sapiens; identical to SEQ ID NO: 2918
  misc_feature 1..120: note = chr6:130687224-130687344
  misc_feature 1..120: note = hyper
  source 1..120: mol_type = genomic DNA

SEQ ID NO: 19455 - DNA, 166 bp, Homo sapiens; identical to SEQ ID NO: 8727
  misc_feature 1..166: note = chr6:130687620-130687786
  misc_feature 1..166: note = hyper
  source 1..166: mol_type = genomic DNA

SEQ ID NO: 19456 - DNA, 285 bp, Homo sapiens
  misc_feature 1..285: note = chr6:132722196-132722481
  misc_feature 1..285: note = hyper
  source 1..285: mol_type = genomic DNA
tgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggt

SEQ ID NO: 19457 - DNA, 24 bp, Homo sapiens
  misc_feature 1..24: note = chr6:133563058-133563082
  misc_feature 1..24: note = hyper
  source 1..24: mol_type = genomic DNA
cttggaggccgggtgccccacgcc

SEQ ID NO: 19458 - DNA, 97 bp, Homo sapiens
  misc_feature 1..97: note = chr6:133563918-133564015
  misc_feature 1..97: note = hyper
  source 1..97: mol_type = genomic DNA
gtcatctcttccctgcttgggaggatagtgtttcccttcaccaccacccctctttctccttcctatgaagacaacggatttgcgcctggggtgagag

SEQ ID NO: 19459 - DNA, 30 bp, Homo sapiens; identical to SEQ ID NO: 8732
  misc_feature 1..30: note = chr6:134175985-134176015
  misc_feature 1..30: note = hyper
  source 1..30: mol_type = genomic DNA

SEQ ID NO: 19460 - DNA, 97 bp, Homo sapiens; identical to SEQ ID NO: 8736
  misc_feature 1..97: note = chr6:134216904-134217001
  misc_feature 1..97: note = hyper
  source 1..97: mol_type = genomic DNA

SEQ ID NO: 19461 - DNA, 30 bp, Homo sapiens; identical to SEQ ID NO: 8737
  misc_feature 1..30: note = chr6:134217399-134217429
  misc_feature 1..30: note = hyper
  source 1..30: mol_type = genomic DNA

SEQ ID NO: 19462 - DNA, 281 bp, Homo sapiens; identical to SEQ ID NO: 8738
  misc_feature 1..281: note = chr6:134499571-134499852
  misc_feature 1..281: note = hyper
  source 1..281: mol_type = genomic DNA

SEQ ID NO: 19463 - DNA, 95 bp, Homo sapiens; identical to SEQ ID NO: 8739
  misc_feature 1..95: note = chr6:134638851-134638946
  misc_feature 1..95: note = hyper
  source 1..95: mol_type = genomic DNA

SEQ ID NO: 19464 - DNA, 21 bp, Homo sapiens
  misc_feature 1..21: note = chr6:137241907-137241928
  misc_feature 1..21: note = hyper
  source 1..21: mol_type = genomic DNA
ggcaacgtgatgcagcgctaa

SEQ ID NO: 19465 - DNA, 44 bp, Homo sapiens; identical to SEQ ID NO: 8742
  misc_feature 1..44: note = chr6:137242390-137242434
  misc_feature 1..44: note = hyper
  source 1..44: mol_type = genomic DNA

SEQ ID NO: 19466 - DNA, 86 bp, Homo sapiens; identical to SEQ ID NO: 8746
  misc_feature 1..86: note = chr6:137808768-137808854
  misc_feature 1..86: note = hyper
  source 1..86: mol_type = genomic DNA

SEQ ID NO: 19467 - DNA, 33 bp, Homo sapiens
  misc_feature 1..33: note = chr6:137809108-137809141
  misc_feature 1..33: note = hyper
  source 1..33: mol_type = genomic DNA
gcccctgtcctcctgcggtgcgagaaacccgac

SEQ ID NO: 19468 - DNA, 30 bp, Homo sapiens; identical to SEQ ID NO: 8750
  misc_feature 1..30: note = chr6:137814359-137814389
  misc_feature 1..30: note = hyper
  source 1..30: mol_type = genomic DNA

SEQ ID NO: 19469 - DNA, 77 bp, Homo sapiens
  misc_feature 1..77: note = chr6:137815662-137815739
  misc_feature 1..77: note = hyper
  source 1..77: mol_type = genomic DNA
tttagcaaggattcctattcatattcattgtggggccgccctgggacacctctgctccgaaccgctaggagccccca

SEQ ID NO: 19470 - DNA, 13 bp, Homo sapiens
  misc_feature 1..13: note = chr6:137816459-137816472
  misc_feature 1..13: note = hyper
  source 1..13: mol_type = genomic DNA
cttcctggacctt

SEQ ID NO: 19471 - DNA, 198 bp, Homo sapiens; identical to SEQ ID NO: 8756
  misc_feature 1..198: note = chr6:137818062-137818260
  misc_feature 1..198: note = hyper
  source 1..198: mol_type = genomic DNA

SEQ ID NO: 19472 - DNA, 180 bp, Homo sapiens
  misc_feature 1..180: note = chr6:137819368-137819548
  misc_feature 1..180: note = hyper
  source 1..180: mol_type = genomic DNA
agcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctg

SEQ ID NO: 19473 - DNA, 30 bp, Homo sapiens; identical to SEQ ID NO: 8760
  misc_feature 1..30: note = chr6:142409862-142409892
  misc_feature 1..30: note = hyper
  source 1..30: mol_type = genomic DNA

SEQ ID NO: 19474 - DNA, 148 bp, Homo sapiens; identical to SEQ ID NO: 8761
  misc_feature 1..148: note = chr6:146349536-146349684
  misc_feature 1..148: note = hyper
  source 1..148: mol_type = genomic DNA

SEQ ID NO: 19475 - DNA, 71 bp, Homo sapiens
  misc_feature 1..71: note = chr6:146755496-146755567
  misc_feature 1..71: note = hyper
  source 1..71: mol_type = genomic DNA
ggtgctggcaggccccggtggtcccgggaacgggctgcggtccctgtacccgcccccgccacctccgcagc

SEQ ID NO: 19476 - DNA, 12 bp, Homo sapiens
  misc_feature 1..12: note = chr6:146755649-146755661
  misc_feature 1..12: note = hyper
  source 1..12: mol_type = genomic DNA
gaggtttaagct

SEQ ID NO: 19477 - DNA, 134 bp, Homo sapiens; identical to SEQ ID NO: 8763
  misc_feature 1..134: note = chr6:149069231-149069365
  misc_feature 1..134: note = hyper
  source 1..134: mol_type = genomic DNA

SEQ ID NO: 19478 - DNA, 30 bp, Homo sapiens; identical to SEQ ID NO: 8764
  misc_feature 1..30: note = chr6:150284761-150284791
  misc_feature 1..30: note = hyper
  source 1..30: mol_type = genomic DNA

SEQ ID NO: 19479 - DNA, 152 bp, Homo sapiens; identical to SEQ ID NO: 8768
  misc_feature 1..152: note = chr6:150311146-150311298
  misc_feature 1..152: note = hyper
  source 1..152: mol_type = genomic DNA

SEQ ID NO: 19480 - DNA, 170 bp, Homo sapiens; identical to SEQ ID NO: 8769
  misc_feature 1..170: note = chr6:150311893-150312063
  misc_feature 1..170: note = hyper
  source 1..170: mol_type = genomic DNA

SEQ ID NO: 19481 - DNA, 15 bp, Homo sapiens
  misc_feature 1..15: note = chr6:150359438-150359453
  misc_feature 1..15: note = hyper
  source 1..15: mol_type = genomic DNA
cgggagaaagggaga

SEQ ID NO: 19482 - DNA, 135 bp, Homo sapiens
  misc_feature 1..135: note = chr6:151561857-151561992
  misc_feature 1..135: note = hyper
  source 1..135: mol_type = genomic DNA
aggtacgggcgtgccgggccacctgcgccgggaggcgcgggtctttgggggtgggggtgggggtgggggggtccctccgatttccgccgagagaacttcccagcccatccagccgcatctgcaaactcaggagtg

SEQ ID NO: 19483 - DNA, 10 bp, Homo sapiens
  misc_feature 1..10: note = chr6:151562056-151562066
  misc_feature 1..10: note = hyper
  source 1..10: mol_type = genomic DNA
cgcggcgggg

SEQ ID NO: 19484 - DNA, 113 bp, Homo sapiens; identical to SEQ ID NO: 8775
  misc_feature 1..113: note = chr6:151815244-151815357
  misc_feature 1..113: note = hyper
  source 1..113: mol_type = genomic DNA

SEQ ID NO: 19485 - DNA, 78 bp, Homo sapiens
  misc_feature 1..78: note = chr6:152622937-152623015
  misc_feature 1..78: note = hyper
  source 1..78: mol_type = genomic DNA
gaacatggagccactcgccaggctccagtcaaagagcaaagccgcggggacccactggatccttaccatgaccacaga

SEQ ID NO: 19486 - DNA, 90 bp, Homo sapiens; identical to SEQ ID NO: 8777
  misc_feature 1..90: note = chr6:152957532-152957622
  misc_feature 1..90: note = hyper
  source 1..90: mol_type = genomic DNA

SEQ ID NO: 19487 - DNA, 209 bp, Homo sapiens
  misc_feature 1..209: note = chr6:152958076-152958285
  misc_feature 1..209: note = hyper
  source 1..209: mol_type = genomic DNA
gttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagag

SEQ ID NO: 19488 - DNA, 259 bp, Homo sapiens
  misc_feature 1..259: note = chr6:153450977-153451236
  misc_feature 1..259: note = hyper
  source 1..259: mol_type = genomic DNA
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtc

SEQ ID NO: 19489 - DNA, 80 bp, Homo sapiens
  misc_feature 1..80: note = chr6:153451810-153451890
  misc_feature 1..80: note = hyper
  source 1..80: mol_type = genomic DNA
tcgttcccaaccaaccgcacaaaacccgcaacacctcgcgtccccgcggggtctcccgcgcccctggcccggccctcccg

SEQ ID NO: 19490 - DNA, 129 bp, Homo sapiens
  misc_feature 1..129: note = chr6:153452584-153452713
  misc_feature 1..129: note = hyper
  source 1..129: mol_type = genomic DNA
ggccccgcccgacctcgcgcgctcgcctgggcgcggcgcccaccgtgcggaggggctcggccgggactctcggcttcggtgacgcccgtccggagcttcgcgggaggcccggagtcccgagagcttccc

SEQ ID NO: 19491 - skipped

SEQ ID NO: 19492 - DNA, 66 bp, Homo sapiens
  misc_feature 1..66: note = chr6:154360584-154360650
  misc_feature 1..66: note = hyper
  source 1..66: mol_type = genomic DNA
agcggcgaaaggaagcggctgaggcgcttggaacccgaaaagtctcggtgctcctggctacctcgc

SEQ ID NO: 19493 - DNA, 65 bp, Homo sapiens
  misc_feature 1..65: note = chr6:155316265-155316330
  misc_feature 1..65: note = hyper
  source 1..65: mol_type = genomic DNA
ttgaattgttttatttgtgttgttccaaagaaagcgcgagggacatggtccgggaccagccggga

SEQ ID NO: 19494 - DNA, 30 bp, Homo sapiens; identical to SEQ ID NO: 8786
  misc_feature 1..30: note = chr6:158430625-158430655
  misc_feature 1..30: note = hyper
  source 1..30: mol_type = genomic DNA

SEQ ID NO: 19495 - DNA, 53 bp, Homo sapiens; identical to SEQ ID NO: 8787
  misc_feature 1..53: note = chr6:158957871-158957924
  misc_feature 1..53: note = hyper
  source 1..53: mol_type = genomic DNA

SEQ ID NO: 19496 - DNA, 263 bp, Homo sapiens
  misc_feature 1..263: note = chr6:159590986-159591249
  misc_feature 1..263: note = hyper
  source 1..263: mol_type = genomic DNA
gtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgc

SEQ ID NO: 19497 - DNA, 10 bp, Homo sapiens
  misc_feature 1..10: note = chr6:159654913-159654923
  misc_feature 1..10: note = hyper
  source 1..10: mol_type = genomic DNA
gaccacaggt

SEQ ID NO: 19498 - DNA, 187 bp, Homo sapiens; identical to SEQ ID NO: 8792
  misc_feature 1..187: note = chr6:161351859-161352046
  misc_feature 1..187: note = hyper
  source 1..187: mol_type = genomic DNA

SEQ ID NO: 19499 - DNA, 136 bp, Homo sapiens; identical to SEQ ID NO: 8794
  misc_feature 1..136: note = chr6:166074525-166074661
  misc_feature 1..136: note = hyper
  source 1..136: mol_type = genomic DNA

SEQ ID NO: 19500 - DNA, 163 bp, Homo sapiens; identical to SEQ ID NO: 8795
  misc_feature 1..163: note = chr6:166074962-166075125
  misc_feature 1..163: note = hyper
  source 1..163: mol_type = genomic DNA

SEQ ID NO: 19501 - DNA, 30 bp, Homo sapiens; identical to SEQ ID NO: 8796
  misc_feature 1..30: note = chr6:166075459-166075489
  misc_feature 1..30: note = hyper
  source 1..30: mol_type = genomic DNA

SEQ ID NO: 19502 - DNA, 39 bp, Homo sapiens; identical to SEQ ID NO: 8798
  misc_feature 1..39: note = chr6:166077961-166078000
  misc_feature 1..39: note = hyper
  source 1..39: mol_type = genomic DNA

SEQ ID NO: 19503 - DNA, 116 bp, Homo sapiens; identical to SEQ ID NO: 8799
  misc_feature 1..116: note = chr6:166218546-166218662
  misc_feature 1..116: note = hyper
  source 1..116: mol_type = genomic DNA

SEQ ID NO: 19504 - DNA, 40 bp, Homo sapiens
  misc_feature 1..40: note = chr6:166267542-166267582
  misc_feature 1..40: note = hyper
  source 1..40: mol_type = genomic DNA
ctggacccagacagacgcgcggggtcctagggaagagccc

SEQ ID NO: 19505 - DNA, 30 bp, Homo sapiens; identical to SEQ ID NO: 8801
  misc_feature 1..30: note = chr6:166400601-166400631
  misc_feature 1..30: note = hyper
  source 1..30: mol_type = genomic DNA

SEQ ID NO: 19506 - DNA, 30 bp, Homo sapiens; identical to SEQ ID NO: 8802
  misc_feature 1..30: note = chr6:166400920-166400950
  misc_feature 1..30: note = hyper
  source 1..30: mol_type = genomic DNA

SEQ ID NO: 19507 - DNA, 105 bp, Homo sapiens
  misc_feature 1..105: note = chr6:166402546-166402651
  misc_feature 1..105: note = hyper
  source 1..105: mol_type = genomic DNA
aggggactgctgcgcggattccccatccgcacccggctcgcggggaatccgtgggcttgcactcgccagaaagagctgctgcaggagcagccggatggtgaggcc

SEQ ID NO: 19508 - skipped

SEQ ID NO: 19509 - DNA, 200 bp, Homo sapiens
  misc_feature 1..200: note = chr6:166580144-166580344
  misc_feature 1..200: note = hyper
  source 1..200: mol_type = genomic DNA
agtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctc

SEQ ID NO: 19510 - DNA, 18 bp, Homo sapiens
  misc_feature 1..18: note = chr6:166583078-166583096
  misc_feature 1..18: note = hyper
  source 1..18: mol_type = genomic DNA
ctcatttgctcctgacgc

SEQ ID NO: 19511 - DNA, 88 bp, Homo sapiens; identical to SEQ ID NO: 8811
  misc_feature 1..88: note = chr6:166583152-166583240
  misc_feature 1..88: note = hyper
  source 1..88: mol_type = genomic DNA

SEQ ID NO: 19512 - DNA, 91 bp, Homo sapiens; identical to SEQ ID NO: 8812
  misc_feature 1..91: note = chr6:166666972-166667063
  misc_feature 1..91: note = hyper
  source 1..91: mol_type = genomic DNA

SEQ ID NO: 19513 - DNA, 34 bp, Homo sapiens; identical to SEQ ID NO: 8813
  misc_feature 1..34: note = chr6:168841594-168841628
  misc_feature 1..34: note = hyper
  source 1..34: mol_type = genomic DNA

SEQ ID NO: 19514 - DNA, 80 bp, Homo sapiens; identical to SEQ ID NO: 8814
  misc_feature 1..80: note = chr6:168842084-168842164
  misc_feature 1..80: note = hyper
  source 1..80: mol_type = genomic DNA

SEQ ID NO: 19515 - DNA, 57 bp, Homo sapiens; identical to SEQ ID NO: 8815
  misc_feature 1..57: note = chr6:169653992-169654049
  misc_feature 1..57: note = hyper
  source 1..57: mol_type = genomic DNA

SEQ ID NO: 19516 - DNA, 71 bp, Homo sapiens; identical to SEQ ID NO: 8816
  misc_feature 1..71: note = chr6:170605686-170605757
  misc_feature 1..71: note = hyper
  source 1..71: mol_type = genomic DNA

SEQ ID NO: 19517 - DNA, 85 bp, Homo sapiens; identical to SEQ ID NO: 8817
  misc_feature 1..85: note = chr7:330501-330586
  misc_feature 1..85: note = hyper
  source 1..85: mol_type = genomic DNA

SEQ ID NO: 19518 - DNA, 134 bp, Homo sapiens
  misc_feature 1..134: note = chr7:751986-752120
  misc_feature 1..134: note = hyper
  source 1..134: mol_type = genomic DNA
gcatccccggggggcctcccaggcccggggctcccggcgcagaccccagcccggccccgcgtacctggatgcgcggcgcccgaggccaggaggcggctgcgcggggacgcggggcgcggggacggctggcgagc

SEQ ID NO: 19519 - DNA, 41 bp, Homo sapiens
  misc_feature 1..41: note = chr7:752221-752262
  misc_feature 1..41: note = hyper
  source 1..41: mol_type = genomic DNA
cccgtctccccccgaccgcctccccgcggggcccccaaccc

SEQ ID NO: 19520 - DNA, 25 bp, Homo sapiens
  misc_feature 1..25: note = chr7:1263736-1263761
  misc_feature 1..25: note = hyper
  source 1..25: mol_type = genomic DNA
ttgtttaccaggctccgaggaggac

SEQ ID NO: 19521 - DNA, 214 bp, Homo sapiens
  misc_feature 1..214: note = chr7:1263960-1264174
  misc_feature 1..214: note = hyper
  source 1..214: mol_type = genomic DNA
ccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagaca

SEQ ID NO: 19522 - DNA, 149 bp, Homo sapiens; identical to SEQ ID NO: 8821
  misc_feature 1..149: note = chr7:1265323-1265472
  misc_feature 1..149: note = hyper
  source 1..149: mol_type = genomic DNA

SEQ ID NO: 19523 - DNA, 68 bp, Homo sapiens
  misc_feature 1..68: note = chr7:1269237-1269305
  misc_feature 1..68: note = hyper
  source 1..68: mol_type = genomic DNA
ccagctgggcccaagcgcaggaggccggtcctcacggtgcgcccgggaagggaagggccgagcggcct

SEQ ID NO: 19524 - DNA, 113 bp, Homo sapiens; identical to SEQ ID NO: 8823
  misc_feature 1..113: note = chr7:1270162-1270275
  misc_feature 1..113: note = hyper
  source 1..113: mol_type = genomic DNA

SEQ ID NO: 19525 - DNA, 334 bp, Homo sapiens; identical to SEQ ID NO: 8824
  misc_feature 1..334: note = chr7:1272630-1272964
  misc_feature 1..334: note = hyper
  source 1..334: mol_type = genomic DNA

SEQ ID NO: 19526 - DNA, 127 bp, Homo sapiens
  misc_feature 1..127: note = chr7:1274514-1274641
  misc_feature 1..127: note = hyper
  source 1..127: mol_type = genomic DNA
aagtctctgtgtggccgcgacaaagaatccgtattaacgcgccctcctggggagggcaggactgcccgagcttccgcggggctcagacggatttgactgtgtgtgtttggtggctggcggttgagtg

SEQ ID NO: 19527 - DNA, 137 bp, Homo sapiens
  misc_feature 1..137: note = chr7:1274677-1274814
  misc_feature 1..137: note = hyper
  source 1..137: mol_type = genomic DNA
gctccccaggacaaggactgcagagaggatggaagagacgcgatgggcccagcctctccttccggcctggtggtcgcctcttgcctccccacctgccttggccggtggcccaggccaaggaccgcaggtttgggaag

SEQ ID NO: 19528 - DNA, 41 bp, Homo sapiens; identical to SEQ ID NO: 8827
  misc_feature 1..41: note = chr7:1276444-1276485
  misc_feature 1..41: note = hyper
  source 1..41: mol_type = genomic DNA

SEQ ID NO: 19529 - DNA, 124 bp, Homo sapiens; identical to SEQ ID NO: 8828
  misc_feature 1..124: note = chr7:1277174-1277298
  misc_feature 1..124: note = hyper
  source 1..124: mol_type = genomic DNA

SEQ ID NO: 19530 - DNA, 30 bp, Homo sapiens; identical to SEQ ID NO: 8829
  misc_feature 1..30: note = chr7:1280395-1280425
  misc_feature 1..30: note = hyper
  source 1..30: mol_type = genomic DNA

SEQ ID NO: 19531 - DNA, 37 bp, Homo sapiens
  misc_feature 1..37: note = chr7:1282644-1282681
  misc_feature 1..37: note = hyper
  source 1..37: mol_type = genomic DNA
cggcttctgctgattctttctgcggcctgataataag

SEQ ID NO: 19532 - DNA, 94 bp, Homo sapiens; identical to SEQ ID NO: 8833
  misc_feature 1..94: note = chr7:1283626-1283720
  misc_feature 1..94: note = hyper
  source 1..94: mol_type = genomic DNA

SEQ ID NO: 19533 - DNA, 27 bp, Homo sapiens
  misc_feature 1..27: note = chr7:1286084-1286111
  misc_feature 1..27: note = hyper
  source 1..27: mol_type = genomic DNA
agggcgggcagaggccgggctgggagg

SEQ ID NO: 19534 - DNA, 30 bp, Homo sapiens
  misc_feature 1..30: note = chr7:1288552-1288582
  misc_feature 1..30: note = hyper
  source 1..30: mol_type = genomic DNA
tctgagggagctttccgtgggatggctggg

SEQ ID NO: 19535 - DNA, 122 bp, Homo sapiens; identical to SEQ ID NO: 8836
  misc_feature 1..122: note = chr7:1289414-1289536
  misc_feature 1..122: note = hyper
  source 1..122: mol_type = genomic DNA

SEQ ID NO: 19536 - DNA, 124 bp, Homo sapiens; identical to SEQ ID NO: 2955
  misc_feature 1..124: note = chr7:1408647-1408771
  misc_feature 1..124: note = hyper
  source 1..124: mol_type = genomic DNA

SEQ ID NO: 19537 - DNA, 34 bp, Homo sapiens; identical to SEQ ID NO: 2956
  misc_feature 1..34: note = chr7:1408874-1408908
  misc_feature 1..34: note = hyper
  source 1..34: mol_type = genomic DNA

SEQ ID NO: 19538 - DNA, 603 bp, Homo sapiens; identical to SEQ ID NO: 8839
  misc_feature 1..603: note = chr7:1704139-1704742
  misc_feature 1..603: note = hyper
  source 1..603: mol_type = genomic DNA

SEQ ID NO: 19539 - DNA, 91 bp, Homo sapiens; identical to SEQ ID NO: 8840
  misc_feature 1..91: note = chr7:1706301-1706392
  misc_feature 1..91: note = hyper
  source 1..91: mol_type = genomic DNA

SEQ ID NO: 19540 - DNA, 128 bp, Homo sapiens; identical to SEQ ID NO: 8841
  misc_feature 1..128: note = chr7:1707040-1707168
  misc_feature 1..128: note = hyper
  source 1..128: mol_type = genomic DNA

SEQ ID NO: 19541 - DNA, 45 bp, Homo sapiens
  misc_feature 1..45: note = chr7:1709093-1709138
  misc_feature 1..45: note = hyper
  source 1..45: mol_type = genomic DNA
ccgagcgtggagtcccgaggctcctgccgggggtccaggctgccc

SEQ ID NO: 19542 - DNA, 209 bp, Homo sapiens
  misc_feature 1..209: note = chr7:1709235-1709444
  misc_feature 1..209: note = hyper
  source 1..209: mol_type = genomic DNA
aggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgct

SEQ ID NO: 19543 - DNA, 21 bp, Homo sapiens
  misc_feature 1..21: note = chr7:1709902-1709923
  misc_feature 1..21: note = hyper
  source 1..21: mol_type = genomic DNA
gaggaatttcaatcccgggag

SEQ ID NO: 19544 - DNA, 289 bp, Homo sapiens; identical to SEQ ID NO: 8844
  misc_feature 1..289: note = chr7:1709955-1710244
  misc_feature 1..289: note = hyper
  source 1..289: mol_type = genomic DNA

SEQ ID NO: 19545 - DNA, 19 bp, Homo sapiens
  misc_feature 1..19: note = chr7:1710324-1710343
  misc_feature 1..19: note = hyper
  source 1..19: mol_type = genomic DNA
cgtccgcaccctgcccggc

SEQ ID NO: 19546 - DNA, 36 bp, Homo sapiens; identical to SEQ ID NO: 8847
  misc_feature 1..36: note = chr7:3083169-3083205
  misc_feature 1..36: note = hyper
  source 1..36: mol_type = genomic DNA

SEQ ID NO: 19547 - DNA, 190 bp, Homo sapiens
  misc_feature 1..190: note = chr7:3340254-3340444
  misc_feature 1..190: note = hyper
  source 1..190: mol_type = genomic DNA
aaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcg

SEQ ID NO: 19548 - DNA, 142 bp, Homo sapiens
  misc_feature 1..142: note = chr7:3340473-3340615
  misc_feature 1..142: note = hyper
  source 1..142: mol_type = genomic DNA
gcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtcccca

SEQ ID NO: 19549 - DNA, 30 bp, Homo sapiens; identical to SEQ ID NO: 8849
  misc_feature 1..30: note = chr7:3341956-3341986
  misc_feature 1..30: note = hyper
  source 1..30: mol_type = genomic DNA

SEQ ID NO: 19550 - DNA, 199 bp, Homo sapiens
  misc_feature 1..199: note = chr7:4998388-4998587
  misc_feature 1..199: note = hyper
  source 1..199: mol_type = genomic DNA
cacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccg

SEQ ID NO: 19551 - DNA, 66 bp, Homo sapiens
  misc_feature 1..66: note = chr7:6566347-6566413
  misc_feature 1..66: note = hyper
  source 1..66: mol_type = genomic DNA
cctgagacaccacctcgtcgaagcgcgcccggtgcttcttggggatgaagatcctgccggcgagga

SEQ ID NO: 19552 - DNA, 244 bp, Homo sapiens; identical to SEQ ID NO: 8854
  misc_feature 1..244: note = chr7:6570454-6570698
  misc_feature 1..244: note = hyper
  source 1..244: mol_type = genomic DNA

SEQ ID NO: 19553 - DNA, 26 bp, Homo sapiens
  misc_feature 1..26: note = chr7:6570933-6570959
  misc_feature 1..26: note = hyper
  source 1..26: mol_type = genomic DNA
tgggacccttttggtcgctctggggt

SEQ ID NO: 19554 - DNA, 47 bp, Homo sapiens
  misc_feature 1..47: note = chr7:6571130-6571177
  misc_feature 1..47: note = hyper
  source 1..47: mol_type = genomic DNA
catgcaatattttccggaggggatgccctttacgctgggcctccagg

SEQ ID NO: 19555 - DNA, 297 bp, Homo sapiens; identical to SEQ ID NO: 8856
  misc_feature 1..297: note = chr7:6654798-6655095
  misc_feature 1..297: note = hyper
  source 1..297: mol_type = genomic DNA

SEQ ID NO: 19556 - DNA, 129 bp, Homo sapiens
  misc_feature 1..129: note = chr7:6703959-6704088
  misc_feature 1..129: note = hyper
  source 1..129: mol_type = genomic DNA
agggcccgctgagtcggggccgctcgtgggccgcctggctgccgcctggggcctccggccgctgcgtcccgcggcttctgggaaccgtgcgcgctcacaggcggacttgggcctcgaacaaggttcctg

SEQ ID NO: 19557 - DNA, 282 bp, Homo sapiens
  misc_feature 1..282: note = chr7:8473674-8473956
  misc_feature 1..282: note = hyper
  source 1..282: mol_type = genomic DNA
ctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcag

SEQ ID NO: 19558 - DNA, 40 bp, Homo sapiens
  misc_feature 1..40: note = chr7:8475057-8475097
  misc_feature 1..40: note = hyper
  source 1..40: mol_type = genomic DNA
ggaccgcgcgcttgctggtctcaggcgctggatttactcg

SEQ ID NO: 19559 - DNA, 54 bp, Homo sapiens; identical to SEQ ID NO: 8865
  misc_feature 1..54: note = chr7:8475348-8475402
  misc_feature 1..54: note = hyper
  source 1..54: mol_type = genomic DNA

SEQ ID NO: 19560 - DNA, 53 bp, Homo sapiens; identical to SEQ ID NO: 8866
  misc_feature 1..53: note = chr7:8476668-8476721
  misc_feature 1..53: note = hyper
  source 1..53: mol_type = genomic DNA

SEQ ID NO: 19561 - DNA, 40 bp, Homo sapiens
  misc_feature 1..40: note = chr7:8482016-8482056
  misc_feature 1..40: note = hyper
  source 1..40: mol_type = genomic DNA
cctcgccatcacccccgccgccctaatggattctgaagcg

SEQ ID NO: 19562 - DNA, 102 bp, Homo sapiens
  misc_feature 1..102: note = chr7:8482921-8483023
  misc_feature 1..102: note = hyper
  source 1..102: mol_type = genomic DNA
cccaacttctccccctacccagtctcccattctttcacagttcattaaatctacccctcccccgaaacagaaacgtgaaggctgtaacgaagagctagaagt

SEQ ID NO: 19563 - skipped

SEQ ID NO: 19564 - DNA, 197 bp, Homo sapiens; identical to SEQ ID NO: 8873
  misc_feature 1..197: note = chr7:11871392-11871589
  misc_feature 1..197: note = hyper
  source 1..197: mol_type = genomic DNA

SEQ ID NO: 19565 - DNA, 98 bp, Homo sapiens; identical to SEQ ID NO: 8874
  misc_feature 1..98: note = chr7:12151205-12151303
  misc_feature 1..98: note = hyper
  source 1..98: mol_type = genomic DNA

SEQ ID NO: 19566 - DNA, 23 bp, Homo sapiens
  misc_feature 1..23: note = chr7:12443294-12443317
  misc_feature 1..23: note = hyper
  source 1..23: mol_type = genomic DNA
ggccaggaacatcagcgcgatca

SEQ ID NO: 19567 - DNA, 30 bp, Homo sapiens; identical to SEQ ID NO: 8877
  misc_feature 1..30: note = chr7:15725085-15725115
  misc_feature 1..30: note = hyper
  source 1..30: mol_type = genomic DNA

SEQ ID NO: 19568 - DNA, 34 bp, Homo sapiens
  misc_feature 1..34: note = chr7:15725949-15725983
  misc_feature 1..34: note = hyper
  source 1..34: mol_type = genomic DNA
agaggattgggagaacgggtgcaagccttgcgcc

SEQ ID NO: 19569 - DNA, 82 bp, Homo sapiens; identical to SEQ ID NO: 8881
  misc_feature 1..82: note = chr7:18125980-18126062
  misc_feature 1..82: note = hyper
  source 1..82: mol_type = genomic DNA

SEQ ID NO: 19570 - skipped

SEQ ID NO: 19571 - DNA, 94 bp, Homo sapiens; identical to SEQ ID NO: 8883
  misc_feature 1..94: note = chr7:18126664-18126758
  misc_feature 1..94: note = hyper
  source 1..94: mol_type = genomic DNA

SEQ ID NO: 19572 - DNA, 253 bp, Homo sapiens
  misc_feature 1..253: note = chr7:19146249-19146502
  misc_feature 1..253: note = hyper
  source 1..253: mol_type = genomic DNA
gaggccggaggctgacaccaccagggacccaacggagggtttattctgcccagcttcacatctgggggtcaaatcgcattaaagccaaaccaccaacggggcagggagcaggtggttaactgcacaaaataaagttacagaaaaaacctcgttttgcaggcgagtgacttagtttccctctgtagctttgccgtcataaaaagcaagtccctcccctctcctgagctggaaggcggggaaaggttatcagcgg

SEQ ID NO: 19573 - DNA, 24 bp, Homo sapiens
  misc_feature 1..24: note = chr7:19146558-19146582
  misc_feature 1..24: note = hyper
  source 1..24: mol_type = genomic DNA
ttaggcgcgcgggctcccatcctc

SEQ ID NO: 19574 - DNA, 180 bp, Homo sapiens
  misc_feature 1..180: note = chr7:19146942-19147122
  misc_feature 1..180: note = hyper
  source 1..180: mol_type = genomic DNA
cttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctcctta

SEQ ID NO: 19575 - DNA, 76 bp, Homo sapiens
  misc_feature 1..76: note = chr7:19147798-19147874
  misc_feature 1..76: note = hyper
  source 1..76: mol_type = genomic DNA
tgctcccccccttcccaaatgctgttgctttttctctggcggtccccaccccctgcttcttcgttctccttcccta

SEQ ID NO: 19576 - DNA, 89 bp, Homo sapiens
  misc_feature 1..89: note = chr7:19157055-19157144
  misc_feature 1..89: note = hyper
  source 1..89: mol_type = genomic DNA
cggaggagagagcaggaggacggacgggagggacctccgcggggagggcgcgcgggggaggcggggagggaggcgggagggggagggga

SEQ ID NO: 19577 - DNA, 30 bp, Homo sapiens; identical to SEQ ID NO: 8895
  misc_feature 1..30: note = chr7:19183647-19183677
  misc_feature 1..30: note = hyper
  source 1..30: mol_type = genomic DNA

SEQ ID NO: 19578 - DNA, 161 bp, Homo sapiens
  misc_feature 1..161: note = chr7:19184255-19184416
  misc_feature 1..161: note = hyper
  source 1..161: mol_type = genomic DNA
ccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctc

SEQ ID NO: 19579 - DNA, 32 bp, Homo sapiens; identical to SEQ ID NO: 8897
  misc_feature 1..32: note = chr7:19184803-19184835
  misc_feature 1..32: note = hyper
  source 1..32: mol_type = genomic DNA

SEQ ID NO: 19580 - DNA, 30 bp, Homo sapiens; identical to SEQ ID NO: 8899
  misc_feature 1..30: note = chr7:20817170-20817200
  misc_feature 1..30: note = hyper
  source 1..30: mol_type = genomic DNA

SEQ ID NO: 19581 - DNA, 121 bp, Homo sapiens; identical to SEQ ID NO: 8900
  misc_feature 1..121: note = chr7:20817836-20817957
  misc_feature 1..121: note = hyper
  source 1..121: mol_type = genomic DNA

SEQ ID NO: 19582 - DNA, 148 bp, Homo sapiens
  misc_feature 1..148: note = chr7:20817982-20818130
  misc_feature 1..148: note = hyper
  source 1..148: mol_type = genomic DNA
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaatt

SEQ ID NO: 19583 - DNA, 31 bp, Homo sapiens
  misc_feature 1..31: note = chr7:20823261-20823292
  misc_feature 1..31: note = hyper
  source 1..31: mol_type = genomic DNA
acaaactctgggtctcgggctgccaaaagtc

SEQ ID NO: 19584 - DNA, 447 bp, Homo sapiens
  misc_feature 1..447: note = chr7:20823432-20823879
  misc_feature 1..447: note = hyper
  source 1..447: mol_type = genomic DNA
gcctccagcctctccctctccaccgctccgctcaggcttgtcagccgagccgctcctgcccgcgcgaggcccgctgtctaccaggcactggattagtccagctctacctccagtggccgttccctctaaaagttacgcccttcacaacctggggggtggaggaggggaggacaaggaagagagaacgagaaataaaggcccgacgaggcgcgggttccggctgcaacgggttcaggcagcgttacccgtggaaagggaaagccagggcccgggacagcgatgcgtgttacttacttgtccatatcccctttacaaagttaagtcacagaaggaagaaggaagaggggcagaaacagaaagagacagagagcgagtcggatgcaatagggaaaggctggagttgaagtccggacagacagggcccaagaggacttggtgggaggaggt

SEQ ID NO: 19585 - DNA, 49 bp, Homo sapiens; identical to SEQ ID NO: 8906
  misc_feature 1..49: note = chr7:20826611-20826660
  misc_feature 1..49: note = hyper
  source 1..49: mol_type = genomic DNA

SEQ ID NO: 19586 - DNA, 41 bp, Homo sapiens; identical to SEQ ID NO: 8907
  misc_feature 1..41: note = chr7:20827412-20827453
  misc_feature 1..41: note = hyper
  source 1..41: mol_type = genomic DNA

SEQ ID NO: 19587 - DNA, 130 bp, Homo sapiens
  misc_feature 1..130: note = chr7:20830700-20830830
  misc_feature 1..130: note = hyper
  source 1..130: mol_type = genomic DNA
gcgtccctggcctgcgcctctcccagaatgggaagacgacccccaaccccttgactagtgtgcggggtcctcgcacgcggacgtgttggctactaaataaagcgtgaagagggatcgctgggtagctgag

SEQ ID NO: 19588 - DNA, 30 bp, Homo sapiens; identical to SEQ ID NO: 8909
  misc_feature 1..30: note = chr7:20833089-20833119
  misc_feature 1..30: note = hyper
  source 1..30: mol_type = genomic DNA

SEQ ID NO: 19589 - DNA, 30 bp, Homo sapiens; identical to SEQ ID NO: 8910
  misc_feature 1..30: note = chr7:20836099-20836129
  misc_feature 1..30: note = hyper
  source 1..30: mol_type = genomic DNA

SEQ ID NO: 19590 - DNA, 30 bp, Homo sapiens; identical to SEQ ID NO: 8911
  misc_feature 1..30: note = chr7:20836810-20836840
  misc_feature 1..30: note = hyper
  source 1..30: mol_type = genomic DNA

SEQ ID NO: 19591 - DNA, 50 bp, Homo sapiens; identical to SEQ ID NO: 8912
  misc_feature 1..50: note = chr7:20838460-20838510
  misc_feature 1..50: note = hyper
  source 1..50: mol_type = genomic DNA

SEQ ID NO: 19592 - DNA, 40 bp, Homo sapiens
  misc_feature 1..40: note = chr7:21582868-21582908
  misc_feature 1..40: note = hyper
  source 1..40: mol_type = genomic DNA
agcccaggtggcagcccgggaggcgcgagacttcagagaa

SEQ ID NO: 19593 - DNA, 31 bp, Homo sapiens
  misc_feature 1..31: note = chr7:22589325-22589356
  misc_feature 1..31: note = hyper
  source 1..31: mol_type = genomic DNA
tttcccaggtggtgccgtggtggccgtgggg

SEQ ID NO: 19594 - DNA, 476 bp, Homo sapiens; identical to SEQ ID NO: 8918
  misc_feature 1..476: note = chr7:23508261-23508737
  misc_feature 1..476: note = hyper
  source 1..476: mol_type = genomic DNA

SEQ ID NO: 19595 - DNA, 220 bp, Homo sapiens; identical to SEQ ID NO: 8919
  misc_feature 1..220: note = chr7:23509018-23509238
  misc_feature 1..220: note = hyper
  source 1..220: mol_type = genomic DNA

SEQ ID NO: 19596 - DNA, 30 bp, Homo sapiens; identical to SEQ ID NO: 8920
  misc_feature 1..30: note = chr7:23509641-23509671
  misc_feature 1..30: note = hyper
  source 1..30: mol_type = genomic DNA

SEQ ID NO: 19597 - DNA, 406 bp, Homo sapiens; identical to SEQ ID NO: 8921
  misc_feature 1..406: note = chr7:23513721-23514127
  misc_feature 1..406: note = hyper
  source 1..406: mol_type = genomic DNA

SEQ ID NO: 19598 - DNA, 36 bp, Homo sapiens; identical to SEQ ID NO: 8922
  misc_feature 1..36: note = chr7:23514666-23514702
  misc_feature 1..36: note = hyper
  source 1..36: mol_type = genomic DNA

SEQ ID NO: 19599 - DNA, 23 bp, Homo sapiens
  misc_feature 1..23: note = chr7:24796567-24796590
  misc_feature 1..23: note = hyper
  source 1..23: mol_type = genomic DNA
tgcacacacgcccccgagccggg

SEQ ID NO: 19600 - DNA, 301 bp, Homo sapiens; identical to SEQ ID NO: 8924
  misc_feature 1..301: note = chr7:24797253-24797554
  misc_feature 1..301: note = hyper
  source 1..301: mol_type = genomic DNA

SEQ ID NO: 19601 - DNA, 80 bp, Homo sapiens
  misc_feature 1..80: note = chr7:25896441-25896521
  misc_feature 1..80: note = hyper
  source 1..80: mol_type = genomic DNA
cagtgtgggtgagagcgcagtctgtgaccaccagcgcttctgactcagcggaaaacgccggcaaacaggactacacctca

SEQ ID NO: 19602 - DNA, 74 bp, Homo sapiens
  misc_feature 1..74: note = chr7:25896864-25896938
  misc_feature 1..74: note = hyper
  source 1..74: mol_type = genomic DNA
gctagagaggagtaaatccttctgtcgtccccgttctgccgcccccgcgatgatttatgcgtcctttttattat

SEQ ID NO: 19603 - DNA, 30 bp, Homo sapiens; identical to SEQ ID NO: 8927
  misc_feature 1..30: note = chr7:25902574-25902604
  misc_feature 1..30: note = hyper
  source 1..30: mol_type = genomic DNA

SEQ ID NO: 19604 - DNA, 281 bp, Homo sapiens; identical to SEQ ID NO: 8928
  misc_feature 1..281: note = chr7:26415803-26416084
  misc_feature 1..281: note = hyper
  source 1..281: mol_type = genomic DNA

SEQ ID NO: 19605 - DNA, 61 bp, Homo sapiens
  misc_feature 1..61: note = chr7:27135266-27135327
  misc_feature 1..61: note = hyper
  source 1..61: mol_type = genomic DNA
acacccccaggttcccggaagtctggtaggtagccggctgggggtggcgatggtggtggtg

SEQ ID NO: 19606 - DNA, 34 bp, Homo sapiens
  misc_feature 1..34: note = chr7:27135979-27136013
  misc_feature 1..34: note = hyper
  source 1..34: mol_type = genomic DNA
cgttcaatgaaagatgaactggcgagaggtgaga

SEQ ID NO: 19607 - DNA, 219 bp, Homo sapiens
  misc_feature 1..219: note = chr7:27190372-27190591
  misc_feature 1..219: note = hyper
  source 1..219: mol_type = genomic DNA
gggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggcc

SEQ ID NO: 19608 - DNA, 71 bp, Homo sapiens
  misc_feature 1..71: note = chr7:27204416-27204487
  misc_feature 1..71: note = hyper
  source 1..71: mol_type = genomic DNA
tcgagagaaacctggcgggccagcagatccgggaggccggcgtggaggcggcggcggatttgaagggagga

SEQ ID NO: 19609 - DNA, 80 bp, Homo sapiens; identical to SEQ ID NO: 8941
  misc_feature 1..80: note = chr7:27209584-27209664
  misc_feature 1..80: note = hyper
  source 1..80: mol_type = genomic DNA

SEQ ID NO: 19610 - DNA, 85 bp, Homo sapiens
  misc_feature 1..85: note = chr7:27212899-27212984
  misc_feature 1..85: note = hyper
  source 1..85: mol_type = genomic DNA
ctgatccttctcctccttgtgtctgcctgtctgcccgcctgactgcagccctctgcagccctgcttacccagggaatccttctcc

SEQ ID NO: 19611 - DNA, 448 bp, Homo sapiens; identical to SEQ ID NO: 8945
  misc_feature 1..448: note = chr7:27219396-27219844
  misc_feature 1..448: note = hyper
  source 1..448: mol_type = genomic DNA

SEQ ID NO: 19612 - DNA, 27 bp, Homo sapiens
  misc_feature 1..27: note = chr7:27223166-27223193
  misc_feature 1..27: note = hyper
  source 1..27: mol_type = genomic DNA
cagcttctgcctccccggccagccttc

SEQ ID NO: 19613 - DNA, 59 bp, Homo sapiens; identical to SEQ ID NO: 8947
  misc_feature 1..59: note = chr7:27223221-27223280
  misc_feature 1..59: note = hyper
  source 1..59: mol_type = genomic DNA

SEQ ID NO: 19614 - DNA, 64 bp, Homo sapiens
  misc_feature 1..64: note = chr7:27223696-27223760
  misc_feature 1..64: note = hyper
  source 1..64: mol_type = genomic DNA
tcaaaagctcccgaagcccttgcagggggaatttacaggcgcccacctccggctccccagcctg

SEQ ID NO: 19615 - DNA, 93 bp, Homo sapiens
  misc_feature 1..93: note = chr7:27223976-27224069
  misc_feature 1..93: note = hyper
  source 1..93: mol_type = genomic DNA
ataaaaatttaacagcggtgctgcgctagatttccaactcccctttcataaagcgcagggcgctgcctttatacgtactggagccgccggcct

SEQ ID NO: 19616 - DNA, 18 bp, Homo sapiens
  misc_feature 1..18: note = chr7:27232962-27232980
  misc_feature 1..18: note = hyper
  source 1..18: mol_type = genomic DNA
ctccgagttcacacccca

SEQ ID NO: 19617 - DNA, 32 bp, Homo sapiens; identical to SEQ ID NO: 8952
  misc_feature 1..32: note = chr7:27239141-27239173
  misc_feature 1..32: note = hyper
  source 1..32: mol_type = genomic DNA

SEQ ID NO: 19618 - DNA, 214 bp, Homo sapiens
  misc_feature 1..214: note = chr7:27239234-27239448
  misc_feature 1..214: note = hyper
  source 1..214: mol_type = genomic DNA
gctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggcc

SEQ ID NO: 19619 - DNA, 162 bp, Homo sapiens; identical to SEQ ID NO: 8954
  misc_feature 1..162: note = chr7:27239668-27239830
  misc_feature 1..162: note = hyper
  source 1..162: mol_type = genomic DNA

SEQ ID NO: 19620 - DNA, 30 bp, Homo sapiens; identical to SEQ ID NO: 8956
  misc_feature 1..30: note = chr7:27240997-27241027
  misc_feature 1..30: note = hyper
  source 1..30: mol_type = genomic DNA

SEQ ID NO: 19621 - DNA, 24 bp, Homo sapiens
  misc_feature 1..24: note = chr7:27252795-27252819
  misc_feature 1..24: note = hyper
  source 1..24: mol_type = genomic DNA
tttttctttctctcccggattgtt

SEQ ID NO: 19622 - DNA, 270 bp, Homo sapiens; identical to SEQ ID NO: 8960
  misc_feature 1..270: note = chr7:27252895-27253165
  misc_feature 1..270: note = hyper
  source 1..270: mol_type = genomic DNA

SEQ ID NO: 19623 - DNA, 18 bp, Homo sapiens
  misc_feature 1..18: note = chr7:27279453-27279471
  misc_feature 1..18: note = hyper
  source 1..18: mol_type = genomic DNA
cgccgggcctggagcggc

SEQ ID NO: 19624 - DNA, 282 bp, Homo sapiens
  misc_feature 1..282: note = chr7:27283013-27283295
  misc_feature 1..282: note = hyper
  source 1..282: mol_type = genomic DNA
aaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 19625 - DNA, 30 bp, Homo sapiens; identical to SEQ ID NO: 8968
  misc_feature 1..30: note = chr7:27289482-27289512
  misc_feature 1..30: note = hyper
  source 1..30: mol_type = genomic DNA

SEQ ID NO: 19626 - DNA, 44 bp, Homo sapiens; identical to SEQ ID NO: 8969
  misc_feature 1..44: note = chr7:27289813-27289857
  misc_feature 1..44: note = hyper
  source 1..44: mol_type = genomic DNA

SEQ ID NO: 19627 - DNA, 173 bp, Homo sapiens; identical to SEQ ID NO: 667
  misc_feature 1..173: note = chr7:27290946-27291119
  misc_feature 1..173: note = hyper
  source 1..173: mol_type = genomic DNA

SEQ ID NO: 19628 - DNA, 23 bp, Homo sapiens
  misc_feature 1..23: note = chr7:28449253-28449276
  misc_feature 1..23: note = hyper
  source 1..23: mol_type = genomic DNA
ttgtaaacattttggcggaccag

SEQ ID NO: 19629 - DNA, 26 bp, Homo sapiens
  misc_feature 1..26: note = chr7:28450015-28450041
  misc_feature 1..26: note = hyper
  source 1..26: mol_type = genomic DNA
cggcagattctcggcagaatcacttg

SEQ ID NO: 19630 - DNA, 217 bp, Homo sapiens
  misc_feature 1..217: note = chr7:28996623-28996840
  misc_feature 1..217: note = hyper
  source 1..217: mol_type = genomic DNA
cggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagcc

SEQ ID NO: 19631 - skipped

SEQ ID NO: 19632 - DNA, 21 bp, Homo sapiens
  misc_feature 1..21: note = chr7:28997625-28997646
  misc_feature 1..21: note = hyper
  source 1..21: mol_type = genomic DNA
ccacgagcaggaggcgcaagg

SEQ ID NO: 19633 - DNA, 377 bp, Homo sapiens
  misc_feature 1..377: note = chr7:28997676-28998053
  misc_feature 1..377: note = hyper
  source 1..377: mol_type = genomic DNA
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggag

SEQ ID NO: 19634 - DNA, 36 bp, Homo sapiens
  misc_feature 1..36: note = chr7:28998119-28998155
  misc_feature 1..36: note = hyper
  source 1..36: mol_type = genomic DNA
gcaccttctcgctcgcggtcccggacggggagggcg

SEQ ID NO: 19635 - DNA, 332 bp, Homo sapiens; identical to SEQ ID NO: 3015
  misc_feature 1..332: note = chr7:29185865-29186197
  misc_feature 1..332: note = hyper
  source 1..332: mol_type = genomic DNA

SEQ ID NO: 19636 - DNA, 43 bp, Homo sapiens; identical to SEQ ID NO: 8981
  misc_feature 1..43: note = chr7:29604285-29604328
  misc_feature 1..43: note = hyper
  source 1..43: mol_type = genomic DNA

SEQ ID NO: 19637 - DNA, 95 bp, Homo sapiens; identical to SEQ ID NO: 8982
  misc_feature 1..95: note = chr7:29846202-29846297
  misc_feature 1..95: note = hyper
  source 1..95: mol_type = genomic DNA

SEQ ID NO: 19638 - DNA, 78 bp, Homo sapiens
  misc_feature 1..78: note = chr7:30721202-30721280
  misc_feature 1..78: note = hyper
  source 1..78: mol_type = genomic DNA
gggaacttcaggcaacgggaacctacaatgagggaaggaggtttacactccaagaggaggaagtatttccttctcccc

SEQ ID NO: 19639 - DNA, 88 bp, Homo sapiens; identical to SEQ ID NO: 8984
  misc_feature 1..88: note = chr7:30722026-30722114
  misc_feature 1..88: note = hyper
  source 1..88: mol_type = genomic DNA

SEQ ID NO: 19640 - DNA, 175 bp, Homo sapiens
  misc_feature 1..175: note = chr7:30722115-30722290
  misc_feature 1..175: note = hyper
  source 1..175: mol_type = genomic DNA
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagc

SEQ ID NO: 19641 - DNA, 39 bp, Homo sapiens; identical to SEQ ID NO: 8986
  misc_feature 1..39: note = chr7:31092310-31092349
  misc_feature 1..39: note = hyper
  source 1..39: mol_type = genomic DNA

SEQ ID NO: 19642 - DNA, 15 bp, Homo sapiens
  misc_feature 1..15: note = chr7:31092684-31092699
  misc_feature 1..15: note = hyper
  source 1..15: mol_type = genomic DNA
ctacccttaggtgga

SEQ ID NO: 19643 - DNA, 167 bp, Homo sapiens; identical to SEQ ID NO: 8988
  misc_feature 1..167: note = chr7:31092713-31092880
  misc_feature 1..167: note = hyper
  source 1..167: mol_type = genomic DNA

SEQ ID NO: 19644 - DNA, 109 bp, Homo sapiens
  misc_feature 1..109: note = chr7:31092894-31093003
  misc_feature 1..109: note = hyper
  source 1..109: mol_type = genomic DNA
cggaggggctggggttggggatgccagggcttcagtggtccccagaagaaacgccctgcggggtctgtggggaaacgcaccggccttcccaggttgaagtgggcccgct

SEQ ID NO: 19645 - DNA, 57 bp, Homo sapiens
  misc_feature 1..57: note = chr7:31093133-31093190
  misc_feature 1..57: note = hyper
  source 1..57: mol_type = genomic DNA
gaccctcaggagggaacccagccggaagccgattgcatttcacgtggagctgaggag

SEQ ID NO: 19646 - DNA, 39 bp, Homo sapiens; identical to SEQ ID NO: 8990
  misc_feature 1..39: note = chr7:32110353-32110392
  misc_feature 1..39: note = hyper
  source 1..39: mol_type = genomic DNA

SEQ ID NO: 19647 - DNA, 23 bp, Homo sapiens
  misc_feature 1..23: note = chr7:32110772-32110795
  misc_feature 1..23: note = hyper
  source 1..23: mol_type = genomic DNA
gccaccaccgacctgcggagctg

SEQ ID NO: 19648 - DNA, 178 bp, Homo sapiens
  misc_feature 1..178: note = chr7:32338410-32338588
  misc_feature 1..178: note = hyper
  source 1..178: mol_type = genomic DNA
cggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctc

SEQ ID NO: 19649 - DNA, 85 bp, Homo sapiens
  misc_feature 1..85: note = chr7:32338930-32339015
  misc_feature 1..85: note = hyper
  source 1..85: mol_type = genomic DNA
acaaggaagtcgggaaaatcgccacgcccacttccttctagccactgcccccagcactggcctggagccccgatagtgtttcttc

SEQ ID NO: 19650 - DNA, 42 bp, Homo sapiens
  misc_feature 1..42: note = chr7:32467419-32467461
  misc_feature 1..42: note = hyper
  source 1..42: mol_type = genomic DNA
gtaaggaaactcacccgctgcgctgcggcttcgtggccagca

SEQ ID NO: 19651 - DNA, 30 bp, Homo sapiens; identical to SEQ ID NO: 8997
  misc_feature 1..30: note = chr7:32468472-32468502
  misc_feature 1..30: note = hyper
  source 1..30: mol_type = genomic DNA

SEQ ID NO: 19652 - DNA, 199 bp, Homo sapiens
  misc_feature 1..199: note = chr7:33943759-33943958
  misc_feature 1..199: note = hyper
  source 1..199: mol_type = genomic DNA
cttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcg

SEQ ID NO: 19653 - DNA, 123 bp, Homo sapiens; identical to SEQ ID NO: 8999
  misc_feature 1..123: note = chr7:33944250-33944373
  misc_feature 1..123: note = hyper
  source 1..123: mol_type = genomic DNA

SEQ ID NO: 19654 - DNA, 81 bp, Homo sapiens; identical to SEQ ID NO: 9000
  misc_feature 1..81: note = chr7:33944751-33944832
  misc_feature 1..81: note = hyper
  source 1..81: mol_type = genomic DNA

SEQ ID NO: 19655 - DNA, 66 bp, Homo sapiens; identical to SEQ ID NO: 9001
  misc_feature 1..66: note = chr7:33945406-33945472
  misc_feature 1..66: note = hyper
  source 1..66: mol_type = genomic DNA

SEQ ID NO: 19656 - DNA, 529 bp, Homo sapiens
  misc_feature 1..529: note = chr7:35225280-35225809
  misc_feature 1..529: note = hyper
  source 1..529: mol_type = genomic DNA
aagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtg

SEQ ID NO: 19657 - DNA, 149 bp, Homo sapiens
  misc_feature 1..149: note = chr7:35226044-35226193
  misc_feature 1..149: note = hyper
  source 1..149: mol_type = genomic DNA
cgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttg

SEQ ID NO: 19658 - DNA, 185 bp, Homo sapiens
  misc_feature 1..185: note = chr7:35293293-35293478
  misc_feature 1..185: note = hyper
  source 1..185: mol_type = genomic DNA
agggagacaaagacccgaaacacagctcaaagtttccgagagcagtcacagcggggccagggactccagaagtgtcagctccaacgactccagagctgcacactggcctctattccccaccgcaaagccccagagccgcagagacttcgaaggcagccggagaggagagggcccaccgagcacta

SEQ ID NO: 19659 - DNA, 39 bp, Homo sapiens
  misc_feature 1..39: note = chr7:35294536-35294575
  misc_feature 1..39: note = hyper
  source 1..39: mol_type = genomic DNA
cagacccctctggttttacaaaggcggctgtgacgagga

SEQ ID NO: 19660 - DNA, 51 bp, Homo sapiens
  misc_feature 1..51: note = chr7:37487113-37487164
  misc_feature 1..51: note = hyper
  source 1..51: mol_type = genomic DNA
ggtcaaggcaggtcccgacccgcctccaacttcaaatggccccctaggcgg

SEQ ID NO: 19661 - DNA, 116 bp, Homo sapiens
  misc_feature 1..116: note = chr7:37488141-37488257
  misc_feature 1..116: note = hyper
  source 1..116: mol_type = genomic DNA
aaacaaaagtgtctccgcggcgcccggagtcccccggagcaggacgcctcctcccggccccagtcccggccccctcccctgccgcgccgaggtcagcgagtcggggcgcggcgcca

SEQ ID NO: 19662 - DNA, 342 bp, Homo sapiens
  misc_feature 1..342: note = chr7:37488578-37488920
  misc_feature 1..342: note = hyper
  source 1..342: mol_type = genomic DNA
aactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatcctttt

SEQ ID NO: 19663 - DNA, 27 bp, Homo sapiens
  misc_feature 1..27: note = chr7:37488992-37489019
  misc_feature 1..27: note = hyper
  source 1..27: mol_type = genomic DNA
tgtttgttttgacgctgtgcctctacc

SEQ ID NO: 19664 - DNA, 133 bp, Homo sapiens
  misc_feature 1..133: note = chr7:37955745-37955878
  misc_feature 1..133: note = hyper
  source 1..133: mol_type = genomic DNA
catagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactc

SEQ ID NO: 19665 - DNA, 54 bp, Homo sapiens
  misc_feature 1..54: note = chr7:37956439-37956493
  misc_feature 1..54: note = hyper
  source 1..54: mol_type = genomic DNA
cctatttatcccgacacctcccctgacgtgggctcggaacgctcccttggcagc

SEQ ID NO: 19666 - DNA, 72 bp, Homo sapiens; identical to SEQ ID NO: 9018
  misc_feature 1..72: note = chr7:37960465-37960537
  misc_feature 1..72: note = hyper
  source 1..72: mol_type = genomic DNA

SEQ ID NO: 19667 - DNA, 396 bp, Homo sapiens; identical to SEQ ID NO: 9019
  misc_feature 1..396: note = chr7:37960562-37960958
  misc_feature 1..396: note = hyper
  source 1..396: mol_type = genomic DNA

SEQ ID NO: 19668 - DNA, 44 bp, Homo sapiens; identical to SEQ ID NO: 9021
  misc_feature 1..44: note = chr7:38671120-38671164
  misc_feature 1..44: note = hyper
  source 1..44: mol_type = genomic DNA

SEQ ID NO: 19669 - DNA, 64 bp, Homo sapiens; identical to SEQ ID NO: 9023
  misc_feature 1..64: note = chr7:39453541-39453605
  misc_feature 1..64: note = hyper
  source 1..64: mol_type = genomic DNA

SEQ ID NO: 19670 - DNA, 30 bp, Homo sapiens; identical to SEQ ID NO: 9024
  misc_feature 1..30: note = chr7:39454074-39454104
  misc_feature 1..30: note = hyper
  source 1..30: mol_type = genomic DNA

SEQ ID NO: 19671 - DNA, 35 bp, Homo sapiens
  misc_feature 1..35: note = chr7:42267677-42267712
  misc_feature 1..35: note = hyper
  source 1..35: mol_type = genomic DNA
cggcggcggcgcggtgggttcattagcgggcgcgc

SEQ ID NO: 19672 - DNA, 42 bp, Homo sapiens; identical to SEQ ID NO: 9026
  misc_feature 1..42: note = chr7:42275797-42275839
  misc_feature 1..42: note = hyper
  source 1..42: mol_type = genomic DNA

SEQ ID NO: 19673 - DNA, 50 bp, Homo sapiens; identical to SEQ ID NO: 9027
  misc_feature 1..50: note = chr7:42276128-42276178
  misc_feature 1..50: note = hyper
  source 1..50: mol_type = genomic DNA

SEQ ID NO: 19674 - DNA, 261 bp, Homo sapiens
  misc_feature 1..261: note = chr7:42276634-42276895
  misc_feature 1..261: note = hyper
  source 1..261: mol_type = genomic DNA
cggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcc

SEQ ID NO: 19675 - DNA, 47 bp, Homo sapiens; identical to SEQ ID NO: 9029
  misc_feature 1..47: note = chr7:42277420-42277467
  misc_feature 1..47: note = hyper
  source 1..47: mol_type = genomic DNA

SEQ ID NO: 19676 - DNA, 73 bp, Homo sapiens; identical to SEQ ID NO: 9030
  misc_feature 1..73: note = chr7:42277748-42277821
  misc_feature 1..73: note = hyper
  source 1..73: mol_type = genomic DNA

SEQ ID NO: 19677 - DNA, 215 bp, Homo sapiens
  misc_feature 1..215: note = chr7:43152700-43152915
  misc_feature 1..215: note = hyper
  source 1..215: mol_type = genomic DNA
agcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcc

SEQ ID NO: 19678 - DNA, 244 bp, Homo sapiens
  misc_feature 1..244: note = chr7:43153237-43153481
  misc_feature 1..244: note = hyper
  source 1..244: mol_type = genomic DNA
agacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtctt

SEQ ID NO: 19679 - DNA, 41 bp, Homo sapiens; identical to SEQ ID NO: 9034
  misc_feature 1..41: note = chr7:44144029-44144070
  misc_feature 1..41: note = hyper
  source 1..41: mol_type = genomic DNA

SEQ ID NO: 19680 - DNA, 102 bp, Homo sapiens
  misc_feature 1..102: note = chr7:44364736-44364838
  misc_feature 1..102: note = hyper
  source 1..102: mol_type = genomic DNA
agagctgggcagggccgcgcgcgctgaggtcaggcagccaggcccggggccgggggctcgcgggtcggggccgcgcggggccgtgcgcttgggcccggagcc

SEQ ID NO: 19681 - DNA, 179 bp, Homo sapiens
  misc_feature 1..179: note = chr7:44364903-44365082
  misc_feature 1..179: note = hyper
  source 1..179: mol_type = genomic DNA
gtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcc

SEQ ID NO: 19682 - DNA, 66 bp, Homo sapiens; identical to SEQ ID NO: 9036
  misc_feature 1..66: note = chr7:44365117-44365183
  misc_feature 1..66: note = hyper
  source 1..66: mol_type = genomic DNA

SEQ ID NO: 19683 - DNA, 250 bp, Homo sapiens
  misc_feature 1..250: note = chr7:45613535-45613785
  misc_feature 1..250: note = hyper
  source 1..250: mol_type = genomic DNA
ccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaagga

SEQ ID NO: 19684 - DNA, 443 bp, Homo sapiens
  misc_feature 1..443: note = chr7:45613898-45614341
  misc_feature 1..443: note = hyper
  source 1..443: mol_type = genomic DNA
ggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccg

SEQ ID NO: 19685 - DNA, 263 bp, Homo sapiens
  misc_feature 1..263: note = chr7:45614474-45614737
  misc_feature 1..263: note = hyper
  source 1..263: mol_type = genomic DNA
ccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtca

SEQ ID NO: 19686 - DNA, 87 bp, Homo sapiens; identical to SEQ ID NO: 9039
  misc_feature 1..87: note = chr7:45928490-45928577
  misc_feature 1..87: note = hyper
  source 1..87: mol_type = genomic DNA

SEQ ID NO: 19687 - DNA, 322 bp, Homo sapiens
  misc_feature 1..322: note = chr7:45960794-45961116
  misc_feature 1..322: note = hyper
  source 1..322: mol_type = genomic DNA
acagtacacggcgcgaagctgtggaatccaggcaggaagcggctgatcctcagcgcccagccgcagtgctcgcatctgggcggcccgggcgcgccggccgctatatagaagccggggtggcccaggacacgccccggaacggcgcgcccaggagtgggggttgggaggggggcgggtcggcgcaggcacggctgcgggggcccgtgcttcgccctgagcagccggggccgagctcgggggcgtgcagctcgagactcgcccgggcacctgctcctcgtgcgcacgcccggagcccgggtcaccttgtcgtctacaagaacca

SEQ ID NO: 19688 - DNA, 55 bp, Homo sapiens
  misc_feature 1..55: note = chr7:45961778-45961833
  misc_feature 1..55: note = hyper
  source 1..55: mol_type = genomic DNA
gtattactgtattctcgatgcgttgggattctagcttatctctgcaatctaaaca

SEQ ID NO: 19689 - DNA, 69 bp, Homo sapiens
  misc_feature 1..69: note = chr7:45961888-45961957
  misc_feature 1..69: note = hyper
  source 1..69: mol_type = genomic DNA
cggccttctctggcactcgagtttcttcagttttgtctgcgcaccccctcccttcggtgaccaacagag

SEQ ID NO: 19690 - DNA, 713 bp, Homo sapiens; identical to SEQ ID NO: 9043
  misc_feature 1..713: note = chr7:48074975-48075688
  misc_feature 1..713: note = hyper
  source 1..713: mol_type = genomic DNA

SEQ ID NO: 19691 - DNA, 12 bp, Homo sapiens
  misc_feature 1..12: note = chr7:49813994-49814006
  misc_feature 1..12: note = hyper
  source 1..12: mol_type = genomic DNA
agagaggctgga

SEQ ID NO: 19692 - DNA, 29 bp, Homo sapiens
  misc_feature 1..29: note = chr7:50343234-50343263
  misc_feature 1..29: note = hyper
  source 1..29: mol_type = genomic DNA
gccggagcctgaacccgggagccaagggg

SEQ ID NO: 19693 - DNA, 89 bp, Homo sapiens
  misc_feature 1..89: note = chr7:50343401-50343490
  misc_feature 1..89: note = hyper
  source 1..89: mol_type = genomic DNA
ggtgcagggtggcgggcccggcggcgcgcgtccccctccccctcctggcggcccgcacgtgtcgcccgcgccgcgcccccacgggttac

SEQ ID NO: 19694 - DNA, 232 bp, Homo sapiens
  misc_feature 1..232: note = chr7:50343994-50344226
  misc_feature 1..232: note = hyper
  source 1..232: mol_type = genomic DNA
agggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggag

SEQ ID NO: 19695 - DNA, 247 bp, Homo sapiens
  misc_feature 1..247: note = chr7:50344491-50344738
  misc_feature 1..247: note = hyper
  source 1..247: mol_type = genomic DNA
gccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacactt

SEQ ID NO: 19696 - DNA, 71 bp, Homo sapiens; identical to SEQ ID NO: 9054
  misc_feature 1..71: note = chr7:54614037-54614108
  misc_feature 1..71: note = hyper
  source 1..71: mol_type = genomic DNA

SEQ ID NO: 19697 - DNA, 72 bp, Homo sapiens; identical to SEQ ID NO: 9055
  misc_feature 1..72: note = chr7:54732296-54732368
  misc_feature 1..72: note = hyper
  source 1..72: mol_type = genomic DNA

SEQ ID NO: 19698 - DNA, 34 bp, Homo sapiens
  misc_feature 1..34: note = chr7:64349056-64349090
  misc_feature 1..34: note = hyper
  source 1..34: mol_type = genomic DNA
gtcttcggggtgagaggtccggctcctggaggac

SEQ ID NO: 19699 - DNA, 37 bp, Homo sapiens; identical to SEQ ID NO: 9057
  misc_feature 1..37: note = chr7:64407804-64407841
  misc_feature 1..37: note = hyper
  source 1..37: mol_type = genomic DNA

SEQ ID NO: 19700 - DNA, 282 bp, Homo sapiens; identical to SEQ ID NO: 9058
  misc_feature 1..282: note = chr7:64700367-64700649
  misc_feature 1..282: note = hyper
  source 1..282: mol_type = genomic DNA

SEQ ID NO: 19701 - DNA, 174 bp, Homo sapiens
  misc_feature 1..174: note = chr7:64712510-64712684
  misc_feature 1..174: note = hyper
  source 1..174: mol_type = genomic DNA
cgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgt

SEQ ID NO: 19702 - DNA, 215 bp, Homo sapiens; identical to SEQ ID NO: 9060
  misc_feature 1..215: note = chr7:64734490-64734705
  misc_feature 1..215: note = hyper
  source 1..215: mol_type = genomic DNA

SEQ ID NO: 19703 - DNA, 112 bp, Homo sapiens
  misc_feature 1..112: note = chr7:64974270-64974382
  misc_feature 1..112: note = hyper
  source 1..112: mol_type = genomic DNA
cgggggctaaaagccgcaaaaagccgcggaggggggagcgaaaagcagtgggagctggggcaaaaaaccacaaaaagccgaggcagcggcggcagaaaacctcggcagcggg

SEQ ID NO: 19704 - DNA, 28 bp, Homo sapiens
  misc_feature 1..28: note = chr7:64974422-64974450
  misc_feature 1..28: note = hyper
  source 1..28: mol_type = genomic DNA
aaagccgcggtggcaaaaatgcgcggcg

SEQ ID NO: 19705 - DNA, 480 bp, Homo sapiens; identical to SEQ ID NO: 3051
  misc_feature 1..480: note = chr7:64974510-64974990
  misc_feature 1..480: note = hyper
  source 1..480: mol_type = genomic DNA

SEQ ID NO: 19706 - DNA, 56 bp, Homo sapiens; identical to SEQ ID NO: 9064
  misc_feature 1..56: note = chr7:65446028-65446084
  misc_feature 1..56: note = hyper
  source 1..56: mol_type = genomic DNA

SEQ ID NO: 19707 - DNA, 30 bp, Homo sapiens
  misc_feature 1..30: note = chr7:65508965-65508995
  misc_feature 1..30: note = hyper
  source 1..30: mol_type = genomic DNA
cagcctgctaagtcccgggtcggataccag

SEQ ID NO: 19708 - DNA, 144 bp, Homo sapiens
  misc_feature 1..144: note = chr7:69062375-69062519
  misc_feature 1..144: note = hyper
  source 1..144: mol_type = genomic DNA
gcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatc

SEQ ID NO: 19709 - DNA, 333 bp, Homo sapiens
  misc_feature 1..333: note = chr7:69062635-69062968
  misc_feature 1..333: note = hyper
  source 1..333: mol_type = genomic DNA
tccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcc

SEQ ID NO: 19710 - DNA, 82 bp, Homo sapiens
  misc_feature 1..82: note = chr7:69065045-69065127
  misc_feature 1..82: note = hyper
  source 1..82: mol_type = genomic DNA
gtctgtctgtctgtctgtctgtctgtctaggctgaggtcttattgttggtggggggagctgggggcgcgggcagacaggcag

SEQ ID NO: 19711 - DNA, 30 bp, Homo sapiens; identical to SEQ ID NO: 9068
  misc_feature 1..30: note = chr7:70596147-70596177
  misc_feature 1..30: note = hyper
  source 1..30: mol_type = genomic DNA

SEQ ID NO: 19712 - DNA, 62 bp, Homo sapiens
  misc_feature 1..62: note = chr7:71217046-71217108
  misc_feature 1..62: note = hyper
  source 1..62: mol_type = genomic DNA
aacgtttcgcagcaccgggtccaaggaagtgcaatacaacagcaaaatgcaatggccgcagc

SEQ ID NO: 19713 - DNA, 45 bp, Homo sapiens
  misc_feature 1..45: note = chr7:71800631-71800676
  misc_feature 1..45: note = hyper
  source 1..45: mol_type = genomic DNA
gggaactgcaggcaccgcttcacccaggagctacgggcttcgacc

SEQ ID NO: 19714 - DNA, 35 bp, Homo sapiens
  misc_feature 1..35: note = chr7:71802637-71802672
  misc_feature 1..35: note = hyper
  source 1..35: mol_type = genomic DNA
ccagggggaaggcggggcgccgaagtggaggggcc

SEQ ID NO: 19715 - DNA, 138 bp, Homo sapiens; identical to SEQ ID NO: 9076
  misc_feature 1..138: note = chr7:76145381-76145519
  misc_feature 1..138: note = hyper
  source 1..138: mol_type = genomic DNA

SEQ ID NO: 19716 - DNA, 17 bp, Homo sapiens
  misc_feature 1..17: note = chr7:79081775-79081792
  misc_feature 1..17: note = hyper
  source 1..17: mol_type = genomic DNA
gtcccttcttttcttcg

SEQ ID NO: 19717 - DNA, 202 bp, Homo sapiens
  misc_feature 1..202: note = chr7:79083190-79083392
  misc_feature 1..202: note = hyper
  source 1..202: mol_type = genomic DNA
cgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctt

SEQ ID NO: 19718 - skipped

SEQ ID NO: 19719 - DNA, 45 bp, Homo sapiens; identical to SEQ ID NO: 9081
  misc_feature 1..45: note = chr7:83278225-83278270
  misc_feature 1..45: note = hyper
  source 1..45: mol_type = genomic DNA

SEQ ID NO: 19720 - DNA, 46 bp, Homo sapiens; identical to SEQ ID NO: 9082
  misc_feature 1..46: note = chr7:84814651-84814697
  misc_feature 1..46: note = hyper
  source 1..46: mol_type = genomic DNA

SEQ ID NO: 19721 - DNA, 71 bp, Homo sapiens; identical to SEQ ID NO: 9084
  misc_feature 1..71: note = chr7:84816281-84816352
  misc_feature 1..71: note = hyper
  source 1..71: mol_type = genomic DNA

SEQ ID NO: 19722 - DNA, 177 bp, Homo sapiens
  misc_feature 1..177: note = chr7:86273541-86273718
  misc_feature 1..177: note = hyper
  source 1..177: mol_type = genomic DNA
ggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgac

SEQ ID NO: 19723 - DNA, 13 bp, Homo sapiens
  misc_feature 1..13: note = chr7:86273719-86273732
  misc_feature 1..13: note = hyper
  source 1..13: mol_type = genomic DNA
gcttcagcctggt

SEQ ID NO: 19724 - skipped

SEQ ID NO: 19725 - DNA, 90 bp, Homo sapiens
  misc_feature 1..90: note = chr7:87230433-87230523
  misc_feature 1..90: note = hyper
  source 1..90: mol_type = genomic DNA
attggggacatttcaacttatgtagacacgtctttcaaagttcacataagtcttcatatccatataactacaggacgtagttaagggaaa

SEQ ID NO: 19726 - DNA, 148 bp, Homo sapiens; identical to SEQ ID NO: 9091
  misc_feature 1..148: note = chr7:87257340-87257488
  misc_feature 1..148: note = hyper
  source 1..148: mol_type = genomic DNA

SEQ ID NO: 19727 - DNA, 41 bp, Homo sapiens; identical to SEQ ID NO: 9092
  misc_feature 1..41: note = chr7:87258357-87258398
  misc_feature 1..41: note = hyper
  source 1..41: mol_type = genomic DNA

SEQ ID NO: 19728 - DNA, 57 bp, Homo sapiens; identical to SEQ ID NO: 9093
  misc_feature 1..57: note = chr7:87936127-87936184
  misc_feature 1..57: note = hyper
  source 1..57: mol_type = genomic DNA

SEQ ID NO: 19729 - DNA, 219 bp, Homo sapiens
  misc_feature 1..219: note = chr7:88388660-88388879
  misc_feature 1..219: note = hyper
  source 1..219: mol_type = genomic DNA
tcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccg

SEQ ID NO: 19730 - DNA, 91 bp, Homo sapiens
  misc_feature 1..91: note = chr7:89748340-89748431
  misc_feature 1..91: note = hyper
  source 1..91: mol_type = genomic DNA
gcaggcgctggggagagtgtggagaggctgcgtggagctgcgcgctcggggtgggggctgcactcccaatgaagcgcgtgaagggcaagcg

SEQ ID NO: 19731 - skipped

SEQ ID NO: 19732 - DNA, 85 bp, Homo sapiens
  misc_feature 1..85: note = chr7:90226464-90226549
  misc_feature 1..85: note = hyper
  source 1..85: mol_type = genomic DNA
tggtattgtttaacgtatccaacctaaagggaagtgggacagttaccttgggacctattgttcggtacttcgggtcctggaaagc

SEQ ID NO: 19733 - DNA, 329 bp, Homo sapiens; identical to SEQ ID NO: 9101
  misc_feature 1..329: note = chr7:91808202-91808531
  misc_feature 1..329: note = hyper
  source 1..329: mol_type = genomic DNA

SEQ ID NO: 19734 - DNA, 34 bp, Homo sapiens
  misc_feature 1..34: note = chr7:93204298-93204332
  misc_feature 1..34: note = hyper
  source 1..34: mol_type = genomic DNA
cgctccagtcagggctggggctcaccctgcgagt

SEQ ID NO: 19735 - DNA, 263 bp, Homo sapiens
  misc_feature 1..263: note = chr7:93551060-93551323
  misc_feature 1..263: note = hyper
  source 1..263: mol_type = genomic DNA
agcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggc

SEQ ID NO: 19736 - DNA, 56 bp, Homo sapiens
  misc_feature 1..56: note = chr7:93551425-93551481
  misc_feature 1..56: note = hyper
  source 1..56: mol_type = genomic DNA
cccgagcccggttctggggcgaaaatgcctgcccttcacatcgaagatttgccaga

SEQ ID NO: 19737 - DNA, 223 bp, Homo sapiens
  misc_feature 1..223: note = chr7:94284873-94285096
  misc_feature 1..223: note = hyper
  source 1..223: mol_type = genomic DNA
acacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaa

SEQ ID NO: 19738 - DNA, 61 bp, Homo sapiens; identical to SEQ ID NO: 9109
  misc_feature 1..61: note = chr7:94536939-94537000
  misc_feature 1..61: note = hyper
  source 1..61: mol_type = genomic DNA

SEQ ID NO: 19739 - DNA, 24 bp, Homo sapiens
  misc_feature 1..24: note = chr7:96625974-96625998
  misc_feature 1..24: note = hyper
  source 1..24: mol_type = genomic DNA
gagcctgacaggtcccgggtccca

SEQ ID NO: 19740 - DNA, 35 bp, Homo sapiens
  misc_feature 1..35: note = chr7:96626051-96626086
  misc_feature 1..35: note = hyper
  source 1..35: mol_type = genomic DNA
taagtaactcaaacccgacccggcaagcgtggccc

SEQ ID NO: 19741 - DNA, 118 bp, Homo sapiens; identical to SEQ ID NO: 9114
  misc_feature 1..118: note = chr7:96627308-96627426
  misc_feature 1..118: note = hyper
  source 1..118: mol_type = genomic DNA

SEQ ID NO: 19742 - DNA, 106 bp, Homo sapiens
  misc_feature 1..106: note = chr7:96635239-96635345
  misc_feature 1..106: note = hyper
  source 1..106: mol_type = genomic DNA
agggtggaggaaacccgggagaaggctttctccagcccccaaagtttttgatgatgaccatgactacgatggctgacggcttggaaggccaggactcgtccaaatc

SEQ ID NO: 19743 - DNA, 104 bp, Homo sapiens; identical to SEQ ID NO: 9117
  misc_feature 1..104: note = chr7:96635486-96635590
  misc_feature 1..104: note = hyper
  source 1..104: mol_type = genomic DNA

SEQ ID NO: 19744 - DNA, 114 bp, Homo sapiens
  misc_feature 1..114: note = chr7:96635619-96635733
  misc_feature 1..114: note = hyper
  source 1..114: mol_type = genomic DNA
cgctcgctcgccgcctacccctacatgagccactcgcagcacagcccttacctccagtcctaccacaacagcagcgcagccgcccagacgcgaggggacgacacaggtgagagg

SEQ ID NO: 19745 - DNA, 15 bp, Homo sapiens
  misc_feature 1..15: note = chr7:96636645-96636660
  misc_feature 1..15: note = hyper
  source 1..15: mol_type = genomic DNA
cgcaccccagagagc

SEQ ID NO: 19746 - DNA, 36 bp, Homo sapiens; identical to SEQ ID NO: 9121
  misc_feature 1..36: note = chr7:96642045-96642081
  misc_feature 1..36: note = hyper
  source 1..36: mol_type = genomic DNA

SEQ ID NO: 19747 - DNA, 157 bp, Homo sapiens; identical to SEQ ID NO: 9122
  misc_feature 1..157: note = chr7:96645902-96646059
  misc_feature 1..157: note = hyper
  source 1..157: mol_type = genomic DNA

SEQ ID NO: 19748 - DNA, 41 bp, Homo sapiens; identical to SEQ ID NO: 9125
  misc_feature 1..41: note = chr7:96652088-96652129
  misc_feature 1..41: note = hyper
  source 1..41: mol_type = genomic DNA

SEQ ID NO: 19749 - DNA, 30 bp, Homo sapiens; identical to SEQ ID NO: 9128
  misc_feature 1..30: note = chr7:96656812-96656842
  misc_feature 1..30: note = hyper
  source 1..30: mol_type = genomic DNA

SEQ ID NO: 19750 - DNA, 69 bp, Homo sapiens
  misc_feature 1..69: note = chr7:97361029-97361098
  misc_feature 1..69: note = hyper
  source 1..69: mol_type = genomic DNA
ggacggaaaagttaccgaagtccaaggaatgagtcactttgctcaaatttgatgagtaatatcaggtgt

SEQ ID NO: 19751 - DNA, 94 bp, Homo sapiens
  misc_feature 1..94: note = chr7:97362198-97362292
  misc_feature 1..94: note = hyper
  source 1..94: mol_type = genomic DNA
ttcccgggttccccacgggattttgtgcccacgattcaagtttcttcccgagggctgcaccgtccggcccaggaactccctgcagtagggatgc

SEQ ID NO: 19752 - DNA, 98 bp, Homo sapiens
  misc_feature 1..98: note = chr7:97362607-97362705
  misc_feature 1..98: note = hyper
  source 1..98: mol_type = genomic DNA
agtcgtctgtaaagcgttgtcacccttccccaccggagccccagccccagatcccacacacctgtgtgcatttagggcggtgaggactctacaaagcc

SEQ ID NO: 19753 - DNA, 222 bp, Homo sapiens; identical to SEQ ID NO: 3078
  misc_feature 1..222: note = chr7:97362706-97362928
  misc_feature 1..222: note = hyper
  source 1..222: mol_type = genomic DNA

SEQ ID NO: 19754 - DNA, 29 bp, Homo sapiens
  misc_feature 1..29: note = chr7:98245856-98245885
  misc_feature 1..29: note = hyper
  source 1..29: mol_type = genomic DNA
cgtgactttgtccctaactccgggtgtcc

SEQ ID NO: 19755 - DNA, 258 bp, Homo sapiens
  misc_feature 1..258: note = chr7:98246868-98247126
  misc_feature 1..258: note = hyper
  source 1..258: mol_type = genomic DNA
gcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcg

SEQ ID NO: 19756 - DNA, 127 bp, Homo sapiens; identical to SEQ ID NO: 9137
  misc_feature 1..127: note = chr7:99149251-99149378
  misc_feature 1..127: note = hyper
  source 1..127: mol_type = genomic DNA

SEQ ID NO: 19757 - DNA, 15 bp, Homo sapiens
  misc_feature 1..15: note = chr7:99155799-99155814
  misc_feature 1..15: note = hyper
  source 1..15: mol_type = genomic DNA
aggccccgcaatcct

SEQ ID NO: 19758 - DNA, 195 bp, Homo sapiens; identical to SEQ ID NO: 9139
  misc_feature 1..195: note = chr7:99155931-99156126
  misc_feature 1..195: note = hyper
  source 1..195: mol_type = genomic DNA

SEQ ID NO: 19759 - DNA, 50 bp, Homo sapiens; identical to SEQ ID NO: 9140
  misc_feature 1..50: note = chr7:99156127-99156177
  misc_feature 1..50: note = hyper
  source 1..50: mol_type = genomic DNA

SEQ ID NO: 19760 - DNA, 100 bp, Homo sapiens; identical to SEQ ID NO: 9141
  misc_feature 1..100: note = chr7:99156815-99156915
  misc_feature 1..100: note = hyper
  source 1..100: mol_type = genomic DNA

SEQ ID NO: 19761 - DNA, 48 bp, Homo sapiens
  misc_feature 1..48: note = chr7:99177694-99177742
  misc_feature 1..48: note = hyper
  source 1..48: mol_type = genomic DNA
cggaagggacagccagttagagtctaggcccacttaggcgatgaaggg

SEQ ID NO: 19762 - DNA, 85 bp, Homo sapiens; identical to SEQ ID NO: 9143
  misc_feature 1..85: note = chr7:99178159-99178244
  misc_feature 1..85: note = hyper
  source 1..85: mol_type = genomic DNA

SEQ ID NO: 19763 - DNA, 30 bp, Homo sapiens; identical to SEQ ID NO: 9144
  misc_feature 1..30: note = chr7:99595151-99595181
  misc_feature 1..30: note = hyper
  source 1..30: mol_type = genomic DNA

SEQ ID NO: 19764 - DNA, 16 bp, Homo sapiens
  misc_feature 1..16: note = chr7:100091165-100091181
  misc_feature 1..16: note = hyper
  source 1..16: mol_type = genomic DNA
gcttctgaggggagac

SEQ ID NO: 19765 - DNA, 132 bp, Homo sapiens; identical to SEQ ID NO: 9146
  misc_feature 1..132: note = chr7:100167379-100167511
  misc_feature 1..132: note = hyper
  source 1..132: mol_type = genomic DNA

SEQ ID NO: 19766 - DNA, 32 bp, Homo sapiens; identical to SEQ ID NO: 9147
  misc_feature 1..32: note = chr7:100318466-100318498
  misc_feature 1..32: note = hyper
  source 1..32: mol_type = genomic DNA

SEQ ID NO: 19767 - DNA, 100 bp, Homo sapiens; identical to SEQ ID NO: 9149
  misc_feature 1..100: note = chr7:100823251-100823351
  misc_feature 1..100: note = hyper
  source 1..100: mol_type = genomic DNA

SEQ ID NO: 19768 - DNA, 56 bp, Homo sapiens
  misc_feature 1..56: note = chr7:100823380-100823436
  misc_feature 1..56: note = hyper
  source 1..56: mol_type = genomic DNA
cggcgggcgcagacacccccggtgccaagagagaggtccctttggagcccccaaga

SEQ ID NO: 19769 - DNA, 62 bp, Homo sapiens
  misc_feature 1..62: note = chr7:100823497-100823559
  misc_feature 1..62: note = hyper
  source 1..62: mol_type = genomic DNA
tcagcgctggggcagcgccgcagctccgttggcgacgcgggccggggcgcccatcggttcag

SEQ ID NO: 19770 - DNA, 30 bp, Homo sapiens; identical to SEQ ID NO: 9151
  misc_feature 1..30: note = chr7:100845392-100845422
  misc_feature 1..30: note = hyper
  source 1..30: mol_type = genomic DNA

SEQ ID NO: 19771 - DNA, 52 bp, Homo sapiens; identical to SEQ ID NO: 9152
  misc_feature 1..52: note = chr7:100943301-100943353
  misc_feature 1..52: note = hyper
  source 1..52: mol_type = genomic DNA

SEQ ID NO: 19772 - DNA, 127 bp, Homo sapiens; identical to SEQ ID NO: 9153
  misc_feature 1..127: note = chr7:101006326-101006453
  misc_feature 1..127: note = hyper
  source 1..127: mol_type = genomic DNA

SEQ ID NO: 19773 - DNA, 34 bp, Homo sapiens
  misc_feature 1..34: note = chr7:103085842-103085876
  misc_feature 1..34: note = hyper
  source 1..34: mol_type = genomic DNA
gcttcgagagttcagcgtgtcagagcctctatga

SEQ ID NO: 19774 - DNA, 109 bp, Homo sapiens; identical to SEQ ID NO: 9157
  misc_feature 1..109: note = chr7:103630363-103630472
  misc_feature 1..109: note = hyper
  source 1..109: mol_type = genomic DNA

SEQ ID NO: 19775 - DNA, 47 bp, Homo sapiens; identical to SEQ ID NO: 9158
  misc_feature 1..47: note = chr7:103630841-103630888
  misc_feature 1..47: note = hyper
  source 1..47: mol_type = genomic DNA

SEQ ID NO: 19776 - DNA, 251 bp, Homo sapiens; identical to SEQ ID NO: 3084
  misc_feature 1..251: note = chr7:103968915-103969166
  misc_feature 1..251: note = hyper
  source 1..251: mol_type = genomic DNA

SEQ ID NO: 19777 - DNA, 50 bp, Homo sapiens
  misc_feature 1..50: note = chr7:103969167-103969217
  misc_feature 1..50: note = hyper
  source 1..50: mol_type = genomic DNA
ctgagaggcggggggaggcggaggaccaggaggaggaggaggaggaggag

SEQ ID NO: 19778 - DNA, 181 bp, Homo sapiens
  misc_feature 1..181: note = chr7:103969341-103969522
  misc_feature 1..181: note = hyper
  source 1..181: mol_type = genomic DNA
ctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctcca

SEQ ID NO: 19779 - DNA, 15 bp, Homo sapiens
  misc_feature 1..15: note = chr7:103969562-103969577
  misc_feature 1..15: note = hyper
  source 1..15: mol_type = genomic DNA
cggcctctccatgat

SEQ ID NO: 19780 - DNA, 479 bp, Homo sapiens
  misc_feature 1..479: note = chr7:107301015-107301494
  misc_feature 1..479: note = hyper
  source 1..479: mol_type = genomic DNA
ccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagc

SEQ ID NO: 19781 - DNA, 141 bp, Homo sapiens
  misc_feature 1..141: note = chr7:107301640-107301781
  misc_feature 1..141: note = hyper
  source 1..141: mol_type = genomic DNA
gtcccgggtcaggtgcggggagggagggaatctcagtgtccccttccagccttgcaagcgcctttggcccctgccccagcccctcggtttgggggagatttcagaacgcggacagcgccctggctgcgggccataggggac

SEQ ID NO: 19782 - DNA, 30 bp, Homo sapiens; identical to SEQ ID NO: 9163
  misc_feature 1..30: note = chr7:107642639-107642669
  misc_feature 1..30: note = hyper
  source 1..30: mol_type = genomic DNA

SEQ ID NO: 19783 - DNA, 30 bp, Homo sapiens; identical to SEQ ID NO: 9165
  misc_feature 1..30: note = chr7:108096780-108096810
  misc_feature 1..30: note = hyper
  source 1..30: mol_type = genomic DNA

SEQ ID NO: 19784 - DNA, 57 bp, Homo sapiens; identical to SEQ ID NO: 9167
  misc_feature 1..57: note = chr7:112726853-112726910
  misc_feature 1..57: note = hyper
  source 1..57: mol_type = genomic DNA

SEQ ID NO: 19785 - DNA, 144 bp, Homo sapiens
  misc_feature 1..144: note = chr7:113723439-113723583
  misc_feature 1..144: note = hyper
  source 1..144: mol_type = genomic DNA
gccaggggcgggggctgaaaaggaggcggccggagaggcgaagcgagctgcgagccccgggcctgaactttcacctctcgaacccgggcccagcccattggctgcagccgaggggtccaccgagggcagcggctcctgacagga

SEQ ID NO: 19786 - DNA, 201 bp, Homo sapiens
  misc_feature 1..201: note = chr7:113724755-113724956
  misc_feature 1..201: note = hyper
  source 1..201: mol_type = genomic DNA
ttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgac

SEQ ID NO: 19787 - DNA, 246 bp, Homo sapiens
  misc_feature 1..246: note = chr7:113725081-113725327
  misc_feature 1..246: note = hyper
  source 1..246: mol_type = genomic DNA
gggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcct

SEQ ID NO: 19788 - DNA, 47 bp, Homo sapiens; identical to SEQ ID NO: 9171
  misc_feature 1..47: note = chr7:113726751-113726798
  misc_feature 1..47: note = hyper
  source 1..47: mol_type = genomic DNA

SEQ ID NO: 19789 - DNA, 27 bp, Homo sapiens
  misc_feature 1..27: note = chr7:113727781-113727808
  misc_feature 1..27: note = hyper
  source 1..27: mol_type = genomic DNA
cgccctgacacccgacctcagtgtgga

SEQ ID NO: 19790 - DNA, 77 bp, Homo sapiens; identical to SEQ ID NO: 9173
  misc_feature 1..77: note = chr7:114562200-114562277
  misc_feature 1..77: note = hyper
  source 1..77: mol_type = genomic DNA

SEQ ID NO: 19791 - skipped

SEQ ID NO: 19792 - DNA, 372 bp, Homo sapiens; identical to SEQ ID NO: 9175
  misc_feature 1..372: note = chr7:114563009-114563381
  misc_feature 1..372: note = hyper
  source 1..372: mol_type = genomic DNA

SEQ ID NO: 19793 - DNA, 52 bp, Homo sapiens
  misc_feature 1..52: note = chr7:115117500-115117552
  misc_feature 1..52: note = hyper
  source 1..52: mol_type = genomic DNA
cgtctcggctgcctccgtggagatcccgagaaaagctcctgcgctccaagtt

SEQ ID NO: 19794 - DNA, 80 bp, Homo sapiens
  misc_feature 1..80: note = chr7:115117647-115117727
  misc_feature 1..80: note = hyper
  source 1..80: mol_type = genomic DNA
ggcgggaaggcaggggacaaggcggggtcctaagggttggtggggttgagctgggggggggggggcggaaaaagagatct

SEQ ID NO: 19795 - DNA, 249 bp, Homo sapiens
  misc_feature 1..249: note = chr7:116962644-116962893
  misc_feature 1..249: note = hyper
  source 1..249: mol_type = genomic DNA
gaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaaggg

SEQ ID NO: 19796 - DNA, 32 bp, Homo sapiens; identical to SEQ ID NO: 9179
  misc_feature 1..32: note = chr7:116964126-116964158
  misc_feature 1..32: note = hyper
  source 1..32: mol_type = genomic DNA

SEQ ID NO: 19797 - DNA, 40 bp, Homo sapiens; identical to SEQ ID NO: 9180
  misc_feature 1..40: note = chr7:116964570-116964610
  misc_feature 1..40: note = hyper
  source 1..40: mol_type = genomic DNA

SEQ ID NO: 19798 - DNA, 60 bp, Homo sapiens; identical to SEQ ID NO: 9183
  misc_feature 1..60: note = chr7:119913034-119913094
  misc_feature 1..60: note = hyper
  source 1..60: mol_type = genomic DNA

SEQ ID NO: 19799 - DNA, 39 bp, Homo sapiens
  misc_feature 1..39: note = chr7:120969800-120969839
  misc_feature 1..39: note = hyper
  source 1..39: mol_type = genomic DNA
catgatcaccgccgccgccactaccgccccgatgggcgc

SEQ ID NO: 19800 - DNA, 314 bp, Homo sapiens; identical to SEQ ID NO: 9185
  misc_feature 1..314: note = chr7:120970100-120970414
  misc_feature 1..314: note = hyper
  source 1..314: mol_type = genomic DNA

SEQ ID NO: 19801 - DNA, 30 bp, Homo sapiens; identical to SEQ ID NO: 9186
  misc_feature 1..30: note = chr7:120970627-120970657
  misc_feature 1..30: note = hyper
  source 1..30: mol_type = genomic DNA

SEQ ID NO: 19802 - DNA, 30 bp, Homo sapiens; identical to SEQ ID NO: 9188
  misc_feature 1..30: note = chr7:121783592-121783622
  misc_feature 1..30: note = hyper
  source 1..30: mol_type = genomic DNA

SEQ ID NO: 19803 - DNA, 10 bp, Homo sapiens
  misc_feature 1..10: note = chr7:121940448-121940458
  misc_feature 1..10: note = hyper
  source 1..10: mol_type = genomic DNA
gtggattctc

SEQ ID NO: 19804 - DNA, 32 bp, Homo sapiens
  misc_feature 1..32: note = chr7:121940903-121940935
  misc_feature 1..32: note = hyper
  source 1..32: mol_type = genomic DNA
gaatggaagtatattcgtctataaacatacat

SEQ ID NO: 19805 - DNA, 17 bp, Homo sapiens
  misc_feature 1..17: note = chr7:121942170-121942187
  misc_feature 1..17: note = hyper
  source 1..17: mol_type = genomic DNA
ttcgccagctggcgtgc

SEQ ID NO: 19806 - DNA, 15 bp, Homo sapiens
  misc_feature 1..15: note = chr7:121943974-121943989
  misc_feature 1..15: note = hyper
  source 1..15: mol_type = genomic DNA
ccgggtggcatgggc

SEQ ID NO: 19807 - DNA, 123 bp, Homo sapiens; identical to SEQ ID NO: 706
  misc_feature 1..123: note = chr7:121944176-121944299
  misc_feature 1..123: note = hyper
  source 1..123: mol_type = genomic DNA

SEQ ID NO: 19808 - DNA, 49 bp, Homo sapiens; identical to SEQ ID NO: 9196
  misc_feature 1..49: note = chr7:121945680-121945729
  misc_feature 1..49: note = hyper
  source 1..49: mol_type = genomic DNA

SEQ ID NO: 19809 - DNA, 46 bp, Homo sapiens; identical to SEQ ID NO: 9197
  misc_feature 1..46: note = chr7:121946080-121946126
  misc_feature 1..46: note = hyper
  source 1..46: mol_type = genomic DNA

SEQ ID NO: 19810 - DNA, 14 bp, Homo sapiens
  misc_feature 1..14: note = chr7:121951863-121951877
  misc_feature 1..14: note = hyper
  source 1..14: mol_type = genomic DNA
ggctcctggaaaca

SEQ ID NO: 19811 - DNA, 88 bp, Homo sapiens; identical to SEQ ID NO: 3103
  misc_feature 1..88: note = chr7:121955425-121955513
  misc_feature 1..88: note = hyper
  source 1..88: mol_type = genomic DNA

SEQ ID NO: 19812 - DNA, 28 bp, Homo sapiens
  misc_feature 1..28: note = chr7:121956458-121956486
  misc_feature 1..28: note = hyper
  source 1..28: mol_type = genomic DNA
tccccatcttcaatccgaagctggggta

SEQ ID NO: 19813 - DNA, 15 bp, Homo sapiens
  misc_feature 1..15: note = chr7:121956567-121956582
  misc_feature 1..15: note = hyper
  source 1..15: mol_type = genomic DNA
ctctccgctactgcc

SEQ ID NO: 19814 - DNA, 182 bp, Homo sapiens
  misc_feature 1..182: note = chr7:123172968-123173150
  misc_feature 1..182: note = hyper
  source 1..182: mol_type = genomic DNA
ggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaag

SEQ ID NO: 19815 - DNA, 16 bp, Homo sapiens
  misc_feature 1..16: note = chr7:123672430-123672446
  misc_feature 1..16: note = hyper
  source 1..16: mol_type = genomic DNA
gggagggacggggagc

SEQ ID NO: 19816 - DNA, 56 bp, Homo sapiens; identical to SEQ ID NO: 9209
  misc_feature 1..56: note = chr7:123672928-123672984
  misc_feature 1..56: note = hyper
  source 1..56: mol_type = genomic DNA

SEQ ID NO: 19817 - DNA, 113 bp, Homo sapiens; identical to SEQ ID NO: 9210
  misc_feature 1..113: note = chr7:123673226-123673339
  misc_feature 1..113: note = hyper
  source 1..113: mol_type = genomic DNA

SEQ ID NO: 19818 - DNA, 45 bp, Homo sapiens
  misc_feature 1..45: note = chr7:124404370-124404415
  misc_feature 1..45: note = hyper
  source 1..45: mol_type = genomic DNA
ggccagcgcccggcccgggagtgcaattgtccacccttcgtgccc

SEQ ID NO: 19819 - DNA, 191 bp, Homo sapiens; identical to SEQ ID NO: 9212
  misc_feature 1..191: note = chr7:124404769-124404960
  misc_feature 1..191: note = hyper
  source 1..191: mol_type = genomic DNA

SEQ ID NO: 19820 - DNA, 37 bp, Homo sapiens; identical to SEQ ID NO: 9213
  misc_feature 1..37: note = chr7:124405619-124405656
  misc_feature 1..37: note = hyper
  source 1..37: mol_type = genomic DNA

SEQ ID NO: 19821 - DNA, 44 bp, Homo sapiens; identical to SEQ ID NO: 9214
  misc_feature 1..44: note = chr7:124405918-124405962
  misc_feature 1..44: note = hyper
  source 1..44: mol_type = genomic DNA

SEQ ID NO: 19822 - DNA, 14 bp, Homo sapiens
  misc_feature 1..14: note = chr7:126891206-126891220
  misc_feature 1..14: note = hyper
  source 1..14: mol_type = genomic DNA
gtctgttttcaccc

SEQ ID NO: 19823 - DNA, 730 bp, Homo sapiens; identical to SEQ ID NO: 9216
  misc_feature 1..730: note = chr7:126891633-126892363
  misc_feature 1..730: note = hyper
  source 1..730: mol_type = genomic DNA

SEQ ID NO: 19824 - DNA, 65 bp, Homo sapiens
  misc_feature 1..65: note = chr7:127744057-127744122
  misc_feature 1..65: note = hyper
  source 1..65: mol_type = genomic DNA
atgaagaaactgagccgaggaaaggaagcgacttggccaaggtcggagagctcattctttgcagg

SEQ ID NO: 19825 - DNA, 39 bp, Homo sapiens
  misc_feature 1..39: note = chr7:127744631-127744670
  misc_feature 1..39: note = hyper
  source 1..39: mol_type = genomic DNA
aaagagtcccattgcttcaccgtccggagcttagtctcc

SEQ ID NO: 19826 - DNA, 36 bp, Homo sapiens; identical to SEQ ID NO: 9219
  misc_feature 1..36: note = chr7:127806571-127806607
  misc_feature 1..36: note = hyper
  source 1..36: mol_type = genomic DNA

SEQ ID NO: 19827 - DNA, 201 bp, Homo sapiens
  misc_feature 1..201: note = chr7:127807846-127808047
  misc_feature 1..201: note = hyper
  source 1..201: mol_type = genomic DNA
aacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccag

SEQ ID NO: 19828 - DNA, 159 bp, Homo sapiens; identical to SEQ ID NO: 3109
  misc_feature 1..159: note = chr7:127841338-127841497
  misc_feature 1..159: note = hyper
  source 1..159: mol_type = genomic DNA

SEQ ID NO: 19829 - DNA, 41 bp, Homo sapiens; identical to SEQ ID NO: 9224
  misc_feature 1..41: note = chr7:127992478-127992519
  misc_feature 1..41: note = hyper
  source 1..41: mol_type = genomic DNA

SEQ ID NO: 19830 - DNA, 45 bp, Homo sapiens
  misc_feature 1..45: note = chr7:128337422-128337467
  misc_feature 1..45: note = hyper
  source 1..45: mol_type = genomic DNA
gccatgtaagcagagcggacaactctgagggcgtggctgggcggg

SEQ ID NO: 19831 - DNA, 125 bp, Homo sapiens; identical to SEQ ID NO: 3113
  misc_feature 1..125: note = chr7:128430757-128430882
  misc_feature 1..125: note = hyper
  source 1..125: mol_type = genomic DNA

SEQ ID NO: 19832 - DNA, 400 bp, Homo sapiens
  misc_feature 1..400: note = chr7:128470497-128470897
  misc_feature 1..400: note = hyper
  source 1..400: mol_type = genomic DNA
gagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccg

SEQ ID NO: 19833 - DNA, 25 bp, Homo sapiens
  misc_feature 1..25: note = chr7:128471032-128471057
  misc_feature 1..25: note = hyper
  source 1..25: mol_type = genomic DNA
cgtgtccataggtcagtgccggggg

SEQ ID NO: 19834 - DNA, 90 bp, Homo sapiens; identical to SEQ ID NO: 3115
  misc_feature 1..90: note = chr7:128471125-128471215
  misc_feature 1..90: note = hyper
  source 1..90: mol_type = genomic DNA

SEQ ID NO: 19835 - DNA, 56 bp, Homo sapiens; identical to SEQ ID NO: 9231
  misc_feature 1..56: note = chr7:128510097-128510153
  misc_feature 1..56: note = hyper
  source 1..56: mol_type = genomic DNA

SEQ ID NO: 19836 - DNA, 65 bp, Homo sapiens
  misc_feature 1..65: note = chr7:128828130-128828195
  misc_feature 1..65: note = hyper
  source 1..65: mol_type = genomic DNA
tggaacagaagtccccgttgacttcaggcatcccctgtctttcccatcctgagccaggagaaaag

SEQ ID NO: 19837 - DNA, 111 bp, Homo sapiens
  misc_feature 1..111: note = chr7:128828272-128828383
  misc_feature 1..111: note = hyper
  source 1..111: mol_type = genomic DNA
actcatctctttcccccgggcgcggggcggcggcaggcggggtcaccagatccccctagcccgggcccctccaggcgccagggacgctgacgctcgcgctcttcctctctc

SEQ ID NO: 19838 - DNA, 262 bp, Homo sapiens; identical to SEQ ID NO: 9233
  misc_feature 1..262: note = chr7:128829105-128829367
  misc_feature 1..262: note = hyper
  source 1..262: mol_type = genomic DNA

SEQ ID NO: 19839 - skipped

SEQ ID NO: 19840 - DNA, 45 bp, Homo sapiens
  misc_feature 1..45: note = chr7:129422115-129422160
  misc_feature 1..45: note = hyper
  source 1..45: mol_type = genomic DNA
ggagctggactcggacggtgagggggcggcccccggggacctgat

SEQ ID NO: 19841 - skipped

SEQ ID NO: 19842 - DNA, 64 bp, Homo sapiens
  misc_feature 1..64: note = chr7:129424591-129424655
  misc_feature 1..64: note = hyper
  source 1..64: mol_type = genomic DNA
caggtgaaacataagcgtccaccccagaggggtcccctacccaagtcagaggagaaggtggcct

SEQ ID NO: 19843 - DNA, 59 bp, Homo sapiens
  misc_feature 1..59: note = chr7:129425887-129425946
  misc_feature 1..59: note = hyper
  source 1..59: mol_type = genomic DNA
ggatctgaagcccagctaggcttctaattccagacagagccctacggagcccagttctc

SEQ ID NO: 19844 - DNA, 30 bp, Homo sapiens; identical to SEQ ID NO: 9240
  misc_feature 1..30: note = chr7:132260536-132260566
  misc_feature 1..30: note = hyper
  source 1..30: mol_type = genomic DNA

SEQ ID NO: 19845 - DNA, 89 bp, Homo sapiens; identical to SEQ ID NO: 9241
  misc_feature 1..89: note = chr7:132260852-132260941
  misc_feature 1..89: note = hyper
  source 1..89: mol_type = genomic DNA

SEQ ID NO: 19846 - DNA, 141 bp, Homo sapiens; identical to SEQ ID NO: 9242
  misc_feature 1..141: note = chr7:132261845-132261986
  misc_feature 1..141: note = hyper
  source 1..141: mol_type = genomic DNA

SEQ ID NO: 19847 - DNA, 109 bp, Homo sapiens
  misc_feature 1..109: note = chr7:134143055-134143164
  misc_feature 1..109: note = hyper
  source 1..109: mol_type = genomic DNA
attatcaactagctacggggtgcccagatttttctcccgagttccagacccagggcaccccgaggcggcgcctggccgaggagctccgcactgcgccttgttaacagct

SEQ ID NO: 19848 - DNA, 112 bp, Homo sapiens
  misc_feature 1..112: note = chr7:134143475-134143587
  misc_feature 1..112: note = hyper
  source 1..112: mol_type = genomic DNA
gcccgcggtagggcgggggctcccgtgagctgctcccaaaccccactcgcaggatgctgccctgacgcccagggccaacccggggagccaaggcccccggtctctgcaaggc

SEQ ID NO: 19849 - DNA, 83 bp, Homo sapiens
  misc_feature 1..83: note = chr7:139167744-139167827
  misc_feature 1..83: note = hyper
  source 1..83: mol_type = genomic DNA
gagcccggggagccggcgcttccttccgcggggctggcccggccctctgcgtcgcagccgctctccgtccgggctgcagccag

SEQ ID NO: 19850 - DNA, 158 bp, Homo sapiens
  misc_feature 1..158: note = chr7:139168379-139168537
  misc_feature 1..158: note = hyper
  source 1..158: mol_type = genomic DNA
ctcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctg

SEQ ID NO: 19851 - DNA, 55 bp, Homo sapiens; identical to SEQ ID NO: 9255
  misc_feature 1..55: note = chr7:139208245-139208300
  misc_feature 1..55: note = hyper
  source 1..55: mol_type = genomic DNA

SEQ ID NO: 19852 - DNA, 133 bp, Homo sapiens; identical to SEQ ID NO: 3130
  misc_feature 1..133: note = chr7:139208629-139208762
  misc_feature 1..133: note = hyper
  source 1..133: mol_type = genomic DNA

SEQ ID NO: 19853 - DNA, 15 bp, Homo sapiens
  misc_feature 1..15: note = chr7:140339853-140339868
  misc_feature 1..15: note = hyper
  source 1..15: mol_type = genomic DNA
gcccggctgctcagc

SEQ ID NO: 19854 - DNA, 40 bp, Homo sapiens; identical to SEQ ID NO: 9258
  misc_feature 1..40: note = chr7:140771769-140771809
  misc_feature 1..40: note = hyper
  source 1..40: mol_type = genomic DNA

SEQ ID NO: 19855 - DNA, 246 bp, Homo sapiens; identical to SEQ ID NO: 9259
  misc_feature 1..246: note = chr7:140772343-140772589
  misc_feature 1..246: note = hyper
  source 1..246: mol_type = genomic DNA

SEQ ID NO: 19856 - DNA, 335 bp, Homo sapiens
  misc_feature 1..335: note = chr7:140773228-140773563
  misc_feature 1..335: note = hyper
  source 1..335: mol_type = genomic DNA
gggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctgg

SEQ ID NO: 19857 - DNA, 470 bp, Homo sapiens
  misc_feature 1..470: note = chr7:140773750-140774220
  misc_feature 1..470: note = hyper
  source 1..470: mol_type = genomic DNA
ggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccag

SEQ ID NO: 19858 - DNA, 26 bp, Homo sapiens
  misc_feature 1..26: note = chr7:143580069-143580095
  misc_feature 1..26: note = hyper
  source 1..26: mol_type = genomic DNA
ctttgtgtcgccggccctggtggctt

SEQ ID NO: 19859 - DNA, 46 bp, Homo sapiens
  misc_feature 1..46: note = chr7:145813082-145813128
  misc_feature 1..46: note = hyper
  source 1..46: mol_type = genomic DNA
cccccgccccagctgatggaccccggccggtcggctcagtctccct

SEQ ID NO: 19860 - DNA, 33 bp, Homo sapiens; identical to SEQ ID NO: 9264
  misc_feature 1..33: note = chr7:145813544-145813577
  misc_feature 1..33: note = hyper
  source 1..33: mol_type = genomic DNA

SEQ ID NO: 19861 - DNA, 18 bp, Homo sapiens
  misc_feature 1..18: note = chr7:149119930-149119948
  misc_feature 1..18: note = hyper
  source 1..18: mol_type = genomic DNA
gcgccaaatggagggcgc

SEQ ID NO: 19862 - DNA, 59 bp, Homo sapiens
  misc_feature 1..59: note = chr7:149411482-149411541
  misc_feature 1..59: note = hyper
  source 1..59: mol_type = genomic DNA
ggcgcgggcgaaagacgtgaggatgtacgggggcctggcagctgctctgtcccacccac

SEQ ID NO: 19863 - DNA, 60 bp, Homo sapiens
  misc_feature 1..60: note = chr7:149412304-149412364
  misc_feature 1..60: note = hyper
  source 1..60: mol_type = genomic DNA
aggtcctcggacaacctctctccagctctccgccgccggtacccacggcccagtctccac

SEQ ID NO: 19864 - DNA, 36 bp, Homo sapiens
  misc_feature 1..36: note = chr7:149744469-149744505
  misc_feature 1..36: note = hyper
  source 1..36: mol_type = genomic DNA
ccagccaccaactcccggccgccgcggctgcagaca

SEQ ID NO: 19865 - skipped

SEQ ID NO: 19866 - DNA, 65 bp, Homo sapiens; identical to SEQ ID NO: 9272
  misc_feature 1..65: note = chr7:149744950-149745015
  misc_feature 1..65: note = hyper
  source 1..65: mol_type = genomic DNA

SEQ ID NO: 19867 - DNA, 41 bp, Homo sapiens
  misc_feature 1..41: note = chr7:149917336-149917377
  misc_feature 1..41: note = hyper
  source 1..41: mol_type = genomic DNA
gtggcctttccccgggggatacctgacgctattggagactc

SEQ ID NO: 19868 - DNA, 34 bp, Homo sapiens
  misc_feature 1..34: note = chr7:150748158-150748192
  misc_feature 1..34: note = hyper
  source 1..34: mol_type = genomic DNA
agaactgtgcccacccggccataggtaagggcga

SEQ ID NO: 19869 - DNA, 113 bp, Homo sapiens
  misc_feature 1..113: note = chr7:150748406-150748519
  misc_feature 1..113: note = hyper
  source 1..113: mol_type = genomic DNA
gtgagctgcgcggggcgggcgggctcctccgagccgggggctcccgacggggcggaacggggcaggccaggccgtagccctagtgcgcacagcccgggcggaggcagcctccg

SEQ ID NO: 19870 - DNA, 165 bp, Homo sapiens; identical to SEQ ID NO: 9276
  misc_feature 1..165: note = chr7:150864232-150864397
  misc_feature 1..165: note = hyper
  source 1..165: mol_type = genomic DNA

SEQ ID NO: 19871 - DNA, 33 bp, Homo sapiens
  misc_feature 1..33: note = chr7:151106418-151106451
  misc_feature 1..33: note = hyper
  source 1..33: mol_type = genomic DNA
ctagaaaggggtctgcgggcgcaggagctgggg

SEQ ID NO: 19872 - DNA, 91 bp, Homo sapiens
  misc_feature 1..91: note = chr7:151107395-151107486
  misc_feature 1..91: note = hyper
  source 1..91: mol_type = genomic DNA
cgcgcgccgggaactcatttggggcgcagctccaccgacccctcggctactcgcctccaccaggcaagccaggtcctcccatgctctgagc

SEQ ID NO: 19873 - DNA, 30 bp, Homo sapiens; identical to SEQ ID NO: 9280
  misc_feature 1..30: note = chr7:151107782-151107812
  misc_feature 1..30: note = hyper
  source 1..30: mol_type = genomic DNA

SEQ ID NO: 19874 - DNA, 175 bp, Homo sapiens; identical to SEQ ID NO: 9281
  misc_feature 1..175: note = chr7:151145538-151145713
  misc_feature 1..175: note = hyper
  source 1..175: mol_type = genomic DNA

SEQ ID NO: 19875 - DNA, 30 bp, Homo sapiens; identical to SEQ ID NO: 9282
  misc_feature 1..30: note = chr7:152622731-152622761
  misc_feature 1..30: note = hyper
  source 1..30: mol_type = genomic DNA

SEQ ID NO: 19876 - DNA, 117 bp, Homo sapiens; identical to SEQ ID NO: 9283
  misc_feature 1..117: note = chr7:153446175-153446292
  misc_feature 1..117: note = hyper
  source 1..117: mol_type = genomic DNA

SEQ ID NO: 19877 - DNA, 64 bp, Homo sapiens; identical to SEQ ID NO: 9284
  misc_feature 1..64: note = chr7:153583466-153583530
  misc_feature 1..64: note = hyper
  source 1..64: mol_type = genomic DNA

SEQ ID NO: 19878 - DNA, 40 bp, Homo sapiens; identical to SEQ ID NO: 9289
  misc_feature 1..40: note = chr7:153750249-153750289
  misc_feature 1..40: note = hyper
  source 1..40: mol_type = genomic DNA

SEQ ID NO: 19879 - DNA, 10 bp, Homo sapiens
  misc_feature 1..10: note = chr7:154002083-154002093
  misc_feature 1..10: note = hyper
  source 1..10: mol_type = genomic DNA
cgctgcctcc

SEQ ID NO: 19880 - DNA, 89 bp, Homo sapiens; identical to SEQ ID NO: 9291
  misc_feature 1..89: note = chr7:154861818-154861907
  misc_feature 1..89: note = hyper
  source 1..89: mol_type = genomic DNA

SEQ ID NO: 19881 - DNA, 41 bp, Homo sapiens
  misc_feature 1..41: note = chr7:154862266-154862307
  misc_feature 1..41: note = hyper
  source 1..41: mol_type = genomic DNA
cgatctgggagatgctcggctctgggcggccaaacagcctt

SEQ ID NO: 19882 - skipped

SEQ ID NO: 19883 - DNA, 313 bp, Homo sapiens
  misc_feature 1..313: note = chr7:155165562-155165875
  misc_feature 1..313: note = hyper
  source 1..313: mol_type = genomic DNA
cctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaa

SEQ ID NO: 19884 - DNA, 250 bp, Homo sapiens
  misc_feature 1..250: note = chr7:155166784-155167034
  misc_feature 1..250: note = hyper
  source 1..250: mol_type = genomic DNA
ccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggg

SEQ ID NO: 19885 - DNA, 77 bp, Homo sapiens; identical to SEQ ID NO: 9296
  misc_feature 1..77: note = chr7:155168537-155168614
  misc_feature 1..77: note = hyper
  source 1..77: mol_type = genomic DNA

SEQ ID NO: 19886 - DNA, 202 bp, Homo sapiens; identical to SEQ ID NO: 9297
  misc_feature 1..202: note = chr7:155170276-155170478
  misc_feature 1..202: note = hyper
  source 1..202: mol_type = genomic DNA

SEQ ID NO: 19887 - DNA, 89 bp, Homo sapiens; identical to SEQ ID NO: 9298
  misc_feature 1..89: note = chr7:155170836-155170925
  misc_feature 1..89: note = hyper
  source 1..89: mol_type = genomic DNA

SEQ ID NO: 19888 - DNA, 78 bp, Homo sapiens; identical to SEQ ID NO: 9299
  misc_feature 1..78: note = chr7:155173869-155173947
  misc_feature 1..78: note = hyper
  source 1..78: mol_type = genomic DNA

SEQ ID NO: 19889 - DNA, 432 bp, Homo sapiens
  misc_feature 1..432: note = chr7:155174224-155174656
  misc_feature 1..432: note = hyper
  source 1..432: mol_type = genomic DNA
ctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggc

SEQ ID NO: 19890 - DNA, 70 bp, Homo sapiens
  misc_feature 1..70: note = chr7:155174788-155174858
  misc_feature 1..70: note = hyper
  source 1..70: mol_type = genomic DNA
acatgtacacgaatgtgagtgtgagtgtgcatgagcgtgagcgtgcgtgtgcgtgcgagtgtgcacgagc

SEQ ID NO: 19891 - DNA, 180 bp, Homo sapiens
  misc_feature 1..180: note = chr7:155242049-155242229
  misc_feature 1..180: note = hyper
  source 1..180: mol_type = genomic DNA
ggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcc

SEQ ID NO: 19892 - DNA, 30 bp, Homo sapiens
  misc_feature 1..30: note = chr7:155242699-155242729
  misc_feature 1..30: note = hyper
  source 1..30: mol_type = genomic DNA
cgagccacgtcccgggacccggagagcccg

SEQ ID NO: 19893 - DNA, 244 bp, Homo sapiens
  misc_feature 1..244: note = chr7:155243102-155243346
  misc_feature 1..244: note = hyper
  source 1..244: mol_type = genomic DNA
gtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacaccc

SEQ ID NO: 19894 - DNA, 67 bp, Homo sapiens; identical to SEQ ID NO: 9304
  misc_feature 1..67: note = chr7:155243755-155243822
  misc_feature 1..67: note = hyper
  source 1..67: mol_type = genomic DNA

SEQ ID NO: 19895 - DNA, 149 bp, Homo sapiens
  misc_feature 1..149: note = chr7:155244031-155244180
  misc_feature 1..149: note = hyper
  source 1..149: mol_type = genomic DNA
gaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatct

SEQ ID NO: 19896 - DNA, 37 bp, Homo sapiens; identical to SEQ ID NO: 9307
  misc_feature 1..37: note = chr7:155248008-155248045
  misc_feature 1..37: note = hyper
  source 1..37: mol_type = genomic DNA

SEQ ID NO: 19897 - DNA, 88 bp, Homo sapiens; identical to SEQ ID NO: 9308
  misc_feature 1..88: note = chr7:155249117-155249205
  misc_feature 1..88: note = hyper
  source 1..88: mol_type = genomic DNA

SEQ ID NO: 19898 - DNA, 25 bp, Homo sapiens
  misc_feature 1..25: note = chr7:155249900-155249925
  misc_feature 1..25: note = hyper
  source 1..25: mol_type = genomic DNA
aaatcttaaaaatagcgatcttcct

SEQ ID NO: 19899 - DNA, 400 bp, Homo sapiens
  misc_feature 1..400: note = chr7:155250387-155250787
  misc_feature 1..400: note = hyper
  source 1..400: mol_type = genomic DNA
cgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccg

SEQ ID NO: 19900 - DNA, 123 bp, Homo sapiens; identical to SEQ ID NO: 9311
  misc_feature 1..123: note = chr7:155251427-155251550
  misc_feature 1..123: note = hyper
  source 1..123: mol_type = genomic DNA

SEQ ID NO: 19901 - DNA, 85 bp, Homo sapiens
  misc_feature 1..85: note = chr7:155252162-155252247
  misc_feature 1..85: note = hyper
  source 1..85: mol_type = genomic DNA
tcatccccttccctacgatcttccaactcaggccaggccggggacgcatgccccagcccaccccagacttgtcctaccatccggt

SEQ ID NO: 19902 - DNA, 25 bp, Homo sapiens
  misc_feature 1..25: note = chr7:155253041-155253066
  misc_feature 1..25: note = hyper
  source 1..25: mol_type = genomic DNA
cagcccaagtcgcctatcttcatgg

SEQ ID NO: 19903 - skipped

SEQ ID NO: 19904 - DNA, 121 bp, Homo sapiens
  misc_feature 1..121: note = chr7:155258072-155258193
  misc_feature 1..121: note = hyper
  source 1..121: mol_type = genomic DNA
tttggggtctttgagcgagtgatctacgcgttgaattgctgtttttccaaactttcatggcttaaaaattttttttcttctccctgtaaaagaaactcagagactggtgatctgttaccga

SEQ ID NO: 19905 - DNA, 377 bp, Homo sapiens
  misc_feature 1..377: note = chr7:155258487-155258864
  misc_feature 1..377: note = hyper
  source 1..377: mol_type = genomic DNA
aaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagac

SEQ ID NO: 19906 - DNA, 35 bp, Homo sapiens
  misc_feature 1..35: note = chr7:155258914-155258949
  misc_feature 1..35: note = hyper
  source 1..35: mol_type = genomic DNA
cgctggttcctctcgggcctcccgggctctgcgtg

SEQ ID NO: 19907 - DNA, 95 bp, Homo sapiens
  misc_feature 1..95: note = chr7:155260785-155260880
  misc_feature 1..95: note = hyper
  source 1..95: mol_type = genomic DNA
cctcagcctggaaggcgtcccagagaggccccacccccagcctccacggagacccaggagggaagaagagccgggacccggtagccctgaggggc

SEQ ID NO: 19908 - DNA, 215 bp, Homo sapiens; identical to SEQ ID NO: 9326
  misc_feature 1..215: note = chr7:155264127-155264342
  misc_feature 1..215: note = hyper
  source 1..215: mol_type = genomic DNA

SEQ ID NO: 19909 - DNA, 85 bp, Homo sapiens
  misc_feature 1..85: note = chr7:155301753-155301838
  misc_feature 1..85: note = hyper
  source 1..85: mol_type = genomic DNA
aagatccgttaggaacgcctccgactgagctagggggatctaagaagaaagacagggcgaggaaacttgtcttaatgttaatgtt

SEQ ID NO: 19910 - DNA, 19 bp, Homo sapiens
  misc_feature 1..19: note = chr7:155301931-155301950
  misc_feature 1..19: note = hyper
  source 1..19: mol_type = genomic DNA
gtaccgcagattgttatta

SEQ ID NO: 19911 - DNA, 14 bp, Homo sapiens
  misc_feature 1..14: note = chr7:155326527-155326541
  misc_feature 1..14: note = hyper
  source 1..14: mol_type = genomic DNA
ggcattgtttcagc

SEQ ID NO: 19912 - DNA, 15 bp, Homo sapiens
  misc_feature 1..15: note = chr7:155580211-155580226
  misc_feature 1..15: note = hyper
  source 1..15: mol_type = genomic DNA
cgcccgcccgctgca

SEQ ID NO: 19913 - DNA, 41 bp, Homo sapiens; identical to SEQ ID NO: 9333
  misc_feature 1..41: note = chr7:156409472-156409513
  misc_feature 1..41: note = hyper
  source 1..41: mol_type = genomic DNA

SEQ ID NO: 19914 - DNA, 99 bp, Homo sapiens
  misc_feature 1..99: note = chr7:156795914-156796013
  misc_feature 1..99: note = hyper
  source 1..99: mol_type = genomic DNA
gcaggggccggcgcaggtccggggcctggctctgctggaggacgggggaggggcggccctattaacagcgtcttcctttgatgtcgctcttccccgcgt

SEQ ID NO: 19915 - DNA, 40 bp, Homo sapiens
  misc_feature 1..40: note = chr7:156796494-156796534
  misc_feature 1..40: note = hyper
  source 1..40: mol_type = genomic DNA
tttatggaaggggcccggggtgataatgagttgccagaga

SEQ ID NO: 19916 - DNA, 66 bp, Homo sapiens
  misc_feature 1..66: note = chr7:156800933-156800999
  misc_feature 1..66: note = hyper
  source 1..66: mol_type = genomic DNA
ccgtgggcaacttagcgtccttggctctgggaaatgcaggtcatattggtggctttctatcagaag

SEQ ID NO: 19917 - DNA, 43 bp, Homo sapiens
  misc_feature 1..43: note = chr7:156801029-156801072
  misc_feature 1..43: note = hyper
  source 1..43: mol_type = genomic DNA
aagcccaggctggcaggggattcgcagacgcagacgtgtctga

SEQ ID NO: 19918 - DNA, 271 bp, Homo sapiens
  misc_feature 1..271: note = chr7:156801601-156801872
  misc_feature 1..271: note = hyper
  source 1..271: mol_type = genomic DNA
ggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctc

SEQ ID NO: 19919 - DNA, 24 bp, Homo sapiens
  misc_feature 1..24: note = chr7:156809199-156809223
  misc_feature 1..24: note = hyper
  source 1..24: mol_type = genomic DNA
gtccatgttcgataatggcaggaa

SEQ ID NO: 19920 - DNA, 38 bp, Homo sapiens; identical to SEQ ID NO: 9351
  misc_feature 1..38: note = chr7:156811672-156811710
  misc_feature 1..38: note = hyper
  source 1..38: mol_type = genomic DNA

SEQ ID NO: 19921 - DNA, 71 bp, Homo sapiens; identical to SEQ ID NO: 9355
  misc_feature 1..71: note = chr7:157129160-157129231
  misc_feature 1..71: note = hyper
  source 1..71: mol_type = genomic DNA

SEQ ID NO: 19922 - DNA, 122 bp, Homo sapiens
  misc_feature 1..122: note = chr7:157481847-157481969
  misc_feature 1..122: note = hyper
  source 1..122: mol_type = genomic DNA
cactttcctctgtgtcggtgaaaggaagagcttccagctccctcctccgcacaaaccttcacttcctctcttgttcgatcgcgtcctaaaatctgggatcggcgacgcaaggacagcctggt

SEQ ID NO: 19923 - DNA, 46 bp, Homo sapiens
  misc_feature 1..46: note = chr7:157483274-157483320
  misc_feature 1..46: note = hyper
  source 1..46: mol_type = genomic DNA
gggaggaggtgggggcgtgcgccgggccgagcggcctcggggcgca

SEQ ID NO: 19924 - DNA, 83 bp, Homo sapiens; identical to SEQ ID NO: 9363
  misc_feature 1..83: note = chr7:157483738-157483821
  misc_feature 1..83: note = hyper
  source 1..83: mol_type = genomic DNA

SEQ ID NO: 19925 - DNA, 75 bp, Homo sapiens; identical to SEQ ID NO: 9364
  misc_feature 1..75: note = chr7:157484507-157484582
  misc_feature 1..75: note = hyper
  source 1..75: mol_type = genomic DNA

SEQ ID NO: 19926 - DNA, 24 bp, Homo sapiens
  misc_feature 1..24: note = chr7:157485503-157485527
  misc_feature 1..24: note = hyper
  source 1..24: mol_type = genomic DNA
gcccagggcaaggcccgcaaaaac

SEQ ID NO: 19927 - skipped

SEQ ID NO: 19928 - DNA, 82 bp, Homo sapiens; identical to SEQ ID NO: 9373
  misc_feature 1..82: note = chr8:495729-495811
  misc_feature 1..82: note = hyper
  source 1..82: mol_type = genomic DNA

SEQ ID NO: 19929 - DNA, 129 bp, Homo sapiens; identical to SEQ ID NO: 3193
  misc_feature 1..129: note = chr8:687513-687642
  misc_feature 1..129: note = hyper
  source 1..129: mol_type = genomic DNA

SEQ ID NO: 19930 - DNA, 36 bp, Homo sapiens
  misc_feature 1..36: note = chr8:4849500-4849536
  misc_feature 1..36: note = hyper
  source 1..36: mol_type = genomic DNA
ccctccgcgcgcacacacttgcgcacagcacctctc

SEQ ID NO: 19931 - DNA, 46 bp, Homo sapiens; identical to SEQ ID NO: 9379
  misc_feature 1..46: note = chr8:4851880-4851926
  misc_feature 1..46: note = hyper
  source 1..46: mol_type = genomic DNA

SEQ ID NO: 19932 - DNA, 68 bp, Homo sapiens; identical to SEQ ID NO: 9380
  misc_feature 1..68: note = chr8:4852501-4852569
  misc_feature 1..68: note = hyper
  source 1..68: mol_type = genomic DNA

SEQ ID NO: 19933 - DNA, 30 bp, Homo sapiens; identical to SEQ ID NO: 9381
  misc_feature 1..30: note = chr8:6692832-6692862
  misc_feature 1..30: note = hyper
  source 1..30: mol_type = genomic DNA

SEQ ID NO: 19934 - DNA, 15 bp, Homo sapiens
  misc_feature 1..15: note = chr8:9756486-9756501
  misc_feature 1..15: note = hyper
  source 1..15: mol_type = genomic DNA
cgctagagtgaaatc

SEQ ID NO: 19935 - DNA, 279 bp, Homo sapiens
  misc_feature 1..279: note = chr8:9762864-9763143
  misc_feature 1..279: note = hyper
  source 1..279: mol_type = genomic DNA
cagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttg

SEQ ID NO: 19936 - DNA, 16 bp, Homo sapiens
  misc_feature 1..16: note = chr8:9763275-9763291
  misc_feature 1..16: note = hyper
  source 1..16: mol_type = genomic DNA
gcggagccgcctggaa

SEQ ID NO: 19937 - DNA, 197 bp, Homo sapiens; identical to SEQ ID NO: 3197
  misc_feature 1..197: note = chr8:9763565-9763762
  misc_feature 1..197: note = hyper
  source 1..197: mol_type = genomic DNA

SEQ ID NO: 19938 - DNA, 108 bp, Homo sapiens
  misc_feature 1..108: note = chr8:9763787-9763895
  misc_feature 1..108: note = hyper
  source 1..108: mol_type = genomic DNA
cgcttccgtttatccgtttctatcccgggaaaagggggcgcctgcccgagcccacgcgcgccgccgcatctgcagcggtcggcgccccacgctccctgaacgcccccc

SEQ ID NO: 19939 - DNA, 220 bp, Homo sapiens
  misc_feature 1..220: note = chr8:9764214-9764434
  misc_feature 1..220: note = hyper
  source 1..220: mol_type = genomic DNA
agcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggac

SEQ ID NO: 19940 - DNA, 362 bp, Homo sapiens
  misc_feature 1..362: note = chr8:9764551-9764913
  misc_feature 1..362: note = hyper
  source 1..362: mol_type = genomic DNA
tccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagca

SEQ ID NO: 19941 - DNA, 131 bp, Homo sapiens; identical to SEQ ID NO: 9389
  misc_feature 1..131: note = chr8:10587422-10587553
  misc_feature 1..131: note = hyper
  source 1..131: mol_type = genomic DNA

SEQ ID NO: 19942 - DNA, 121 bp, Homo sapiens
  misc_feature 1..121: note = chr8:11204905-11205026
  misc_feature 1..121: note = hyper
  source 1..121: mol_type = genomic DNA
gatttcggtcgcgtgcggctctgaccgcgtcgccccatccctggcggggccacgcacggacgccatggctggcgccgcggagccgggcgatgcgcgcggactctcccggggccctgactgt

SEQ ID NO: 19943 - DNA, 249 bp, Homo sapiens; identical to SEQ ID NO: 9391
  misc_feature 1..249: note = chr8:11205453-11205702
  misc_feature 1..249: note = hyper
  source 1..249: mol_type = genomic DNA

SEQ ID NO: 19944 - DNA, 61 bp, Homo sapiens; identical to SEQ ID NO: 9392
  misc_feature 1..61: note = chr8:11206007-11206068
  misc_feature 1..61: note = hyper
  source 1..61: mol_type = genomic DNA

SEQ ID NO: 19945 - DNA, 46 bp, Homo sapiens
  misc_feature 1..46: note = chr8:11537179-11537225
  misc_feature 1..46: note = hyper
  source 1..46: mol_type = genomic DNA
gagccctgagtgggccgggtgctgggcgaacagtcctagccctgca

SEQ ID NO: 19946 - DNA, 24 bp, Homo sapiens
  misc_feature 1..24: note = chr8:11537259-11537283
  misc_feature 1..24: note = hyper
  source 1..24: mol_type = genomic DNA
ttacaggggcgaggttgggatcgg

SEQ ID NO: 19947 - DNA, 50 bp, Homo sapiens; identical to SEQ ID NO: 9395
  misc_feature 1..50: note = chr8:11550672-11550722
  misc_feature 1..50: note = hyper
  source 1..50: mol_type = genomic DNA

SEQ ID NO: 19948 - DNA, 30 bp, Homo sapiens; identical to SEQ ID NO: 9398
  misc_feature 1..30: note = chr8:11560481-11560511
  misc_feature 1..30: note = hyper
  source 1..30: mol_type = genomic DNA

SEQ ID NO: 19949 - DNA, 59 bp, Homo sapiens
  misc_feature 1..59: note = chr8:11560793-11560852
  misc_feature 1..59: note = hyper
  source 1..59: mol_type = genomic DNA
ctgtgattgctctattaacctttagacctgtctgagggactctccggctcgcagccccg

SEQ ID NO: 19950 - DNA, 30 bp, Homo sapiens; identical to SEQ ID NO: 9400
  misc_feature 1..30: note = chr8:11561116-11561146
  misc_feature 1..30: note = hyper
  source 1..30: mol_type = genomic DNA

SEQ ID NO: 19951 - DNA, 27 bp, Homo sapiens
  misc_feature 1..27: note = chr8:11562169-11562196
  misc_feature 1..27: note = hyper
  source 1..27: mol_type = genomic DNA
ggactgacgggcccgggacaggctgca

SEQ ID NO: 19952 - DNA, 146 bp, Homo sapiens; identical to SEQ ID NO: 3203
  misc_feature 1..146: note = chr8:11562235-11562381
  misc_feature 1..146: note = hyper
  source 1..146: mol_type = genomic DNA

SEQ ID NO: 19953 - DNA, 74 bp, Homo sapiens
  misc_feature 1..74: note = chr8:11562627-11562701
  misc_feature 1..74: note = hyper
  source 1..74: mol_type = genomic DNA
tggctggggaaagagcgtggtgggggacccgcggccgatggaatccctggggcagcgcggcccgcaccgtggag

SEQ ID NO: 19954 - DNA, 36 bp, Homo sapiens; identical to SEQ ID NO: 9405
  misc_feature 1..36: note = chr8:12808858-12808894
  misc_feature 1..36: note = hyper
  source 1..36: mol_type = genomic DNA

SEQ ID NO: 19955 - DNA, 247 bp, Homo sapiens; identical to SEQ ID NO: 9406
  misc_feature 1..247: note = chr8:12989381-12989628
  misc_feature 1..247: note = hyper
  source 1..247: mol_type = genomic DNA

SEQ ID NO: 19956 - DNA, 236 bp, Homo sapiens; identical to SEQ ID NO: 9407
  misc_feature 1..236: note = chr8:12991090-12991326
  misc_feature 1..236: note = hyper
  source 1..236: mol_type = genomic DNA

SEQ ID NO: 19957 - DNA, 72 bp, Homo sapiens
  misc_feature 1..72: note = chr8:15094433-15094505
  misc_feature 1..72: note = hyper
  source 1..72: mol_type = genomic DNA
ccccggacctgctcccgcgcctggggctagggcaggctagccgtccccggcagcgggggtacctctccagcc

SEQ ID NO: 19958 - DNA, 93 bp, Homo sapiens; identical to SEQ ID NO: 9409
  misc_feature 1..93: note = chr8:16859361-16859454
  misc_feature 1..93: note = hyper
  source 1..93: mol_type = genomic DNA

SEQ ID NO: 19959 - DNA, 30 bp, Homo sapiens; identical to SEQ ID NO: 9410
  misc_feature 1..30: note = chr8:16884436-16884466
  misc_feature 1..30: note = hyper
  source 1..30: mol_type = genomic DNA

SEQ ID NO: 19960 - DNA, 30 bp, Homo sapiens; identical to SEQ ID NO: 9411
  misc_feature 1..30: note = chr8:16884959-16884989
  misc_feature 1..30: note = hyper
  source 1..30: mol_type = genomic DNA

SEQ ID NO: 19961 - DNA, 73 bp, Homo sapiens
  misc_feature 1..73: note = chr8:19797866-19797939
  misc_feature 1..73: note = hyper
  source 1..73: mol_type = genomic DNA
ggctgaggtcagctccgggcgcccggccccgccgcgcggctgcgagcacgtggggttgacgggcgccgcgtgg

SEQ ID NO: 19962 - DNA, 149 bp, Homo sapiens; identical to SEQ ID NO: 9413
  misc_feature 1..149: note = chr8:20161245-20161394
  misc_feature 1..149: note = hyper
  source 1..149: mol_type = genomic DNA

SEQ ID NO: 19963 - DNA, 34 bp, Homo sapiens; identical to SEQ ID NO: 9414
  misc_feature 1..34: note = chr8:20161617-20161651
  misc_feature 1..34: note = hyper
  source 1..34: mol_type = genomic DNA

SEQ ID NO: 19964 - DNA, 32 bp, Homo sapiens; identical to SEQ ID NO: 9415
  misc_feature 1..32: note = chr8:20161666-20161698
  misc_feature 1..32: note = hyper
  source 1..32: mol_type = genomic DNA

SEQ ID NO: 19965 - DNA, 30 bp, Homo sapiens; identical to SEQ ID NO: 9416
  misc_feature 1..30: note = chr8:22613837-22613867
  misc_feature 1..30: note = hyper
  source 1..30: mol_type = genomic DNA

SEQ ID NO: 19966 - DNA, 59 bp, Homo sapiens
  misc_feature 1..59: note = chr8:22960723-22960782
  misc_feature 1..59: note = hyper
  source 1..59: mol_type = genomic DNA
gaagagcgcacctggcgccgggagggggcagggagacggggacacggcagggatgcctg

SEQ ID NO: 19967 - DNA, 147 bp, Homo sapiens; identical to SEQ ID NO: 9418
  misc_feature 1..147: note = chr8:23021380-23021527
  misc_feature 1..147: note = hyper
  source 1..147: mol_type = genomic DNA

SEQ ID NO: 19968 - DNA, 123 bp, Homo sapiens
  misc_feature 1..123: note = chr8:23260870-23260993
  misc_feature 1..123: note = hyper
  source 1..123: mol_type = genomic DNA
aggactcacggcgctcccgcgctcccaacagcctttcgagcaggctgggggttgaaccgggttcaagcagtggacgctacagctcccgggcgcagcccccggggtccccgcccccactccgtc

SEQ ID NO: 19969 - DNA, 160 bp, Homo sapiens; identical to SEQ ID NO: 9420
  misc_feature 1..160: note = chr8:23261393-23261553
  misc_feature 1..160: note = hyper
  source 1..160: mol_type = genomic DNA

SEQ ID NO: 19970 - DNA, 112 bp, Homo sapiens
  misc_feature 1..112: note = chr8:23560525-23560637
  misc_feature 1..112: note = hyper
  source 1..112: mol_type = genomic DNA
ctgttgccaacgccgcgctctggcaccctggtcccgccgccgaggggcgaggccgcgttcaggccgggctctaaaagcacaggaagggacacatcagcgcccagcctaaggc

SEQ ID NO: 19971 - DNA, 36 bp, Homo sapiens
  misc_feature 1..36: note = chr8:23565024-23565060
  misc_feature 1..36: note = hyper
  source 1..36: mol_type = genomic DNA
tctcctttatcctccttaaagcggattgcctggagc

SEQ ID NO: 19972 - DNA, 55 bp, Homo sapiens
  misc_feature 1..55: note = chr8:23572554-23572609
  misc_feature 1..55: note = hyper
  source 1..55: mol_type = genomic DNA
acacacattgctgaccttgagggtcagacagaccctttctcgtctagtttttagc

SEQ ID NO: 19973 - DNA, 46 bp, Homo sapiens; identical to SEQ ID NO: 3213
  misc_feature 1..46: note = chr8:23583971-23584017
  misc_feature 1..46: note = hyper
  source 1..46: mol_type = genomic DNA

SEQ ID NO: 19974 - DNA, 14 bp, Homo sapiens
  misc_feature 1..14: note = chr8:23584760-23584774
  misc_feature 1..14: note = hyper
  source 1..14: mol_type = genomic DNA
gcccaccctgagca

SEQ ID NO: 19975 - DNA, 21 bp, Homo sapiens
  misc_feature 1..21: note = chr8:24770293-24770314
  misc_feature 1..21: note = hyper
  source 1..21: mol_type = genomic DNA
gggtgacaagccccccgggtg

SEQ ID NO: 19976 - DNA, 213 bp, Homo sapiens; identical to SEQ ID NO: 3216
  misc_feature 1..213: note = chr8:24770912-24771125
  misc_feature 1..213: note = hyper
  source 1..213: mol_type = genomic DNA

SEQ ID NO: 19977 - DNA, 82 bp, Homo sapiens
  misc_feature 1..82: note = chr8:24771349-24771431
  misc_feature 1..82: note = hyper
  source 1..82: mol_type = genomic DNA
ggcgggtaaccgagacccgctcgagcttcagccgcgtcagcggctccccgtccagtggcttccgctcgcagtcgtggtcccg

SEQ ID NO: 19978 - DNA, 177 bp, Homo sapiens
  misc_feature 1..177: note = chr8:24813287-24813464
  misc_feature 1..177: note = hyper
  source 1..177: mol_type = genomic DNA
ccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccct

SEQ ID NO: 19979 - DNA, 132 bp, Homo sapiens
  misc_feature 1..132: note = chr8:24813618-24813750
  misc_feature 1..132: note = hyper
  source 1..132: mol_type = genomic DNA
cgcccggaagcgggatggctcggagtgcttctggcgcagcaccagcagctcggcttccaggaccttgttctgctgctccagctcgtgcacgcgctcgatgaagctggcgaagcggtcattgaggtcctggag

SEQ ID NO: 19980 - DNA, 21 bp, Homo sapiens
  misc_feature 1..21: note = chr8:24814407-24814428
  misc_feature 1..21: note = hyper
  source 1..21: mol_type = genomic DNA
agaccccgtgacacttggatc

SEQ ID NO: 19981 - DNA, 108 bp, Homo sapiens; identical to SEQ ID NO: 9439
  misc_feature 1..108: note = chr8:24815208-24815316
  misc_feature 1..108: note = hyper
  source 1..108: mol_type = genomic DNA

SEQ ID NO: 19982 - DNA, 150 bp, Homo sapiens
  misc_feature 1..150: note = chr8:24857626-24857776
  misc_feature 1..150: note = hyper
  source 1..150: mol_type = genomic DNA
gtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttaca

SEQ ID NO: 19983 - DNA, 232 bp, Homo sapiens
  misc_feature 1..232: note = chr8:24857808-24858040
  misc_feature 1..232: note = hyper
  source 1..232: mol_type = genomic DNA
acactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagct

SEQ ID NO: 19984 - DNA, 209 bp, Homo sapiens
  misc_feature 1..209: note = chr8:24858647-24858856
  misc_feature 1..209: note = hyper
  source 1..209: mol_type = genomic DNA
gctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcct

SEQ ID NO: 19985 - DNA, 82 bp, Homo sapiens
  misc_feature 1..82: note = chr8:25901765-25901847
  misc_feature 1..82: note = hyper
  source 1..82: mol_type = genomic DNA
gccggcctcccaggctccaggaatcgcccagcaagatgcgggaggtaggcgctcgcaggcggcgtggcgaagccaagagtgg

SEQ ID NO: 19986 - DNA, 33 bp, Homo sapiens
  misc_feature 1..33: note = chr8:25902113-25902146
  misc_feature 1..33: note = hyper
  source 1..33: mol_type = genomic DNA
cgcgcagggcctgggcgacagatggggggacag

SEQ ID NO: 19987 - DNA, 157 bp, Homo sapiens
  misc_feature 1..157: note = chr8:25904191-25904348
  misc_feature 1..157: note = hyper
  source 1..157: mol_type = genomic DNA
agagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcggg

SEQ ID NO: 19988 - DNA, 318 bp, Homo sapiens; identical to SEQ ID NO: 9451
  misc_feature 1..318: note = chr8:25905311-25905629
  misc_feature 1..318: note = hyper
  source 1..318: mol_type = genomic DNA

SEQ ID NO: 19989 - DNA, 67 bp, Homo sapiens
  misc_feature 1..67: note = chr8:25905695-25905762
  misc_feature 1..67: note = hyper
  source 1..67: mol_type = genomic DNA
cgatctcgtgcaacacaaaacctgccccgagctgtgcgggggcctggcaagcgcagctgcggccccg

SEQ ID NO: 19990 - DNA, 38 bp, Homo sapiens; identical to SEQ ID NO: 9453
  misc_feature 1..38: note = chr8:25907271-25907309
  misc_feature 1..38: note = hyper
  source 1..38: mol_type = genomic DNA

SEQ ID NO: 19991 - DNA, 15 bp, Homo sapiens
  misc_feature 1..15: note = chr8:26372893-26372908
  misc_feature 1..15: note = hyper
  source 1..15: mol_type = genomic DNA
cgctccccaaaccgc

SEQ ID NO: 19992 - DNA, 44 bp, Homo sapiens; identical to SEQ ID NO: 9456
  misc_feature 1..44: note = chr8:26723005-26723049
  misc_feature 1..44: note = hyper
  source 1..44: mol_type = genomic DNA

SEQ ID NO: 19993 - DNA, 311 bp, Homo sapiens
  misc_feature 1..311: note = chr8:26723674-26723985
  misc_feature 1..311: note = hyper
  source 1..311: mol_type = genomic DNA
gcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcg

SEQ ID NO: 19994 - DNA, 50 bp, Homo sapiens; identical to SEQ ID NO: 9458
  misc_feature 1..50: note = chr8:26724529-26724579
  misc_feature 1..50: note = hyper
  source 1..50: mol_type = genomic DNA

SEQ ID NO: 19995 - DNA, 246 bp, Homo sapiens
  misc_feature 1..246: note = chr8:30769411-30769657
  misc_feature 1..246: note = hyper
  source 1..246: mol_type = genomic DNA
agtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcaccta

SEQ ID NO: 19996 - DNA, 34 bp, Homo sapiens; identical to SEQ ID NO: 9460
  misc_feature 1..34: note = chr8:31496785-31496819
  misc_feature 1..34: note = hyper
  source 1..34: mol_type = genomic DNA

SEQ ID NO: 19997 - DNA, 31 bp, Homo sapiens
  misc_feature 1..31: note = chr8:31497468-31497499
  misc_feature 1..31: note = hyper
  source 1..31: mol_type = genomic DNA
cgacagccagaagcccgcacgcacctcgcac

SEQ ID NO: 19998 - DNA, 211 bp, Homo sapiens; identical to SEQ ID NO: 9462
  misc_feature 1..211: note = chr8:31497750-31497961
  misc_feature 1..211: note = hyper
  source 1..211: mol_type = genomic DNA

SEQ ID NO: 19999 - DNA, 135 bp, Homo sapiens; identical to SEQ ID NO: 9463
  misc_feature 1..135: note = chr8:32404798-32404933
  misc_feature 1..135: note = hyper
  source 1..135: mol_type = genomic DNA

SEQ ID NO: 20000 - DNA, 37 bp, Homo sapiens; identical to SEQ ID NO: 9464
  misc_feature 1..37: note = chr8:32405476-32405513
  misc_feature 1..37: note = hyper
  source 1..37: mol_type = genomic DNA

SEQ ID NO: 20001 - DNA, 66 bp, Homo sapiens
  misc_feature 1..66: note = chr8:32406532-32406598
  misc_feature 1..66: note = hyper
  source 1..66: mol_type = genomic DNA
cctaccgggcgcctacgcccagagctcagggcaagggacagcagtcccggccgcaccctcccagag

SEQ ID NO: 20002 - DNA, 14 bp, Homo sapiens
  misc_feature 1..14: note = chr8:32406914-32406928
  misc_feature 1..14: note = hyper
  source 1..14: mol_type = genomic DNA
cagtcctgtgctac

SEQ ID NO: 20003 - DNA, 53 bp, Homo sapiens; identical to SEQ ID NO: 9466
  misc_feature 1..53: note = chr8:32406929-32406982
  misc_feature 1..53: note = hyper
  source 1..53: mol_type = genomic DNA

SEQ ID NO: 20004 - DNA, 176 bp, Homo sapiens; identical to SEQ ID NO: 9467
  misc_feature 1..176: note = chr8:33371806-33371982
  misc_feature 1..176: note = hyper
  source 1..176: mol_type = genomic DNA

SEQ ID NO: 20005 - DNA, 43 bp, Homo sapiens; identical to SEQ ID NO: 9469
  misc_feature 1..43: note = chr8:35093236-35093279
  misc_feature 1..43: note = hyper
  source 1..43: mol_type = genomic DNA

SEQ ID NO: 20006 - DNA, 12 bp, Homo sapiens
  misc_feature 1..12: note = chr8:37655798-37655810
  misc_feature 1..12: note = hyper
  source 1..12: mol_type = genomic DNA
ttcgcgcaaaga

SEQ ID NO: 20007 - DNA, 116 bp, Homo sapiens
  misc_feature 1..116: note = chr8:37656081-37656197
  misc_feature 1..116: note = hyper
  source 1..116: mol_type = genomic DNA
cgggcccccgcggccgccgcttcctttcctgtcccaaatccagcctaagagccgcttccctttccctgtcctcctgaccccagtggcaaccgtttctccaccgccccttgcccgca

SEQ ID NO: 20008 - DNA, 25 bp, Homo sapiens
  misc_feature 1..25: note = chr8:38008209-38008234
  misc_feature 1..25: note = hyper
  source 1..25: mol_type = genomic DNA
ggcctgagcctcatccgctgagagc

SEQ ID NO: 20009 - DNA, 41 bp, Homo sapiens
  misc_feature 1..41: note = chr8:38008557-38008598
  misc_feature 1..41: note = hyper
  source 1..41: mol_type = genomic DNA
tgcaaaggaaggggtcaaggatagagcgattgcctcacact

SEQ ID NO: 20010 - DNA, 158 bp, Homo sapiens; identical to SEQ ID NO: 9476
  misc_feature 1..158: note = chr8:38323407-38323565
  misc_feature 1..158: note = hyper
  source 1..158: mol_type = genomic DNA

SEQ ID NO: 20011 - DNA, 111 bp, Homo sapiens
  misc_feature 1..111: note = chr8:38323800-38323911
  misc_feature 1..111: note = hyper
  source 1..111: mol_type = genomic DNA
cagccgagaggggaccgcgggctccgggcagggcaggcgctcccgcagctccagctataacacaagggagagaaagcaacgctttggttccagaaacttccatcgtcaagg

SEQ ID NO: 20012 - DNA, 214 bp, Homo sapiens
  misc_feature 1..214: note = chr8:38323941-38324155
  misc_feature 1..214: note = hyper
  source 1..214: mol_type = genomic DNA
cccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtct

SEQ ID NO: 20013 - DNA, 229 bp, Homo sapiens
  misc_feature 1..229: note = chr8:41166745-41166974
  misc_feature 1..229: note = hyper
  source 1..229: mol_type = genomic DNA
cgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggc

SEQ ID NO: 20014 - DNA, 88 bp, Homo sapiens
  misc_feature 1..88: note = chr8:41167035-41167123
  misc_feature 1..88: note = hyper
  source 1..88: mol_type = genomic DNA
atcagctcccggcggggcgagccgcactcgttaccacgtccgtcaccggcgcgggagccaatcgcctccctcgcgagcgggttcggtt

SEQ ID NO: 20015 - DNA, 378 bp, Homo sapiens; identical to SEQ ID NO: 9484
  misc_feature 1..378: note = chr8:41503901-41504279
  misc_feature 1..378: note = hyper
  source 1..378: mol_type = genomic DNA

SEQ ID NO: 20016 - DNA, 11 bp, Homo sapiens
  misc_feature 1..11: note = chr8:41624550-41624561
  misc_feature 1..11: note = hyper
  source 1..11: mol_type = genomic DNA
ctccacgctcc

SEQ ID NO: 20017 - DNA, 103 bp, Homo sapiens; identical to SEQ ID NO: 9486
  misc_feature 1..103: note = chr8:41624633-41624736
  misc_feature 1..103: note = hyper
  source 1..103: mol_type = genomic DNA

SEQ ID NO: 20018 - DNA, 54 bp, Homo sapiens; identical to SEQ ID NO: 9487
  misc_feature 1..54: note = chr8:41625007-41625061
  misc_feature 1..54: note = hyper
  source 1..54: mol_type = genomic DNA

SEQ ID NO: 20019 - DNA, 144 bp, Homo sapiens; identical to SEQ ID NO: 9488
  misc_feature 1..144: note = chr8:41686308-41686452
  misc_feature 1..144: note = hyper
  source 1..144: mol_type = genomic DNA

SEQ ID NO: 20020 - DNA, 56 bp, Homo sapiens
  misc_feature 1..56: note = chr8:41733449-41733505
  misc_feature 1..56: note = hyper
  source 1..56: mol_type = genomic DNA
ccagaggggccggcgcgcgcccgggcgcacactcgcacacctgcccgcgcgcacac

SEQ ID NO: 20021 - DNA, 14 bp, Homo sapiens
  misc_feature 1..14: note = chr8:41733640-41733654
  misc_feature 1..14: note = hyper
  source 1..14: mol_type = genomic DNA
agagctcggagcgg

SEQ ID NO: 20022 - DNA, 92 bp, Homo sapiens; identical to SEQ ID NO: 9490
  misc_feature 1..92: note = chr8:41733684-41733776
  misc_feature 1..92: note = hyper
  source 1..92: mol_type = genomic DNA

SEQ ID NO: 20023 - DNA, 268 bp, Homo sapiens
  misc_feature 1..268: note = chr8:41753325-41753593
  misc_feature 1..268: note = hyper
  source 1..268: mol_type = genomic DNA
ggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggt

SEQ ID NO: 20024 - DNA, 382 bp, Homo sapiens
  misc_feature 1..382: note = chr8:41753770-41754152
  misc_feature 1..382: note = hyper
  source 1..382: mol_type = genomic DNA
cgggcgccgcgccccaccgcgtcccgggccgcccgacccctgcccccagcagccacttgcaggtgccgcggtcgctgggctttcaccgccgccccctcctaccttcttctttcggtcacgggagcggtttctccgcttcctgttggattcctccttctccttctgctcctggagggcctgcgcctcgatgtctttgattttcttcagctgtttggccgcttgagccatggcgggtcacggcgctcccgtccccgcctcctggacccctagcgctcagcgatccccgaggcgacaccccctaagaaggggaagggggtctctgctccacagaggggacagcgttcgtggcgccccgagggccggctgctgcggggtcgcggga

SEQ ID NO: 20025 - DNA, 293 bp, Homo sapiens
  misc_feature 1..293: note = chr8:41754885-41755178
  misc_feature 1..293: note = hyper
  source 1..293: mol_type = genomic DNA
ttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgc

SEQ ID NO: 20026 - DNA, 40 bp, Homo sapiens; identical to SEQ ID NO: 9494
  misc_feature 1..40: note = chr8:42009967-42010007
  misc_feature 1..40: note = hyper
  source 1..40: mol_type = genomic DNA

SEQ ID NO: 20027 - DNA, 36 bp, Homo sapiens; identical to SEQ ID NO: 9495
  misc_feature 1..36: note = chr8:43102519-43102555
  misc_feature 1..36: note = hyper
  source 1..36: mol_type = genomic DNA

SEQ ID NO: 20028-20029 - skipped (2 entries)

SEQ ID NO: 20030 - DNA, 64 bp, Homo sapiens
  misc_feature 1..64: note = chr8:49469127-49469191
  misc_feature 1..64: note = hyper
  source 1..64: mol_type = genomic DNA
gcagtcttgctttgaatttaaacagcgaagaagccagagggtcctgttccgtatggggggaggg

SEQ ID NO: 20031 - DNA, 34 bp, Homo sapiens; identical to SEQ ID NO: 9501
  misc_feature 1..34: note = chr8:49647817-49647851
  misc_feature 1..34: note = hyper
  source 1..34: mol_type = genomic DNA

SEQ ID NO: 20032 - DNA, 189 bp, Homo sapiens; identical to SEQ ID NO: 9502
  misc_feature 1..189: note = chr8:49782697-49782886
  misc_feature 1..189: note = hyper
  source 1..189: mol_type = genomic DNA

SEQ ID NO: 20033 - DNA, 30 bp, Homo sapiens; identical to SEQ ID NO: 9503
  misc_feature 1..30: note = chr8:49834319-49834349
  misc_feature 1..30: note = hyper
  source 1..30: mol_type = genomic DNA

SEQ ID NO: 20034 - DNA, 30 bp, Homo sapiens; identical to SEQ ID NO: 9504
  misc_feature 1..30: note = chr8:49834685-49834715
  misc_feature 1..30: note = hyper
  source 1..30: mol_type = genomic DNA

SEQ ID NO: 20035 - DNA, 25 bp, Homo sapiens
  misc_feature 1..25: note = chr8:50822308-50822333
  misc_feature 1..25: note = hyper
  source 1..25: mol_type = genomic DNA
acagcgaccgcggcctgcaatgtgc

SEQ ID NO: 20036 - DNA, 30 bp, Homo sapiens; identical to SEQ ID NO: 9506
  misc_feature 1..30: note = chr8:50822561-50822591
  misc_feature 1..30: note = hyper
  source 1..30: mol_type = genomic DNA

SEQ ID NO: 20037 - DNA, 36 bp, Homo sapiens; identical to SEQ ID NO: 9507
  misc_feature 1..36: note = chr8:50823108-50823144
  misc_feature 1..36: note = hyper
  source 1..36: mol_type = genomic DNA

SEQ ID NO: 20038 - DNA, 15 bp, Homo sapiens
  misc_feature 1..15: note = chr8:50824293-50824308
  misc_feature 1..15: note = hyper
  source 1..15: mol_type = genomic DNA
ctgcagccacaggga

SEQ ID NO: 20039 - DNA, 20 bp, Homo sapiens
  misc_feature 1..20: note = chr8:50824352-50824372
  misc_feature 1..20: note = hyper
  source 1..20: mol_type = genomic DNA
cgccacgggcagctgggcta

SEQ ID NO: 20040 - DNA, 49 bp, Homo sapiens; identical to SEQ ID NO: 9511
  misc_feature 1..49: note = chr8:53477121-53477170
  misc_feature 1..49: note = hyper
  source 1..49: mol_type = genomic DNA

SEQ ID NO: 20041 - DNA, 30 bp, Homo sapiens; identical to SEQ ID NO: 9514
  misc_feature 1..30: note = chr8:53853779-53853809
  misc_feature 1..30: note = hyper
  source 1..30: mol_type = genomic DNA

SEQ ID NO: 20042 - DNA, 21 bp, Homo sapiens
  misc_feature 1..21: note = chr8:54789257-54789278
  misc_feature 1..21: note = hyper
  source 1..21: mol_type = genomic DNA
cctaactggagaagccgctgg

SEQ ID NO: 20043 - DNA, 19 bp, Homo sapiens
  misc_feature 1..19: note = chr8:54789613-54789632
  misc_feature 1..19: note = hyper
  source 1..19: mol_type = genomic DNA
aacatgagctggagacgcc

SEQ ID NO: 20044 - DNA, 214 bp, Homo sapiens
  misc_feature 1..214: note = chr8:54790077-54790291
  misc_feature 1..214: note = hyper
  source 1..214: mol_type = genomic DNA
tccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaa

SEQ ID NO: 20045 - DNA, 397 bp, Homo sapiens
  misc_feature 1..397: note = chr8:54792237-54792634
  misc_feature 1..397: note = hyper
  source 1..397: mol_type = genomic DNA
ccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctcc

SEQ ID NO: 20046 - DNA, 368 bp, Homo sapiens
  misc_feature 1..368: note = chr8:54792760-54793128
  misc_feature 1..368: note = hyper
  source 1..368: mol_type = genomic DNA
tactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattca

SEQ ID NO: 20047 - DNA, 161 bp, Homo sapiens; identical to SEQ ID NO: 9524
  misc_feature 1..161: note = chr8:54793349-54793510
  misc_feature 1..161: note = hyper
  source 1..161: mol_type = genomic DNA

SEQ ID NO: 20048 - DNA, 126 bp, Homo sapiens; identical to SEQ ID NO: 9525
  misc_feature 1..126: note = chr8:54793756-54793882
  misc_feature 1..126: note = hyper
  source 1..126: mol_type = genomic DNA

SEQ ID NO: 20049 - DNA, 50 bp, Homo sapiens
  misc_feature 1..50: note = chr8:54794167-54794217
  misc_feature 1..50: note = hyper
  source 1..50: mol_type = genomic DNA
ccagggcaggggcaccgaggggcagggtgaggaagtggacgccccacgcg

SEQ ID NO: 20050 - DNA, 57 bp, Homo sapiens
  misc_feature 1..57: note = chr8:54794327-54794384
  misc_feature 1..57: note = hyper
  source 1..57: mol_type = genomic DNA
agttaacgtgcaggcgccgccgggattttcctggaacaaacccgggcacttgatctt

SEQ ID NO: 20051 - DNA, 66 bp, Homo sapiens
  misc_feature 1..66: note = chr8:54794647-54794713
  misc_feature 1..66: note = hyper
  source 1..66: mol_type = genomic DNA
tccccacacccagctcgggcggaggagccctgagagaagcggctagctgagagtggggtgggcgtt

SEQ ID NO: 20052 - DNA, 23 bp, Homo sapiens
  misc_feature 1..23: note = chr8:55366165-55366188
  misc_feature 1..23: note = hyper
  source 1..23: mol_type = genomic DNA
aagagggaagtggaccgggaaca

SEQ ID NO: 20053 - skipped

SEQ ID NO: 20054 - DNA, 29 bp, Homo sapiens
  misc_feature 1..29: note = chr8:55379202-55379231
  misc_feature 1..29: note = hyper
  source 1..29: mol_type = genomic DNA
ctcttagcttggtgccggggcccgcccgg

SEQ ID NO: 20055 - DNA, 108 bp, Homo sapiens; identical to SEQ ID NO: 3262
  misc_feature 1..108: note = chr8:55380036-55380144
  misc_feature 1..108: note = hyper
  source 1..108: mol_type = genomic DNA

SEQ ID NO: 20056 - DNA, 26 bp, Homo sapiens
  misc_feature 1..26: note = chr8:56014131-56014157
  misc_feature 1..26: note = hyper
  source 1..26: mol_type = genomic DNA
ccgagcccgggcgcccgagttacacc

SEQ ID NO: 20057 - DNA, 247 bp, Homo sapiens
  misc_feature 1..247: note = chr8:56014376-56014623
  misc_feature 1..247: note = hyper
  source 1..247: mol_type = genomic DNA
cgttccgaaatcccgggagtgggggccttcgactgtcaccctcaggcccccttggccgctcctcccggcccttgggacccgccagggcagtcccccaacccccgcccgccgctcctctcggtcccggcccctcctccgggtccctcctcctccctcgcccctcccgagccagggtgggagcgacggcagctggaagagaagggatgaggtcatcctctccctcggagtcagctggtggaggagagga

SEQ ID NO: 20058 - skipped

SEQ ID NO: 20059 - DNA, 13 bp, Homo sapiens
  misc_feature 1..13: note = chr8:56015619-56015632
  misc_feature 1..13: note = hyper
  source 1..13: mol_type = genomic DNA
attgcaagacggt

SEQ ID NO: 20060 - DNA, 27 bp, Homo sapiens
  misc_feature 1..27: note = chr8:57026141-57026168
  misc_feature 1..27: note = hyper
  source 1..27: mol_type = genomic DNA
ggctattggaccctgcgggcgtgcgcg

SEQ ID NO: 20061 - DNA, 109 bp, Homo sapiens
  misc_feature 1..109: note = chr8:57026213-57026322
  misc_feature 1..109: note = hyper
  source 1..109: mol_type = genomic DNA
ctacgttgagctcagcccagaaactccgccgagatgctagtcggttcttggtgcacttgttcacttgctttatggccacaggaacaccgcggtaagtcgccttgtacac

SEQ ID NO: 20062-20063 - skipped (2 entries)

SEQ ID NO: 20064 - DNA, 180 bp, Homo sapiens; identical to SEQ ID NO: 9555
  misc_feature 1..180: note = chr8:57232591-57232771
  misc_feature 1..180: note = hyper
  source 1..180: mol_type = genomic DNA

SEQ ID NO: 20065 - DNA, 23 bp, Homo sapiens
  misc_feature 1..23: note = chr8:57359636-57359659
  misc_feature 1..23: note = hyper
  source 1..23: mol_type = genomic DNA
ccccctcgcgggtccccgtgggc

SEQ ID NO: 20066 - DNA, 30 bp, Homo sapiens
  misc_feature 1..30: note = chr8:57360540-57360570
  misc_feature 1..30: note = hyper
  source 1..30: mol_type = genomic DNA
tttccaggccctctgcgccctctgcaaagg

SEQ ID NO: 20067 - DNA, 15 bp, Homo sapiens
  misc_feature 1..15: note = chr8:57360791-57360806
  misc_feature 1..15: note = hyper
  source 1..15: mol_type = genomic DNA
cggggcatcacggta

SEQ ID NO: 20068 - DNA, 29 bp, Homo sapiens
  misc_feature 1..29: note = chr8:58907390-58907419
  misc_feature 1..29: note = hyper
  source 1..29: mol_type = genomic DNA
agagagactgctgggcgggggttgggatt

SEQ ID NO: 20069 - DNA, 215 bp, Homo sapiens
  misc_feature 1..215: note = chr8:58907483-58907698
  misc_feature 1..215: note = hyper
  source 1..215: mol_type = genomic DNA
cgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccg

SEQ ID NO: 20070 - DNA, 106 bp, Homo sapiens
  misc_feature 1..106: note = chr8:58907835-58907941
  misc_feature 1..106: note = hyper
  source 1..106: mol_type = genomic DNA
tctaatctcggtgttaaatactttatgagagtatcaataccacctaatcctttgctgagaattactgctagaaatgtagattctgaggttccgaaagtttgttttt

SEQ ID NO: 20071 - DNA, 37 bp, Homo sapiens; identical to SEQ ID NO: 9563
  misc_feature 1..37: note = chr8:60030268-60030305
  misc_feature 1..37: note = hyper
  source 1..37: mol_type = genomic DNA

SEQ ID NO: 20072 - DNA, 71 bp, Homo sapiens; identical to SEQ ID NO: 9564
  misc_feature 1..71: note = chr8:60030539-60030610
  misc_feature 1..71: note = hyper
  source 1..71: mol_type = genomic DNA

SEQ ID NO: 20073 - DNA, 65 bp, Homo sapiens; identical to SEQ ID NO: 9565
  misc_feature 1..65: note = chr8:60030824-60030889
  misc_feature 1..65: note = hyper
  source 1..65: mol_type = genomic DNA

SEQ ID NO: 20074 - DNA, 61 bp, Homo sapiens; identical to SEQ ID NO: 9566
  misc_feature 1..61: note = chr8:60031205-60031266
  misc_feature 1..61: note = hyper
  source 1..61: mol_type = genomic DNA

SEQ ID NO: 20075 - DNA, 75 bp, Homo sapiens; identical to SEQ ID NO: 9567
  misc_feature 1..75: note = chr8:60031479-60031554
  misc_feature 1..75: note = hyper
  source 1..75: mol_type = genomic DNA

SEQ ID NO: 20076 - DNA, 89 bp, Homo sapiens; identical to SEQ ID NO: 9568
  misc_feature 1..89: note = chr8:60032140-60032229
  misc_feature 1..89: note = hyper
  source 1..89: mol_type = genomic DNA

SEQ ID NO: 20077 - DNA, 190 bp, Homo sapiens
  misc_feature 1..190: note = chr8:60032490-60032680
  misc_feature 1..190: note = hyper
  source 1..190: mol_type = genomic DNA
tcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctct

SEQ ID NO: 20078 - DNA, 391 bp, Homo sapiens; identical to SEQ ID NO: 9570
  misc_feature 1..391: note = chr8:61193203-61193594
  misc_feature 1..391: note = hyper
  source 1..391: mol_type = genomic DNA

SEQ ID NO: 20079 - DNA, 30 bp, Homo sapiens
  misc_feature 1..30: note = chr8:62200776-62200806
  misc_feature 1..30: note = hyper
  source 1..30: mol_type = genomic DNA
ggcgtttcagcacttcggtatgtggacagc

SEQ ID NO: 20080 - DNA, 171 bp, Homo sapiens; identical to SEQ ID NO: 9572
  misc_feature 1..171: note = chr8:63160730-63160901
  misc_feature 1..171: note = hyper
  source 1..171: mol_type = genomic DNA

SEQ ID NO: 20081 - DNA, 27 bp, Homo sapiens
  misc_feature 1..27: note = chr8:63161631-63161658
  misc_feature 1..27: note = hyper
  source 1..27: mol_type = genomic DNA
catgggctgctgcaccggacgctgctc

SEQ ID NO: 20082 - DNA, 32 bp, Homo sapiens; identical to SEQ ID NO: 9574
  misc_feature 1..32: note = chr8:63998517-63998549
  misc_feature 1..32: note = hyper
  source 1..32: mol_type = genomic DNA

SEQ ID NO: 20083 - DNA, 82 bp, Homo sapiens; identical to SEQ ID NO: 9575
  misc_feature 1..82: note = chr8:65281329-65281411
  misc_feature 1..82: note = hyper
  source 1..82: mol_type = genomic DNA

SEQ ID NO: 20084 - DNA, 124 bp, Homo sapiens
  misc_feature 1..124: note = chr8:65286558-65286682
  misc_feature 1..124: note = hyper
  source 1..124: mol_type = genomic DNA
cctagaatggagccccggccagccgcgggccgggccccttggttttcaggacttattcttgccggggttggctcgcacgccagcatcgcgccttcggtgcgtcttttatctccatctcaaatat

SEQ ID NO: 20085 - DNA, 21 bp, Homo sapiens
  misc_feature 1..21: note = chr8:65286942-65286963
  misc_feature 1..21: note = hyper
  source 1..21: mol_type = genomic DNA
agaaagtagccttctcgtgcc

SEQ ID NO: 20086 - DNA, 74 bp, Homo sapiens
  misc_feature 1..74: note = chr8:65289049-65289123
  misc_feature 1..74: note = hyper
  source 1..74: mol_type = genomic DNA
tttagttttagacaacgtattcaaagtacttgagaagaatatgcaatgacattttttccgtgtcctaatcagga

SEQ ID NO: 20087 - DNA, 112 bp, Homo sapiens
  misc_feature 1..112: note = chr8:65289241-65289353
  misc_feature 1..112: note = hyper
  source 1..112: mol_type = genomic DNA
gataagattaaacataaacctaaaccttggcctcgggggaaggcaggctgcggggttgagaagaggagatgcagattagctctgcttttgctgcttgcgcacataattaaga

SEQ ID NO: 20088 - DNA, 22 bp, Homo sapiens
  misc_feature 1..22: note = chr8:65289592-65289614
  misc_feature 1..22: note = hyper
  source 1..22: mol_type = genomic DNA
gagaggctggaagctcgacgtc

SEQ ID NO: 20089 - DNA, 30 bp, Homo sapiens; identical to SEQ ID NO: 9585
  misc_feature 1..30: note = chr8:65291776-65291806
  misc_feature 1..30: note = hyper
  source 1..30: mol_type = genomic DNA

SEQ ID NO: 20090 - DNA, 146 bp, Homo sapiens
  misc_feature 1..146: note = chr8:65493433-65493579
  misc_feature 1..146: note = hyper
  source 1..146: mol_type = genomic DNA
gcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 20091 - DNA, 149 bp, Homo sapiens; identical to SEQ ID NO: 3283
  misc_feature 1..149: note = chr8:65493806-65493955
  misc_feature 1..149: note = hyper
  source 1..149: mol_type = genomic DNA

SEQ ID NO: 20092 - DNA, 66 bp, Homo sapiens
  misc_feature 1..66: note = chr8:65498500-65498566
  misc_feature 1..66: note = hyper
  source 1..66: mol_type = genomic DNA
gcaaatgatcatcttcgatagagctctctagttacccgtgcttctccctccctatggtatgtgttt

SEQ ID NO: 20093 - skipped

SEQ ID NO: 20094 - DNA, 30 bp, Homo sapiens; identical to SEQ ID NO: 9597
  misc_feature 1..30: note = chr8:67089781-67089811
  misc_feature 1..30: note = hyper
  source 1..30: mol_type = genomic DNA

SEQ ID NO: 20095 - skipped

SEQ ID NO: 20096 - DNA, 89 bp, Homo sapiens
  misc_feature 1..89: note = chr8:67940875-67940964
  misc_feature 1..89: note = hyper
  source 1..89: mol_type = genomic DNA
ccccggtgggtccttcccctgtgaggcggcggccgggcgctgatgggcactgacggtggtcactaggccgactccgactagagtcctgt

SEQ ID NO: 20097 - DNA, 33 bp, Homo sapiens
  misc_feature 1..33: note = chr8:68864545-68864578
  misc_feature 1..33: note = hyper
  source 1..33: mol_type = genomic DNA
cgccgccgggggccgggcagcagcgggcgcgcg

SEQ ID NO: 20098 - DNA, 38 bp, Homo sapiens
  misc_feature 1..38: note = chr8:68864765-68864803
  misc_feature 1..38: note = hyper
  source 1..38: mol_type = genomic DNA
tgtcggtgagtgtccccggcagacgcagggggacgtcc

SEQ ID NO: 20099 - DNA, 37 bp, Homo sapiens; identical to SEQ ID NO: 9609
  misc_feature 1..37: note = chr8:68865398-68865435
  misc_feature 1..37: note = hyper
  source 1..37: mol_type = genomic DNA

SEQ ID NO: 20100 - DNA, 10 bp, Homo sapiens
  misc_feature 1..10: note = chr8:69244500-69244510
  misc_feature 1..10: note = hyper
  source 1..10: mol_type = genomic DNA
aggcccttgc

SEQ ID NO: 20101 - DNA, 125 bp, Homo sapiens; identical to SEQ ID NO: 9614
  misc_feature 1..125: note = chr8:69244511-69244636
  misc_feature 1..125: note = hyper
  source 1..125: mol_type = genomic DNA

SEQ ID NO: 20102 - DNA, 34 bp, Homo sapiens; identical to SEQ ID NO: 9615
  misc_feature 1..34: note = chr8:70404830-70404864
  misc_feature 1..34: note = hyper
  source 1..34: mol_type = genomic DNA

SEQ ID NO: 20103 - DNA, 21 bp, Homo sapiens
  misc_feature 1..21: note = chr8:70744839-70744860
  misc_feature 1..21: note = hyper
  source 1..21: mol_type = genomic DNA
agcttctgcagtggccggcgc

SEQ ID NO: 20104 - DNA, 270 bp, Homo sapiens
  misc_feature 1..270: note = chr8:70744925-70745195
  misc_feature 1..270: note = hyper
  source 1..270: mol_type = genomic DNA
tttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttga

SEQ ID NO: 20105 - DNA, 30 bp, Homo sapiens; identical to SEQ ID NO: 9617
  misc_feature 1..30: note = chr8:70945287-70945317
  misc_feature 1..30: note = hyper
  source 1..30: mol_type = genomic DNA

SEQ ID NO: 20106 - DNA, 21 bp, Homo sapiens
  misc_feature 1..21: note = chr8:70983226-70983247
  misc_feature 1..21: note = hyper
  source 1..21: mol_type = genomic DNA
ctcctccgacctcagggatct

SEQ ID NO: 20107 - DNA, 16 bp, Homo sapiens
  misc_feature 1..16: note = chr8:70984978-70984994
  misc_feature 1..16: note = hyper
  source 1..16: mol_type = genomic DNA
tcgcctcttgtcccaa

SEQ ID NO: 20108 - DNA, 32 bp, Homo sapiens
  misc_feature 1..32: note = chr8:72273966-72273998
  misc_feature 1..32: note = hyper
  source 1..32: mol_type = genomic DNA
gctcctggatgggtacgcgcgggggctctcag

SEQ ID NO: 20109 - DNA, 101 bp, Homo sapiens
  misc_feature 1..101: note = chr8:72274033-72274134
  misc_feature 1..101: note = hyper
  source 1..101: mol_type = genomic DNA
agcgcctctgcaggggaaagctcggcgcagggggcaggcgcctggccgctgccgcaggctcgggctgccgagcgactgagcgaaaacgtgttccccaggaa

SEQ ID NO: 20110 - DNA, 78 bp, Homo sapiens; identical to SEQ ID NO: 810
  misc_feature 1..78: note = chr8:72460433-72460511
  misc_feature 1..78: note = hyper
  source 1..78: mol_type = genomic DNA

SEQ ID NO: 20111 - DNA, 86 bp, Homo sapiens
  misc_feature 1..86: note = chr8:72755176-72755262
  misc_feature 1..86: note = hyper
  source 1..86: mol_type = genomic DNA
ccgttcacgcttcttcctggactttgcccgcaggataatttggtgaaactcatctgactttgaggttctgtcgtttagttcccttc

SEQ ID NO: 20112 - DNA, 196 bp, Homo sapiens
  misc_feature 1..196: note = chr8:72755470-72755666
  misc_feature 1..196: note = hyper
  source 1..196: mol_type = genomic DNA
ctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaa

SEQ ID NO: 20113 - DNA, 15 bp, Homo sapiens
  misc_feature 1..15: note = chr8:73163646-73163661
  misc_feature 1..15: note = hyper
  source 1..15: mol_type = genomic DNA
ccggacttcagaacc

SEQ ID NO: 20114 - DNA, 46 bp, Homo sapiens; identical to SEQ ID NO: 9640
  misc_feature 1..46: note = chr8:73448786-73448832
  misc_feature 1..46: note = hyper
  source 1..46: mol_type = genomic DNA

SEQ ID NO: 20115 - DNA, 153 bp, Homo sapiens; identical to SEQ ID NO: 3315
  misc_feature 1..153: note = chr8:73449802-73449955
  misc_feature 1..153: note = hyper
  source 1..153: mol_type = genomic DNA

SEQ ID NO: 20116 - DNA, 38 bp, Homo sapiens
  misc_feature 1..38: note = chr8:73450026-73450064
  misc_feature 1..38: note = hyper
  source 1..38: mol_type = genomic DNA
cggggagaggctccccggagggagcggggaatcccaca

SEQ ID NO: 20117 - DNA, 16 bp, Homo sapiens
  misc_feature 1..16: note = chr8:73450100-73450116
  misc_feature 1..16: note = hyper
  source 1..16: mol_type = genomic DNA
gcggggtctgtgggag

SEQ ID NO: 20118 - skipped

SEQ ID NO: 20119 - DNA, 62 bp, Homo sapiens
  misc_feature 1..62: note = chr8:77586278-77586340
  misc_feature 1..62: note = hyper
  source 1..62: mol_type = genomic DNA
acagtcaattggaaggagcccgagtcagggagcaattgctaggacttcggacagagagggca

SEQ ID NO: 20120 - DNA, 66 bp, Homo sapiens
  misc_feature 1..66: note = chr8:77590466-77590532
  misc_feature 1..66: note = hyper
  source 1..66: mol_type = genomic DNA
gcagtcccgccgccgcttcagcccaacagccctcctcacgctggcgcgctccgaggccaagccctg

SEQ ID NO: 20121 - DNA, 333 bp, Homo sapiens
  misc_feature 1..333: note = chr8:77593376-77593709
  misc_feature 1..333: note = hyper
  source 1..333: mol_type = genomic DNA
ggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcac

SEQ ID NO: 20122 - DNA, 29 bp, Homo sapiens
  misc_feature 1..29: note = chr8:77594619-77594648
  misc_feature 1..29: note = hyper
  source 1..29: mol_type = genomic DNA
agaggctggggtgaacgctggggctgggg

SEQ ID NO: 20123 - DNA, 453 bp, Homo sapiens; identical to SEQ ID NO: 9654
  misc_feature 1..453: note = chr8:79428468-79428921
  misc_feature 1..453: note = hyper
  source 1..453: mol_type = genomic DNA

SEQ ID NO: 20124 - DNA, 23 bp, Homo sapiens
  misc_feature 1..23: note = chr8:80523960-80523983
  misc_feature 1..23: note = hyper
  source 1..23: mol_type = genomic DNA
actgggcacattttacggtattg

SEQ ID NO: 20125 - DNA, 224 bp, Homo sapiens
  misc_feature 1..224: note = chr8:80524029-80524253
  misc_feature 1..224: note = hyper
  source 1..224: mol_type = genomic DNA
agacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagc

SEQ ID NO: 20126 - DNA, 132 bp, Homo sapiens
  misc_feature 1..132: note = chr8:80524318-80524450
  misc_feature 1..132: note = hyper
  source 1..132: mol_type = genomic DNA
tgctgcatcttcattcgaaagggggtcgggtggggagcgcagcgtgacacccaggagcccaaccctgcggggacagcggcgccacgccccgcgctccccgctcccgactccccgccgcggcttccaagagag

SEQ ID NO: 20127 - DNA, 101 bp, Homo sapiens
  misc_feature 1..101: note = chr8:80524845-80524946
  misc_feature 1..101: note = hyper
  source 1..101: mol_type = genomic DNA
tgccttgagtgcccacggttctggcgctcagtggccccggggtgaaaaggcagggtggggcctggggtcctgtggcagctggaagcacgtgtcccccggga

SEQ ID NO: 20128 - DNA, 288 bp, Homo sapiens
  misc_feature 1..288: note = chr8:80525020-80525308
  misc_feature 1..288: note = hyper
  source 1..288: mol_type = genomic DNA
tccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccc

SEQ ID NO: 20129 - DNA, 39 bp, Homo sapiens; identical to SEQ ID NO: 9657
  misc_feature 1..39: note = chr8:80525530-80525569
  misc_feature 1..39: note = hyper
  source 1..39: mol_type = genomic DNA

SEQ ID NO: 20130 - DNA, 80 bp, Homo sapiens
  misc_feature 1..80: note = chr8:80803593-80803673
  misc_feature 1..80: note = hyper
  source 1..80: mol_type = genomic DNA
actctcaaatgccaccggcacattcttttaaaaaaaaatgaaaggaaagaaagaaagaaaaagaaaataagagaggaaaa

SEQ ID NO: 20131 - DNA, 29 bp, Homo sapiens
  misc_feature 1..29: note = chr8:81478156-81478185
  misc_feature 1..29: note = hyper
  source 1..29: mol_type = genomic DNA
cgtctttcctcctatcgtatgttacggtt

SEQ ID NO: 20132 - skipped

SEQ ID NO: 20133 - DNA, 448 bp, Homo sapiens; identical to SEQ ID NO: 9660
  misc_feature 1..448: note = chr8:82192848-82193296
  misc_feature 1..448: note = hyper
  source 1..448: mol_type = genomic DNA

SEQ ID NO: 20134 - DNA, 30 bp, Homo sapiens; identical to SEQ ID NO: 9661
  misc_feature 1..30: note = chr8:82193521-82193551
  misc_feature 1..30: note = hyper
  source 1..30: mol_type = genomic DNA

SEQ ID NO: 20135 - DNA, 325 bp, Homo sapiens
  misc_feature 1..325: note = chr8:89339064-89339389
  misc_feature 1..325: note = hyper
  source 1..325: mol_type = genomic DNA
aattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgat

SEQ ID NO: 20136 - DNA, 261 bp, Homo sapiens
  misc_feature 1..261: note = chr8:89339745-89340006
  misc_feature 1..261: note = hyper
  source 1..261: mol_type = genomic DNA
cgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcgcgcgcgcgcgcacacacacacac

SEQ ID NO: 20137 - DNA, 52 bp, Homo sapiens
  misc_feature 1..52: note = chr8:89340345-89340397
  misc_feature 1..52: note = hyper
  source 1..52: mol_type = genomic DNA
cctggggagcggcccaaccctggtcctggagagcggtcggcattcctgagga

SEQ ID NO: 20138 - DNA, 30 bp, Homo sapiens; identical to SEQ ID NO: 9667
  misc_feature 1..30: note = chr8:89340928-89340958
  misc_feature 1..30: note = hyper
  source 1..30: mol_type = genomic DNA

SEQ ID NO: 20139 - DNA, 32 bp, Homo sapiens; identical to SEQ ID NO: 9668
  misc_feature 1..32: note = chr8:91094254-91094286
  misc_feature 1..32: note = hyper
  source 1..32: mol_type = genomic DNA

SEQ ID NO: 20140 - DNA, 59 bp, Homo sapiens
  misc_feature 1..59: note = chr8:91997947-91998006
  misc_feature 1..59: note = hyper
  source 1..59: mol_type = genomic DNA
caggcgctgctttccccttggtgcatttagtgggtgtcgggattcgggttggcagggag

SEQ ID NO: 20141 - DNA, 30 bp, Homo sapiens; identical to SEQ ID NO: 9673
  misc_feature 1..30: note = chr8:93115382-93115412
  misc_feature 1..30: note = hyper
  source 1..30: mol_type = genomic DNA

SEQ ID NO: 20142 - DNA, 36 bp, Homo sapiens; identical to SEQ ID NO: 9674
  misc_feature 1..36: note = chr8:93115823-93115859
  misc_feature 1..36: note = hyper
  source 1..36: mol_type = genomic DNA

SEQ ID NO: 20143 - DNA, 77 bp, Homo sapiens
  misc_feature 1..77: note = chr8:97157008-97157085
  misc_feature 1..77: note = hyper
  source 1..77: mol_type = genomic DNA
cgcagtgataggcctcgtactccaggggcgcgataatccagtcgtcccagcccagctccttgaagttcacgtgcagg

SEQ ID NO: 20144 - DNA, 77 bp, Homo sapiens
  misc_feature 1..77: note = chr8:97158066-97158143
  misc_feature 1..77: note = hyper
  source 1..77: mol_type = genomic DNA
gccctttgtggtctcaagcctgggccgcgtttcccctagacctcctctgggctgggctggctcgttctcgttgacgt

SEQ ID NO: 20145 - DNA, 122 bp, Homo sapiens
  misc_feature 1..122: note = chr8:97169716-97169838
  misc_feature 1..122: note = hyper
  source 1..122: mol_type = genomic DNA
cccttgggggacccccggctccaccgagccaggccagccccactcgacggcgatttaaacatcccttaggcaaggcgccaagttagcgctgctggcccagctctaggcgggccgctgctctt

SEQ ID NO: 20146 - skipped

SEQ ID NO: 20147 - DNA, 291 bp, Homo sapiens; identical to SEQ ID NO: 822
  misc_feature 1..291: note = chr8:97170377-97170668
  misc_feature 1..291: note = hyper
  source 1..291: mol_type = genomic DNA

SEQ ID NO: 20148 - DNA, 10 bp, Homo sapiens
  misc_feature 1..10: note = chr8:97171119-97171129
  misc_feature 1..10: note = hyper
  source 1..10: mol_type = genomic DNA
gaacctcgct

SEQ ID NO: 20149 - DNA, 233 bp, Homo sapiens
  misc_feature 1..233: note = chr8:97172200-97172433
  misc_feature 1..233: note = hyper
  source 1..233: mol_type = genomic DNA
gctgcctcccgtcctccacgtttcccccaccagccaccaacaagcggcaaccacgctgccttctgcaaaagaggaagaaggaaagaagggagagagaaagaaagggggggaaaggaagggaggtttagagactggaatagaatccgcagccacattcagaaacttactcgagcttgagaaaaacaatttaagaaaagtaaaaaggaagtgtccagagcaggaagggaattcac

SEQ ID NO: 20150 - DNA, 68 bp, Homo sapiens
  misc_feature 1..68: note = chr8:97173458-97173526
  misc_feature 1..68: note = hyper
  source 1..68: mol_type = genomic DNA
gcggcggcgcccccaagagacagcttggagcaggcgcctctgctgcaggctgcgtgctgcctcggggc

SEQ ID NO: 20151 - DNA, 13 bp, Homo sapiens
  misc_feature 1..13: note = chr8:97173527-97173540
  misc_feature 1..13: note = hyper
  source 1..13: mol_type = genomic DNA
gtggtaccctccc

SEQ ID NO: 20152 - DNA, 30 bp, Homo sapiens; identical to SEQ ID NO: 9688
  misc_feature 1..30: note = chr8:97505645-97505675
  misc_feature 1..30: note = hyper
  source 1..30: mol_type = genomic DNA

SEQ ID NO: 20153 - DNA, 262 bp, Homo sapiens
  misc_feature 1..262: note = chr8:97507284-97507546
  misc_feature 1..262: note = hyper
  source 1..262: mol_type = genomic DNA
gttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttga

SEQ ID NO: 20154 - DNA, 15 bp, Homo sapiens
  misc_feature 1..15: note = chr8:97507680-97507695
  misc_feature 1..15: note = hyper
  source 1..15: mol_type = genomic DNA
cgggccaggtggaag

SEQ ID NO: 20155 - skipped

SEQ ID NO: 20156 - DNA, 87 bp, Homo sapiens
  misc_feature 1..87: note = chr8:98290260-98290347
  misc_feature 1..87: note = hyper
  source 1..87: mol_type = genomic DNA
ccgcgggcgctcccacccccatctcgcgcggactcgctttaggtctcggcgagtttctctgatatgcgctcgcgggggtgctgccat

SEQ ID NO: 20157 - DNA, 94 bp, Homo sapiens; identical to SEQ ID NO: 9694
  misc_feature 1..94: note = chr8:99076589-99076683
  misc_feature 1..94: note = hyper
  source 1..94: mol_type = genomic DNA

SEQ ID NO: 20158 - DNA, 240 bp, Homo sapiens; identical to SEQ ID NO: 9695
  misc_feature 1..240: note = chr8:99076759-99076999
  misc_feature 1..240: note = hyper
  source 1..240: mol_type = genomic DNA

SEQ ID NO: 20159 - DNA, 91 bp, Homo sapiens; identical to SEQ ID NO: 9696
  misc_feature 1..91: note = chr8:99439283-99439374
  misc_feature 1..91: note = hyper
  source 1..91: mol_type = genomic DNA

SEQ ID NO: 20160 - DNA, 36 bp, Homo sapiens
  misc_feature 1..36: note = chr8:99952815-99952851
  misc_feature 1..36: note = hyper
  source 1..36: mol_type = genomic DNA
gcagacgcgggaaggcccccgcgccatccgtgggag

SEQ ID NO: 20161 - DNA, 74 bp, Homo sapiens
  misc_feature 1..74: note = chr8:99954416-99954490
  misc_feature 1..74: note = hyper
  source 1..74: mol_type = genomic DNA
tcagcccccagtgggcgcagaggtggcccaggagggcccgcggacggtgctgcgctgcgctcagcctccgggcc

SEQ ID NO: 20162 - DNA, 30 bp, Homo sapiens; identical to SEQ ID NO: 9703
  misc_feature 1..30: note = chr8:99960111-99960141
  misc_feature 1..30: note = hyper
  source 1..30: mol_type = genomic DNA

SEQ ID NO: 20163 - DNA, 18 bp, Homo sapiens
  misc_feature 1..18: note = chr8:99961822-99961840
  misc_feature 1..18: note = hyper
  source 1..18: mol_type = genomic DNA
ctgcgggatcacaggtga

SEQ ID NO: 20164 - DNA, 30 bp, Homo sapiens; identical to SEQ ID NO: 9709
  misc_feature 1..30: note = chr8:101118014-101118044
  misc_feature 1..30: note = hyper
  source 1..30: mol_type = genomic DNA

SEQ ID NO: 20165 - DNA, 59 bp, Homo sapiens
  misc_feature 1..59: note = chr8:101822047-101822106
  misc_feature 1..59: note = hyper
  source 1..59: mol_type = genomic DNA
ctacgacagcgaggggcccgggaagcccgcggaaacgcaggaggcggccaggagaggca

SEQ ID NO: 20166 - DNA, 174 bp, Homo sapiens; identical to SEQ ID NO: 9712
  misc_feature 1..174: note = chr8:104152775-104152949
  misc_feature 1..174: note = hyper
  source 1..174: mol_type = genomic DNA

SEQ ID NO: 20167 - DNA, 182 bp, Homo sapiens
  misc_feature 1..182: note = chr8:104153267-104153449
  misc_feature 1..182: note = hyper
  source 1..182: mol_type = genomic DNA
cgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaag

SEQ ID NO: 20168 - DNA, 349 bp, Homo sapiens; identical to SEQ ID NO: 9714
  misc_feature 1..349: note = chr8:104511157-104511506
  misc_feature 1..349: note = hyper
  source 1..349: mol_type = genomic DNA

SEQ ID NO: 20169 - DNA, 100 bp, Homo sapiens
  misc_feature 1..100: note = chr8:104512023-104512123
  misc_feature 1..100: note = hyper
  source 1..100: mol_type = genomic DNA
gggaggggcggctgccgcccgcggggcgcccgcggtgcccgggcctgggcagcgaggaggtgacgccgcccccgcgggatgagcccgggaggcggagggg

SEQ ID NO: 20170 - DNA, 57 bp, Homo sapiens
  misc_feature 1..57: note = chr8:104513405-104513462
  misc_feature 1..57: note = hyper
  source 1..57: mol_type = genomic DNA
aggccacgagggctgcggccagcgccggccgcccgggctgttttaggggtgtctgag

SEQ ID NO: 20171 - DNA, 120 bp, Homo sapiens
  misc_feature 1..120: note = chr8:105235249-105235369
  misc_feature 1..120: note = hyper
  source 1..120: mol_type = genomic DNA
cctgtgtttgaggagcgttaaaaaaaactgtgaacctgaggaaagggaaagtgactaccagaaatttaccggtttacttatctgagatgcctaactcactgcatctaattagtcaccact

SEQ ID NO: 20172 - DNA, 155 bp, Homo sapiens; identical to SEQ ID NO: 9720
  misc_feature 1..155: note = chr8:105600526-105600681
  misc_feature 1..155: note = hyper
  source 1..155: mol_type = genomic DNA

SEQ ID NO: 20173 - DNA, 87 bp, Homo sapiens; identical to SEQ ID NO: 9721
  misc_feature 1..87: note = chr8:105601174-105601261
  misc_feature 1..87: note = hyper
  source 1..87: mol_type = genomic DNA

SEQ ID NO: 20174 - DNA, 30 bp, Homo sapiens; identical to SEQ ID NO: 9722
  misc_feature 1..30: note = chr8:105602021-105602051
  misc_feature 1..30: note = hyper
  source 1..30: mol_type = genomic DNA

SEQ ID NO: 20175 - DNA, 30 bp, Homo sapiens; identical to SEQ ID NO: 9723
  misc_feature 1..30: note = chr8:106330435-106330465
  misc_feature 1..30: note = hyper
  source 1..30: mol_type = genomic DNA

SEQ ID NO: 20176 - DNA, 63 bp, Homo sapiens; identical to SEQ ID NO: 9724
  misc_feature 1..63: note = chr8:106331011-106331074
  misc_feature 1..63: note = hyper
  source 1..63: mol_type = genomic DNA

SEQ ID NO: 20177 - DNA, 77 bp, Homo sapiens
  misc_feature 1..77: note = chr8:106331083-106331160
  misc_feature 1..77: note = hyper
  source 1..77: mol_type = genomic DNA
cggcggcggcggcggcgggagccgagggagcggcagccgcgaccgcgggcaccgcgggagccccagcggcagcagcc

SEQ ID NO: 20178 - DNA, 505 bp, Homo sapiens; identical to SEQ ID NO: 9726
  misc_feature 1..505: note = chr8:107283327-107283832
  misc_feature 1..505: note = hyper
  source 1..505: mol_type = genomic DNA

SEQ ID NO: 20179 - DNA, 140 bp, Homo sapiens; identical to SEQ ID NO: 9727
  misc_feature 1..140: note = chr8:107284082-107284222
  misc_feature 1..140: note = hyper
  source 1..140: mol_type = genomic DNA

SEQ ID NO: 20180 - DNA, 245 bp, Homo sapiens
  misc_feature 1..245: note = chr8:109094595-109094840
  misc_feature 1..245: note = hyper
  source 1..245: mol_type = genomic DNA
gaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagg

SEQ ID NO: 20181 - DNA, 117 bp, Homo sapiens; identical to SEQ ID NO: 3359
  misc_feature 1..117: note = chr8:110703765-110703882
  misc_feature 1..117: note = hyper
  source 1..117: mol_type = genomic DNA

SEQ ID NO: 20182 - DNA, 30 bp, Homo sapiens; identical to SEQ ID NO: 9734
  misc_feature 1..30: note = chr8:110704224-110704254
  misc_feature 1..30: note = hyper
  source 1..30: mol_type = genomic DNA

SEQ ID NO: 20183 - DNA, 52 bp, Homo sapiens; identical to SEQ ID NO: 9735
  misc_feature 1..52: note = chr8:110986212-110986264
  misc_feature 1..52: note = hyper
  source 1..52: mol_type = genomic DNA

SEQ ID NO: 20184 - DNA, 115 bp, Homo sapiens
  misc_feature 1..115: note = chr8:110986328-110986443
  misc_feature 1..115: note = hyper
  source 1..115: mol_type = genomic DNA
cggggttggcatcgtcgcaaagctccagagggctgggcacggcggccagggccccggggcggcggtaggaagccaccaccacggccagcttgccaaggcgcgtgtgcgggaagca

SEQ ID NO: 20185 - DNA, 85 bp, Homo sapiens; identical to SEQ ID NO: 9737
  misc_feature 1..85: note = chr8:110986934-110987019
  misc_feature 1..85: note = hyper
  source 1..85: mol_type = genomic DNA

SEQ ID NO: 20186 - DNA, 202 bp, Homo sapiens; identical to SEQ ID NO: 9738
  misc_feature 1..202: note = chr8:110987020-110987222
  misc_feature 1..202: note = hyper
  source 1..202: mol_type = genomic DNA

SEQ ID NO: 20187 - DNA, 146 bp, Homo sapiens; identical to SEQ ID NO: 9739
  misc_feature 1..146: note = chr8:110987765-110987911
  misc_feature 1..146: note = hyper
  source 1..146: mol_type = genomic DNA

SEQ ID NO: 20188 - DNA, 41 bp, Homo sapiens; identical to SEQ ID NO: 9741
  misc_feature 1..41: note = chr8:114445521-114445562
  misc_feature 1..41: note = hyper
  source 1..41: mol_type = genomic DNA

SEQ ID NO: 20189 - DNA, 30 bp, Homo sapiens; identical to SEQ ID NO: 9744
  misc_feature 1..30: note = chr8:114447368-114447398
  misc_feature 1..30: note = hyper
  source 1..30: mol_type = genomic DNA

SEQ ID NO: 20190 - DNA, 30 bp, Homo sapiens; identical to SEQ ID NO: 9745
  misc_feature 1..30: note = chr8:114448796-114448826
  misc_feature 1..30: note = hyper
  source 1..30: mol_type = genomic DNA

SEQ ID NO: 20191 - DNA, 59 bp, Homo sapiens
  misc_feature 1..59: note = chr8:117950379-117950438
  misc_feature 1..59: note = hyper
  source 1..59: mol_type = genomic DNA
tccttgaattacctccgcccccgccctgaccccgccctaaacatcaaacttagaaactc

SEQ ID NO: 20192 - DNA, 50 bp, Homo sapiens
  misc_feature 1..50: note = chr8:117950468-117950518
  misc_feature 1..50: note = hyper
  source 1..50: mol_type = genomic DNA
caggcgtctccgcgatgggccccggggacttccgccgctgcagagagaga

SEQ ID NO: 20193 - skipped

SEQ ID NO: 20194 - DNA, 38 bp, Homo sapiens
  misc_feature 1..38: note = chr8:117950914-117950952
  misc_feature 1..38: note = hyper
  source 1..38: mol_type = genomic DNA
ctcaggtctggacacggcgttgacgcccccgcctcccc

SEQ ID NO: 20195 - DNA, 30 bp, Homo sapiens; identical to SEQ ID NO: 9753
  misc_feature 1..30: note = chr8:122652164-122652194
  misc_feature 1..30: note = hyper
  source 1..30: mol_type = genomic DNA

SEQ ID NO: 20196 - DNA, 151 bp, Homo sapiens
  misc_feature 1..151: note = chr8:124173095-124173246
  misc_feature 1..151: note = hyper
  source 1..151: mol_type = genomic DNA
gaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtc

SEQ ID NO: 20197 - DNA, 33 bp, Homo sapiens; identical to SEQ ID NO: 9755
  misc_feature 1..33: note = chr8:131455313-131455346
  misc_feature 1..33: note = hyper
  source 1..33: mol_type = genomic DNA

SEQ ID NO: 20198 - DNA, 102 bp, Homo sapiens; identical to SEQ ID NO: 9756
  misc_feature 1..102: note = chr8:131455680-131455782
  misc_feature 1..102: note = hyper
  source 1..102: mol_type = genomic DNA

SEQ ID NO: 20199 - DNA, 142 bp, Homo sapiens
  misc_feature 1..142: note = chr8:132052005-132052147
  misc_feature 1..142: note = hyper
  source 1..142: mol_type = genomic DNA
tcagcacgtccagcacgttcatcaccacttccgatttgcgcctttggcccaagaaatagcgctggtagaggcgttccaaatcccgagatttgaaggagttgcgcagggtggggaaaatgacccctcggtagctatagccccc

SEQ ID NO: 20200 - DNA, 30 bp, Homo sapiens; identical to SEQ ID NO: 9760
  misc_feature 1..30: note = chr8:132053488-132053518
  misc_feature 1..30: note = hyper
  source 1..30: mol_type = genomic DNA

SEQ ID NO: 20201 - DNA, 257 bp, Homo sapiens; identical to SEQ ID NO: 9763
  misc_feature 1..257: note = chr8:133492359-133492616
  misc_feature 1..257: note = hyper
  source 1..257: mol_type = genomic DNA

SEQ ID NO: 20202 - DNA, 41 bp, Homo sapiens; identical to SEQ ID NO: 9764
  misc_feature 1..41: note = chr8:133493711-133493752
  misc_feature 1..41: note = hyper
  source 1..41: mol_type = genomic DNA

SEQ ID NO: 20203 - DNA, 30 bp, Homo sapiens; identical to SEQ ID NO: 9766
  misc_feature 1..30: note = chr8:139926700-139926730
  misc_feature 1..30: note = hyper
  source 1..30: mol_type = genomic DNA

SEQ ID NO: 20204 - DNA, 250 bp, Homo sapiens
  misc_feature 1..250: note = chr8:140715219-140715469
  misc_feature 1..250: note = hyper
  source 1..250: mol_type = genomic DNA
cgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcgg

SEQ ID NO: 20205 - DNA, 75 bp, Homo sapiens; identical to SEQ ID NO: 9769
  misc_feature 1..75: note = chr8:140715859-140715934
  misc_feature 1..75: note = hyper
  source 1..75: mol_type = genomic DNA

SEQ ID NO: 20206 - DNA, 197 bp, Homo sapiens; identical to SEQ ID NO: 9770
  misc_feature 1..197: note = chr8:140716694-140716891
  misc_feature 1..197: note = hyper
  source 1..197: mol_type = genomic DNA

SEQ ID NO: 20207 - DNA, 30 bp, Homo sapiens; identical to SEQ ID NO: 9771
  misc_feature 1..30: note = chr8:140717104-140717134
  misc_feature 1..30: note = hyper
  source 1..30: mol_type = genomic DNA

SEQ ID NO: 20208 - DNA, 15 bp, Homo sapiens
  misc_feature 1..15: note = chr8:142529027-142529042
  misc_feature 1..15: note = hyper
  source 1..15: mol_type = genomic DNA
cggaggcaggccctc

SEQ ID NO: 20209 - DNA, 177 bp, Homo sapiens; identical to SEQ ID NO: 9776
  misc_feature 1..177: note = chr8:143530536-143530713
  misc_feature 1..177: note = hyper
  source 1..177: mol_type = genomic DNA

SEQ ID NO: 20210 - DNA, 352 bp, Homo sapiens; identical to SEQ ID NO: 9777
  misc_feature 1..352: note = chr8:143531062-143531414
  misc_feature 1..352: note = hyper
  source 1..352: mol_type = genomic DNA

SEQ ID NO: 20211 - DNA, 125 bp, Homo sapiens; identical to SEQ ID NO: 9778
  misc_feature 1..125: note = chr8:143531646-143531771
  misc_feature 1..125: note = hyper
  source 1..125: mol_type = genomic DNA

SEQ ID NO: 20212 - DNA, 81 bp, Homo sapiens
  misc_feature 1..81: note = chr8:143532041-143532122
  misc_feature 1..81: note = hyper
  source 1..81: mol_type = genomic DNA
ccccagactccttctcgaagccctcgctcgtagaagccctcgcctgtagacctggcattggcagtggagactccctggagg

SEQ ID NO: 20213 - DNA, 653 bp, Homo sapiens
  misc_feature 1..653: note = chr8:143532846-143533499
  misc_feature 1..653: note = hyper
  source 1..653: mol_type = genomic DNA
tgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccac

SEQ ID NO: 20214 - DNA, 111 bp, Homo sapiens
  misc_feature 1..111: note = chr8:143533500-143533611
  misc_feature 1..111: note = hyper
  source 1..111: mol_type = genomic DNA
ccctcccttcggctcgctagctgctccttggcgctgctttcagacttgttgcgcctcgatctggggggcagaaggctggcccgggagacccggcggctgagggccgagccg

SEQ ID NO: 20215 - DNA, 145 bp, Homo sapiens
  misc_feature 1..145: note = chr8:143533906-143534051
  misc_feature 1..145: note = hyper
  source 1..145: mol_type = genomic DNA
cgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcgg

SEQ ID NO: 20216 - DNA, 195 bp, Homo sapiens; identical to SEQ ID NO: 9784
  misc_feature 1..195: note = chr8:143591612-143591807
  misc_feature 1..195: note = hyper
  source 1..195: mol_type = genomic DNA

SEQ ID NO: 20217 - DNA, 17 bp, Homo sapiens
  misc_feature 1..17: note = chr8:143591888-143591905
  misc_feature 1..17: note = hyper
  source 1..17: mol_type = genomic DNA
cgcgcccctccgggcct

SEQ ID NO: 20218 - DNA, 146 bp, Homo sapiens; identical to SEQ ID NO: 9786
  misc_feature 1..146: note = chr8:143592126-143592272
  misc_feature 1..146: note = hyper
  source 1..146: mol_type = genomic DNA

SEQ ID NO: 20219 - DNA, 45 bp, Homo sapiens; identical to SEQ ID NO: 9788
  misc_feature 1..45: note = chr8:143859143-143859188
  misc_feature 1..45: note = hyper
  source 1..45: mol_type = genomic DNA

SEQ ID NO: 20220 - DNA, 147 bp, Homo sapiens
  misc_feature 1..147: note = chr8:144241287-144241434
  misc_feature 1..147: note = hyper
  source 1..147: mol_type = genomic DNA
gccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 20221 - DNA, 87 bp, Homo sapiens; identical to SEQ ID NO: 3378
  misc_feature 1..87: note = chr8:144241435-144241522
  misc_feature 1..87: note = hyper
  source 1..87: mol_type = genomic DNA

SEQ ID NO: 20222 - DNA, 67 bp, Homo sapiens
  misc_feature 1..67: note = chr8:144328254-144328321
  misc_feature 1..67: note = hyper
  source 1..67: mol_type = genomic DNA
gacggctcgccagggcgcgcacgcggtggcggcggcggtggaggcgttgcccgcctagctaggggcc

SEQ ID NO: 20223 - skipped

SEQ ID NO: 20224 - DNA, 87 bp, Homo sapiens; identical to SEQ ID NO: 9793
  misc_feature 1..87: note = chr8:144503405-144503492
  misc_feature 1..87: note = hyper
  source 1..87: mol_type = genomic DNA

SEQ ID NO: 20225 - DNA, 30 bp, Homo sapiens; identical to SEQ ID NO: 9794
  misc_feature 1..30: note = chr8:144509088-144509118
  misc_feature 1..30: note = hyper
  source 1..30: mol_type = genomic DNA

SEQ ID NO: 20226 - DNA, 32 bp, Homo sapiens
  misc_feature 1..32: note = chr8:144510529-144510561
  misc_feature 1..32: note = hyper
  source 1..32: mol_type = genomic DNA
agattccacaaacaaaacgaaacacaatttaa

SEQ ID NO: 20227 - DNA, 65 bp, Homo sapiens; identical to SEQ ID NO: 9797
  misc_feature 1..65: note = chr8:144510915-144510980
  misc_feature 1..65: note = hyper
  source 1..65: mol_type = genomic DNA

SEQ ID NO: 20228 - DNA, 41 bp, Homo sapiens
  misc_feature 1..41: note = chr8:144511184-144511225
  misc_feature 1..41: note = hyper
  source 1..41: mol_type = genomic DNA
tctaggctggcagggcgaaggtgggaacggagaaccacgtt

SEQ ID NO: 20229 - DNA, 617 bp, Homo sapiens
  misc_feature 1..617: note = chr8:144511424-144512041
  misc_feature 1..617: note = hyper
  source 1..617: mol_type = genomic DNA
cgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgt

SEQ ID NO: 20230 - DNA, 118 bp, Homo sapiens; identical to SEQ ID NO: 9799
  misc_feature 1..118: note = chr8:144651780-144651898
  misc_feature 1..118: note = hyper
  source 1..118: mol_type = genomic DNA

SEQ ID NO: 20231 - DNA, 65 bp, Homo sapiens; identical to SEQ ID NO: 9800
  misc_feature 1..65: note = chr8:145700341-145700406
  misc_feature 1..65: note = hyper
  source 1..65: mol_type = genomic DNA

SEQ ID NO: 20232 - DNA, 30 bp, Homo sapiens; identical to SEQ ID NO: 9801
  misc_feature 1..30: note = chr8:145806218-145806248
  misc_feature 1..30: note = hyper
  source 1..30: mol_type = genomic DNA

SEQ ID NO: 20233 - DNA, 40 bp, Homo sapiens; identical to SEQ ID NO: 9802
  misc_feature 1..40: note = chr9:73266-73306
  misc_feature 1..40: note = hyper
  source 1..40: mol_type = genomic DNA

SEQ ID NO: 20234 - DNA, 13 bp, Homo sapiens
  misc_feature 1..13: note = chr9:113420-113433
  misc_feature 1..13: note = hyper
  source 1..13: mol_type = genomic DNA
cgcagcccagctt

SEQ ID NO: 20235 - DNA, 76 bp, Homo sapiens
  misc_feature 1..76: note = chr9:113774-113850
  misc_feature 1..76: note = hyper
  source 1..76: mol_type = genomic DNA
ccggcggcgccgtcgcgcgcactcggcagaggcttcgcgggagaacgcgcagcccggggcgtggggcggggaactg

SEQ ID NO: 20236 - DNA, 269 bp, Homo sapiens
  misc_feature 1..269: note = chr9:113885-114154
  misc_feature 1..269: note = hyper
  source 1..269: mol_type = genomic DNA
gagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggag

SEQ ID NO: 20237 - DNA, 102 bp, Homo sapiens; identical to SEQ ID NO: 9806
  misc_feature 1..102: note = chr9:114750-114852
  misc_feature 1..102: note = hyper
  source 1..102: mol_type = genomic DNA

SEQ ID NO: 20238 - skipped

SEQ ID NO: 20239 - DNA, 43 bp, Homo sapiens; identical to SEQ ID NO: 9811
  misc_feature 1..43: note = chr9:842922-842965
  misc_feature 1..43: note = hyper
  source 1..43: mol_type = genomic DNA

SEQ ID NO: 20240 - DNA, 141 bp, Homo sapiens; identical to SEQ ID NO: 9812
  misc_feature 1..141: note = chr9:843219-843360
  misc_feature 1..141: note = hyper
  source 1..141: mol_type = genomic DNA

SEQ ID NO: 20241 - DNA, 140 bp, Homo sapiens
  misc_feature 1..140: note = chr9:969846-969986
  misc_feature 1..140: note = hyper
  source 1..140: mol_type = genomic DNA
agtgtcccctctcagcactgcccccttcagtccccctgcatttctggaaagtcaggcaaggcccaggtaggctgccagtgcactctcagccttgactgagcacctttcgggcctctggtgagccccgagagccaggtttg

SEQ ID NO: 20242 - DNA, 59 bp, Homo sapiens; identical to SEQ ID NO: 9815
  misc_feature 1..59: note = chr9:970533-970592
  misc_feature 1..59: note = hyper
  source 1..59: mol_type = genomic DNA

SEQ ID NO: 20243 - DNA, 56 bp, Homo sapiens; identical to SEQ ID NO: 9817
  misc_feature 1..56: note = chr9:972016-972072
  misc_feature 1..56: note = hyper
  source 1..56: mol_type = genomic DNA

SEQ ID NO: 20244 - DNA, 183 bp, Homo sapiens
  misc_feature 1..183: note = chr9:976435-976618
  misc_feature 1..183: note = hyper
  source 1..183: mol_type = genomic DNA
cttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcgg

SEQ ID NO: 20245 - DNA, 96 bp, Homo sapiens; identical to SEQ ID NO: 9823
  misc_feature 1..96: note = chr9:977422-977518
  misc_feature 1..96: note = hyper
  source 1..96: mol_type = genomic DNA

SEQ ID NO: 20246 - DNA, 13 bp, Homo sapiens
  misc_feature 1..13: note = chr9:981830-981843
  misc_feature 1..13: note = hyper
  source 1..13: mol_type = genomic DNA
gctctttccttgg

SEQ ID NO: 20247 - DNA, 76 bp, Homo sapiens
  misc_feature 1..76: note = chr9:1042326-1042402
  misc_feature 1..76: note = hyper
  source 1..76: mol_type = genomic DNA
tggaagggtctgacacggaatctgaccaaggctggaccctcaataattgtgatttcttttcccccttttccttctt

SEQ ID NO: 20248 - DNA, 152 bp, Homo sapiens
  misc_feature 1..152: note = chr9:1052166-1052318
  misc_feature 1..152: note = hyper
  source 1..152: mol_type = genomic DNA
aggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 20249 - DNA, 179 bp, Homo sapiens
  misc_feature 1..179: note = chr9:3181573-3181752
  misc_feature 1..179: note = hyper
  source 1..179: mol_type = genomic DNA
tcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagca

SEQ ID NO: 20250 - DNA, 11 bp, Homo sapiens
  misc_feature 1..11: note = chr9:3181869-3181880
  misc_feature 1..11: note = hyper
  source 1..11: mol_type = genomic DNA
ctttgcctgag

SEQ ID NO: 20251 - DNA, 30 bp, Homo sapiens; identical to SEQ ID NO: 9829
  misc_feature 1..30: note = chr9:4299034-4299064
  misc_feature 1..30: note = hyper
  source 1..30: mol_type = genomic DNA

SEQ ID NO: 20252 - DNA, 58 bp, Homo sapiens; identical to SEQ ID NO: 9830
  misc_feature 1..58: note = chr9:4299348-4299406
  misc_feature 1..58: note = hyper
  source 1..58: mol_type = genomic DNA

SEQ ID NO: 20253 - DNA, 30 bp, Homo sapiens; identical to SEQ ID NO: 9831
  misc_feature 1..30: note = chr9:4299642-4299672
  misc_feature 1..30: note = hyper
  source 1..30: mol_type = genomic DNA

SEQ ID NO: 20254 - DNA, 94 bp, Homo sapiens; identical to SEQ ID NO: 9832
  misc_feature 1..94: note = chr9:4299969-4300063
  misc_feature 1..94: note = hyper
  source 1..94: mol_type = genomic DNA

SEQ ID NO: 20255 - DNA, 41 bp, Homo sapiens
  misc_feature 1..41: note = chr9:6412809-6412850
  misc_feature 1..41: note = hyper
  source 1..41: mol_type = genomic DNA
cccctttccaggattatacaagtgcacgccagggtttctta

SEQ ID NO: 20256 - DNA, 31 bp, Homo sapiens
  misc_feature 1..31: note = chr9:6645594-6645625
  misc_feature 1..31: note = hyper
  source 1..31: mol_type = genomic DNA
gcctggagcccctttcgctggacagtcggcc

SEQ ID NO: 20257 - DNA, 327 bp, Homo sapiens
  misc_feature 1..327: note = chr9:6645700-6646027
  misc_feature 1..327: note = hyper
  source 1..327: mol_type = genomic DNA
ccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctg

SEQ ID NO: 20258 - DNA, 30 bp, Homo sapiens; identical to SEQ ID NO: 9837
  misc_feature 1..30: note = chr9:8857443-8857473
  misc_feature 1..30: note = hyper
  source 1..30: mol_type = genomic DNA

SEQ ID NO: 20259 - DNA, 47 bp, Homo sapiens; identical to SEQ ID NO: 9838
  misc_feature 1..47: note = chr9:8858369-8858416
  misc_feature 1..47: note = hyper
  source 1..47: mol_type = genomic DNA

SEQ ID NO: 20260 - DNA, 70 bp, Homo sapiens
  misc_feature 1..70: note = chr9:13278748-13278818
  misc_feature 1..70: note = hyper
  source 1..70: mol_type = genomic DNA
accggtaccaattagcggctcgcctcggggtccccgcggctaaggcgagaacgcaggaccaggagcattg

SEQ ID NO: 20261 - DNA, 67 bp, Homo sapiens
  misc_feature 1..67: note = chr9:13278864-13278931
  misc_feature 1..67: note = hyper
  source 1..67: mol_type = genomic DNA
gcggatggggcgtccgggagcggcccctgcaggggagagcaacaggctcccgcgccctggaggcctg

SEQ ID NO: 20262 - DNA, 32 bp, Homo sapiens; identical to SEQ ID NO: 9840
  misc_feature 1..32: note = chr9:13279717-13279749
  misc_feature 1..32: note = hyper
  source 1..32: mol_type = genomic DNA

SEQ ID NO: 20263 - DNA, 207 bp, Homo sapiens
  misc_feature 1..207: note = chr9:14348107-14348314
  misc_feature 1..207: note = hyper
  source 1..207: mol_type = genomic DNA
gaaggaaatgtggtgcgccctctggggcgtgaggccgccgcggcccattctacacacctactggcattccgcttttccttactgtgcgccaggggaaggcataattcaattatatcatacaactgcagcgcacccttttccttttttgctttgaggggaattttccaattcccaaataaatacctatggctctaaagccgagttggg

SEQ ID NO: 20264 - DNA, 43 bp, Homo sapiens; identical to SEQ ID NO: 9842
  misc_feature 1..43: note = chr9:16870864-16870907
  misc_feature 1..43: note = hyper
  source 1..43: mol_type = genomic DNA

SEQ ID NO: 20265 - DNA, 42 bp, Homo sapiens; identical to SEQ ID NO: 9843
  misc_feature 1..42: note = chr9:17135632-17135674
  misc_feature 1..42: note = hyper
  source 1..42: mol_type = genomic DNA

SEQ ID NO: 20266 - DNA, 48 bp, Homo sapiens; identical to SEQ ID NO: 9844
  misc_feature 1..48: note = chr9:17578826-17578874
  misc_feature 1..48: note = hyper
  source 1..48: mol_type = genomic DNA

SEQ ID NO: 20267 - DNA, 63 bp, Homo sapiens; identical to SEQ ID NO: 9845
  misc_feature 1..63: note = chr9:17579090-17579153
  misc_feature 1..63: note = hyper
  source 1..63: mol_type = genomic DNA

SEQ ID NO: 20268 - DNA, 223 bp, Homo sapiens; identical to SEQ ID NO: 9846
  misc_feature 1..223: note = chr9:17579476-17579699
  misc_feature 1..223: note = hyper
  source 1..223: mol_type = genomic DNA

SEQ ID NO: 20269 - DNA, 51 bp, Homo sapiens; identical to SEQ ID NO: 9847
  misc_feature 1..51: note = chr9:17906058-17906109
  misc_feature 1..51: note = hyper
  source 1..51: mol_type = genomic DNA

SEQ ID NO: 20270 - DNA, 30 bp, Homo sapiens; identical to SEQ ID NO: 9851
  misc_feature 1..30: note = chr9:19127231-19127261
  misc_feature 1..30: note = hyper
  source 1..30: mol_type = genomic DNA

SEQ ID NO: 20271 - DNA, 30 bp, Homo sapiens; identical to SEQ ID NO: 9852
  misc_feature 1..30: note = chr9:19788506-19788536
  misc_feature 1..30: note = hyper
  source 1..30: mol_type = genomic DNA

SEQ ID NO: 20272 - DNA, 255 bp, Homo sapiens
  misc_feature 1..255: note = chr9:21031479-21031734
  misc_feature 1..255: note = hyper
  source 1..255: mol_type = genomic DNA
gcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttg

SEQ ID NO: 20273 - DNA, 46 bp, Homo sapiens; identical to SEQ ID NO: 9855
  misc_feature 1..46: note = chr9:21396004-21396050
  misc_feature 1..46: note = hyper
  source 1..46: mol_type = genomic DNA

SEQ ID NO: 20274 - DNA, 38 bp, Homo sapiens; identical to SEQ ID NO: 9856
  misc_feature 1..38: note = chr9:21396276-21396314
  misc_feature 1..38: note = hyper
  source 1..38: mol_type = genomic DNA

SEQ ID NO: 20275 - DNA, 27 bp, Homo sapiens
  misc_feature 1..27: note = chr9:21402590-21402617
  misc_feature 1..27: note = hyper
  source 1..27: mol_type = genomic DNA
tccccttccccaagacgtccccgccct

SEQ ID NO: 20276 - DNA, 125 bp, Homo sapiens
  misc_feature 1..125: note = chr9:21403021-21403146
  misc_feature 1..125: note = hyper
  source 1..125: mol_type = genomic DNA
gctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 20277 - skipped

SEQ ID NO: 20278 - DNA, 206 bp, Homo sapiens
  misc_feature 1..206: note = chr9:21968475-21968681
  misc_feature 1..206: note = hyper
  source 1..206: mol_type = genomic DNA
ggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggc

SEQ ID NO: 20279 - DNA, 19 bp, Homo sapiens
  misc_feature 1..19: note = chr9:21969231-21969250
  misc_feature 1..19: note = hyper
  source 1..19: mol_type = genomic DNA
acaaacaaacccaggcgtc

SEQ ID NO: 20280 - DNA, 262 bp, Homo sapiens
  misc_feature 1..262: note = chr9:21974237-21974499
  misc_feature 1..262: note = hyper
  source 1..262: mol_type = genomic DNA
catacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttccca

SEQ ID NO: 20281 - DNA, 323 bp, Homo sapiens
  misc_feature 1..323: note = chr9:21974794-21975117
  misc_feature 1..323: note = hyper
  source 1..323: mol_type = genomic DNA
ggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagc

SEQ ID NO: 20282 - DNA, 418 bp, Homo sapiens; identical to SEQ ID NO: 3399
  misc_feature 1..418: note = chr9:21975190-21975608
  misc_feature 1..418: note = hyper
  source 1..418: mol_type = genomic DNA

SEQ ID NO: 20283 - DNA, 56 bp, Homo sapiens; identical to SEQ ID NO: 9865
  misc_feature 1..56: note = chr9:22447029-22447085
  misc_feature 1..56: note = hyper
  source 1..56: mol_type = genomic DNA

SEQ ID NO: 20284 - DNA, 432 bp, Homo sapiens
  misc_feature 1..432: note = chr9:23824129-23824561
  misc_feature 1..432: note = hyper
  source 1..432: mol_type = genomic DNA
aaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacac

SEQ ID NO: 20285 - DNA, 39 bp, Homo sapiens; identical to SEQ ID NO: 9868
  misc_feature 1..39: note = chr9:23826326-23826365
  misc_feature 1..39: note = hyper
  source 1..39: mol_type = genomic DNA

SEQ ID NO: 20286 - DNA, 15 bp, Homo sapiens
  misc_feature 1..15: note = chr9:23831450-23831465
  misc_feature 1..15: note = hyper
  source 1..15: mol_type = genomic DNA
cgggccacggtgaca

SEQ ID NO: 20287 - DNA, 13 bp, Homo sapiens
  misc_feature 1..13: note = chr9:29212294-29212307
  misc_feature 1..13: note = hyper
  source 1..13: mol_type = genomic DNA
ctcaccccgccgc

SEQ ID NO: 20288 - DNA, 51 bp, Homo sapiens; identical to SEQ ID NO: 9872
  misc_feature 1..51: note = chr9:29212731-29212782
  misc_feature 1..51: note = hyper
  source 1..51: mol_type = genomic DNA

SEQ ID NO: 20289 - DNA, 30 bp, Homo sapiens; identical to SEQ ID NO: 9873
  misc_feature 1..30: note = chr9:29213181-29213211
  misc_feature 1..30: note = hyper
  source 1..30: mol_type = genomic DNA

SEQ ID NO: 20290 - DNA, 100 bp, Homo sapiens
  misc_feature 1..100: note = chr9:32783121-32783221
  misc_feature 1..100: note = hyper
  source 1..100: mol_type = genomic DNA
cctgccgtcagtcacccggatttgtaactggagaagggtgcgggtcccggagggacatctccagctggcacctaactcctcggatcccggactgggagcc

SEQ ID NO: 20291 - DNA, 87 bp, Homo sapiens
  misc_feature 1..87: note = chr9:32783259-32783346
  misc_feature 1..87: note = hyper
  source 1..87: mol_type = genomic DNA
cgaccctggtttccgactccggccactggcagcctcgcgccccagacccttcccgggcacggaagcgggtcaggtcgccctgctcag

SEQ ID NO: 20292 - DNA, 95 bp, Homo sapiens; identical to SEQ ID NO: 9883
  misc_feature 1..95: note = chr9:33523986-33524081
  misc_feature 1..95: note = hyper
  source 1..95: mol_type = genomic DNA

SEQ ID NO: 20293 - DNA, 110 bp, Homo sapiens
  misc_feature 1..110: note = chr9:33524499-33524609
  misc_feature 1..110: note = hyper
  source 1..110: mol_type = genomic DNA
ctcagttttgggagacgcctgggccaggcgctcctgagctccatggaccaagagtatgcgggtcgggggtaccacattcgggactgggaactgcggaagatccacagggc

SEQ ID NO: 20294 - skipped

SEQ ID NO: 20295 - DNA, 559 bp, Homo sapiens
  misc_feature 1..559: note = chr9:33676801-33677360
  misc_feature 1..559: note = hyper
  source 1..559: mol_type = genomic DNA
gctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagagg

SEQ ID NO: 20296 - DNA, 101 bp, Homo sapiens
  misc_feature 1..101: note = chr9:34589156-34589257
  misc_feature 1..101: note = hyper
  source 1..101: mol_type = genomic DNA
atttctgcccgagaaagaagccacctttgggcgcgcaaaggccactacgaacctccccaaacccaggaatttttccagaccccgcgcgtgcagctgagggg

SEQ ID NO: 20297 - DNA, 30 bp, Homo sapiens; identical to SEQ ID NO: 9887
  misc_feature 1..30: note = chr9:34590193-34590223
  misc_feature 1..30: note = hyper
  source 1..30: mol_type = genomic DNA

SEQ ID NO: 20298 - DNA, 45 bp, Homo sapiens
  misc_feature 1..45: note = chr9:35675494-35675539
  misc_feature 1..45: note = hyper
  source 1..45: mol_type = genomic DNA
ggctctaagcttgagcggttcatccttttcatttatacaggggat

SEQ ID NO: 20299 - DNA, 65 bp, Homo sapiens; identical to SEQ ID NO: 9890
  misc_feature 1..65: note = chr9:35728859-35728924
  misc_feature 1..65: note = hyper
  source 1..65: mol_type = genomic DNA

SEQ ID NO: 20300 - DNA, 308 bp, Homo sapiens; identical to SEQ ID NO: 9891
  misc_feature 1..308: note = chr9:36037287-36037595
  misc_feature 1..308: note = hyper
  source 1..308: mol_type = genomic DNA

SEQ ID NO: 20301 - DNA, 261 bp, Homo sapiens; identical to SEQ ID NO: 9892
  misc_feature 1..261: note = chr9:36258385-36258646
  misc_feature 1..261: note = hyper
  source 1..261: mol_type = genomic DNA

SEQ ID NO: 20302 - DNA, 321 bp, Homo sapiens; identical to SEQ ID NO: 9893
  misc_feature 1..321: note = chr9:36258697-36259018
  misc_feature 1..321: note = hyper
  source 1..321: mol_type = genomic DNA

SEQ ID NO: 20303 - DNA, 20 bp, Homo sapiens
  misc_feature 1..20: note = chr9:36739980-36740000
  misc_feature 1..20: note = hyper
  source 1..20: mol_type = genomic DNA
tgctccggagccagggtaca

SEQ ID NO: 20304 - DNA, 258 bp, Homo sapiens
  misc_feature 1..258: note = chr9:37025306-37025564
  misc_feature 1..258: note = hyper
  source 1..258: mol_type = genomic DNA
agacacggacatgctcgccccgggaagctcaccttcactccagccgggtctctgctgcctttgttaaataggggacctgcggctaggaaagctggatcccaggctgttgggatgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcag

SEQ ID NO: 20305 - DNA, 363 bp, Homo sapiens
  misc_feature 1..363: note = chr9:37025783-37026146
  misc_feature 1..363: note = hyper
  source 1..363: mol_type = genomic DNA
ggggtgcctgcgtggtaactaattggcttcctctttctttctttctttttcgtttcttatcctctttttttaaaggggagaagccatgagaaaaggcgtcctgcagagaaggacccaatggggtctttaagggtctctgtatgaactggccggctcctaagcagaagctgaactcagaaaccgctacttccttgatttttcaaagccccctcctcaactccaggacgcctttggagccctagccccggtgtcctcgcttagctctcaacctcttcctccacacatacagacacgggtcagggccccactatccctccaagcgccagtctggatcagccccatggctgaaaaaggcgccatcgg

SEQ ID NO: 20306 - DNA, 209 bp, Homo sapiens
  misc_feature 1..209: note = chr9:37026622-37026831
  misc_feature 1..209: note = hyper
  source 1..209: mol_type = genomic DNA
aggggctgcccagggcggatagggagcctcgccaccaggccaggcactgtgcgagctgggctcagaaaacactgctggagcttcggggtctctctcagagcctccctgctggagaccgcccggagctgcgcggagaggcgggaaatggtgctagcgcacccgggctaggagcgggtgcccaactccggctggcttccctccctggctgg

SEQ ID NO: 20307 - DNA, 388 bp, Homo sapiens
  misc_feature 1..388: note = chr9:37027412-37027800
  misc_feature 1..388: note = hyper
  source 1..388: mol_type = genomic DNA
ttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggcc

SEQ ID NO: 20308 - DNA, 30 bp, Homo sapiens; identical to SEQ ID NO: 9901
  misc_feature 1..30: note = chr9:37028470-37028500
  misc_feature 1..30: note = hyper
  source 1..30: mol_type = genomic DNA

SEQ ID NO: 20309 - DNA, 43 bp, Homo sapiens; identical to SEQ ID NO: 9902
  misc_feature 1..43: note = chr9:37029348-37029391
  misc_feature 1..43: note = hyper
  source 1..43: mol_type = genomic DNA

SEQ ID NO: 20310 - DNA, 112 bp, Homo sapiens
  misc_feature 1..112: note = chr9:37030655-37030767
  misc_feature 1..112: note = hyper
  source 1..112: mol_type = genomic DNA
agttttagtactgaaagacagcccattgagaataatgtgtgagaagccagagacctcgtttcactggggacacaccccctcccggcttccctttccacgcctcccagcgcac

SEQ ID NO: 20311 - DNA, 369 bp, Homo sapiens
  misc_feature 1..369: note = chr9:37034247-37034616
  misc_feature 1..369: note = hyper
  source 1..369: mol_type = genomic DNA
tgaaatgattaaggaactaaagagcttctcgccatgtgagatcatgtcctgttctcgccaacatcacaagatgtccccagacacgccgcgcccccagcgcgccgccccacactgccggcccggagcgaggaaagggtaggcgctgcgcggccgggcctgctcagcgcgccagacgtggcggacccggcccggccggagtagagcgggaagccgggagagcagcagtgctgctgccgcgccgccccagacttttataggggttggggggagggaaggaaggcttcagcctgcgccgggcgctagccagcgcacctacgggaaggggcagaccgaagcggagcccgggagcccgggtcttccagccgcacc

SEQ ID NO: 20312 - DNA, 133 bp, Homo sapiens
  misc_feature 1..133: note = chr9:37034731-37034864
  misc_feature 1..133: note = hyper
  source 1..133: mol_type = genomic DNA
gaagaaattaactgctcggccaagcaggtgcttttgaaaggggttgcaaaggctggcagtgttgccaggcaccgaggcgacgttccggtttactccgattcacccctagggcggcgcccgaccccagggttcc

SEQ ID NO: 20313 - DNA, 46 bp, Homo sapiens
  misc_feature 1..46: note = chr9:37035734-37035780
  misc_feature 1..46: note = hyper
  source 1..46: mol_type = genomic DNA
ggccatctccgagtgctcgactctttccctccgcagcccagcccca

SEQ ID NO: 20314 - DNA, 247 bp, Homo sapiens
  misc_feature 1..247: note = chr9:37036647-37036894
  misc_feature 1..247: note = hyper
  source 1..247: mol_type = genomic DNA
cagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatccccca

SEQ ID NO: 20315 - DNA, 218 bp, Homo sapiens
  misc_feature 1..218: note = chr9:37037453-37037671
  misc_feature 1..218: note = hyper
  source 1..218: mol_type = genomic DNA
gggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggc

SEQ ID NO: 20316 - DNA, 54 bp, Homo sapiens; identical to SEQ ID NO: 9908
  misc_feature 1..54: note = chr9:38424355-38424409
  misc_feature 1..54: note = hyper
  source 1..54: mol_type = genomic DNA

SEQ ID NO: 20317 - DNA, 30 bp, Homo sapiens; identical to SEQ ID NO: 9909
  misc_feature 1..30: note = chr9:38621877-38621907
  misc_feature 1..30: note = hyper
  source 1..30: mol_type = genomic DNA

SEQ ID NO: 20318 - DNA, 42 bp, Homo sapiens; identical to SEQ ID NO: 9910
  misc_feature 1..42: note = chr9:38622559-38622601
  misc_feature 1..42: note = hyper
  source 1..42: mol_type = genomic DNA

SEQ ID NO: 20319 - DNA, 25 bp, Homo sapiens
  misc_feature 1..25: note = chr9:66458550-66458575
  misc_feature 1..25: note = hyper
  source 1..25: mol_type = genomic DNA
gggcggcctcctttccgcccacgct

SEQ ID NO: 20320 - DNA, 34 bp, Homo sapiens; identical to SEQ ID NO: 9912
  misc_feature 1..34: note = chr9:66494123-66494157
  misc_feature 1..34: note = hyper
  source 1..34: mol_type = genomic DNA

SEQ ID NO: 20321 - DNA, 78 bp, Homo sapiens; identical to SEQ ID NO: 9914
  misc_feature 1..78: note = chr9:74061681-74061759
  misc_feature 1..78: note = hyper
  source 1..78: mol_type = genomic DNA

SEQ ID NO: 20322 - DNA, 51 bp, Homo sapiens
  misc_feature 1..51: note = chr9:74061787-74061838
  misc_feature 1..51: note = hyper
  source 1..51: mol_type = genomic DNA
cgccgagcgctctcgctggctcctcgccgcgggtctccctccagcctgcgc

SEQ ID NO: 20323 - DNA, 21 bp, Homo sapiens
  misc_feature 1..21: note = chr9:74062070-74062091
  misc_feature 1..21: note = hyper
  source 1..21: mol_type = genomic DNA
atgcgccgcagggtagcgctc

SEQ ID NO: 20324 - DNA, 49 bp, Homo sapiens; identical to SEQ ID NO: 9916
  misc_feature 1..49: note = chr9:74764314-74764363
  misc_feature 1..49: note = hyper
  source 1..49: mol_type = genomic DNA

SEQ ID NO: 20325 - DNA, 80 bp, Homo sapiens; identical to SEQ ID NO: 9917
  misc_feature 1..80: note = chr9:77111763-77111843
  misc_feature 1..80: note = hyper
  source 1..80: mol_type = genomic DNA

SEQ ID NO: 20326 - DNA, 69 bp, Homo sapiens; identical to SEQ ID NO: 9918
  misc_feature 1..69: note = chr9:77112827-77112896
  misc_feature 1..69: note = hyper
  source 1..69: mol_type = genomic DNA

SEQ ID NO: 20327 - DNA, 96 bp, Homo sapiens
  misc_feature 1..96: note = chr9:77112897-77112993
  misc_feature 1..96: note = hyper
  source 1..96: mol_type = genomic DNA
aggtaagcgagtctgcgggcaccgaggctccccgagtccggccaactccagccagacggggagatgggggaggggagggcacccagcagaaaggga

SEQ ID NO: 20328 - DNA, 18 bp, Homo sapiens
  misc_feature 1..18: note = chr9:77114851-77114869
  misc_feature 1..18: note = hyper
  source 1..18: mol_type = genomic DNA
gcgcggggtggggatggg

SEQ ID NO: 20329 - DNA, 28 bp, Homo sapiens
  misc_feature 1..28: note = chr9:79627370-79627398
  misc_feature 1..28: note = hyper
  source 1..28: mol_type = genomic DNA
ggaggccaacagccgcttaggagagccc

SEQ ID NO: 20330 - DNA, 35 bp, Homo sapiens; identical to SEQ ID NO: 9925
  misc_feature 1..35: note = chr9:79628238-79628273
  misc_feature 1..35: note = hyper
  source 1..35: mol_type = genomic DNA

SEQ ID NO: 20331 - DNA, 54 bp, Homo sapiens; identical to SEQ ID NO: 9927
  misc_feature 1..54: note = chr9:79631016-79631070
  misc_feature 1..54: note = hyper
  source 1..54: mol_type = genomic DNA

SEQ ID NO: 20332 - DNA, 30 bp, Homo sapiens; identical to SEQ ID NO: 9930
  misc_feature 1..30: note = chr9:79632823-79632853
  misc_feature 1..30: note = hyper
  source 1..30: mol_type = genomic DNA

SEQ ID NO: 20333 - DNA, 63 bp, Homo sapiens
  misc_feature 1..63: note = chr9:79633334-79633397
  misc_feature 1..63: note = hyper
  source 1..63: mol_type = genomic DNA
gtggcccgggtggggcgcagctgcgggaaatgcacccggagctgtgccccctcccggcgaaca

SEQ ID NO: 20334 - DNA, 45 bp, Homo sapiens
  misc_feature 1..45: note = chr9:79637274-79637319
  misc_feature 1..45: note = hyper
  source 1..45: mol_type = genomic DNA
aagcttctctctggatatctatgctagccccgtgtgaaggtgttt

SEQ ID NO: 20335 - DNA, 40 bp, Homo sapiens; identical to SEQ ID NO: 9940
  misc_feature 1..40: note = chr9:80263460-80263500
  misc_feature 1..40: note = hyper
  source 1..40: mol_type = genomic DNA

SEQ ID NO: 20336 - DNA, 265 bp, Homo sapiens
  misc_feature 1..265: note = chr9:87283038-87283303
  misc_feature 1..265: note = hyper
  source 1..265: mol_type = genomic DNA
ttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgt

SEQ ID NO: 20337 - DNA, 30 bp, Homo sapiens; identical to SEQ ID NO: 9944
  misc_feature 1..30: note = chr9:87283616-87283646
  misc_feature 1..30: note = hyper
  source 1..30: mol_type = genomic DNA

SEQ ID NO: 20338 - DNA, 30 bp, Homo sapiens; identical to SEQ ID NO: 9945
  misc_feature 1..30: note = chr9:87284009-87284039
  misc_feature 1..30: note = hyper
  source 1..30: mol_type = genomic DNA

SEQ ID NO: 20339 - DNA, 151 bp, Homo sapiens
  misc_feature 1..151: note = chr9:87284555-87284706
  misc_feature 1..151: note = hyper
  source 1..151: mol_type = genomic DNA
ttgtgtgtgtatgagcgtgtgtgtgtttttggatttcagactaattttctggagtttctgcccctgctctgcgtcagccctcacgtcacttcgccagcagtagcagaggcggcggcggcggctcccggaattgggttggagcaggagcctc

SEQ ID NO: 20340 - DNA, 196 bp, Homo sapiens
  misc_feature 1..196: note = chr9:87284798-87284994
  misc_feature 1..196: note = hyper
  source 1..196: mol_type = genomic DNA
cccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcat

SEQ ID NO: 20341 - DNA, 61 bp, Homo sapiens
  misc_feature 1..61: note = chr9:87285472-87285533
  misc_feature 1..61: note = hyper
  source 1..61: mol_type = genomic DNA
ccctgccgcctgccggaacactcttcgctccggaccagctcagcctctgataagctggact

SEQ ID NO: 20342 - DNA, 116 bp, Homo sapiens
  misc_feature 1..116: note = chr9:88137998-88138114
  misc_feature 1..116: note = hyper
  source 1..116: mol_type = genomic DNA
gagaactgatgcttagtaagcttaaaagccccagaaaggaagtctgtacaaatccttaatgatccagtcaattgtcgctgcataacaaaccaccccagaaccggtaacttgaaaca

SEQ ID NO: 20343 - DNA, 45 bp, Homo sapiens
  misc_feature 1..45: note = chr9:89560715-89560760
  misc_feature 1..45: note = hyper
  source 1..45: mol_type = genomic DNA
ggggcgccaagcggccgccgccgccgctgctcctgcgcccaggcc

SEQ ID NO: 20344 - DNA, 35 bp, Homo sapiens; identical to SEQ ID NO: 9951
  misc_feature 1..35: note = chr9:89560977-89561012
  misc_feature 1..35: note = hyper
  source 1..35: mol_type = genomic DNA

SEQ ID NO: 20345 - skipped

SEQ ID NO: 20346 - DNA, 52 bp, Homo sapiens
  misc_feature 1..52: note = chr9:91150170-91150222
  misc_feature 1..52: note = hyper
  source 1..52: mol_type = genomic DNA
tgctccagccacaggcgaggcctggccaaggtgtgggcgcatctggggcagg

SEQ ID NO: 20347 - DNA, 43 bp, Homo sapiens
  misc_feature 1..43: note = chr9:91606058-91606101
  misc_feature 1..43: note = hyper
  source 1..43: mol_type = genomic DNA
cgcccggtttctgcacctggagctcgcccgatgaggacaaggt

SEQ ID NO: 20348 - DNA, 38 bp, Homo sapiens; identical to SEQ ID NO: 9955
  misc_feature 1..38: note = chr9:91606320-91606358
  misc_feature 1..38: note = hyper
  source 1..38: mol_type = genomic DNA

SEQ ID NO: 20349 - DNA, 30 bp, Homo sapiens; identical to SEQ ID NO: 9958
  misc_feature 1..30: note = chr9:91849779-91849809
  misc_feature 1..30: note = hyper
  source 1..30: mol_type = genomic DNA

SEQ ID NO: 20350 - DNA, 12 bp, Homo sapiens
  misc_feature 1..12: note = chr9:94183858-94183870
  misc_feature 1..12: note = hyper
  source 1..12: mol_type = genomic DNA
cagaccccaccg

SEQ ID NO: 20351 - DNA, 30 bp, Homo sapiens; identical to SEQ ID NO: 9960
  misc_feature 1..30: note = chr9:94711494-94711524
  misc_feature 1..30: note = hyper
  source 1..30: mol_type = genomic DNA

SEQ ID NO: 20352 - DNA, 120 bp, Homo sapiens; identical to SEQ ID NO: 3429
  misc_feature 1..120: note = chr9:94712294-94712414
  misc_feature 1..120: note = hyper
  source 1..120: mol_type = genomic DNA

SEQ ID NO: 20353 - DNA, 70 bp, Homo sapiens; identical to SEQ ID NO: 9962
  misc_feature 1..70: note = chr9:94713007-94713077
  misc_feature 1..70: note = hyper
  source 1..70: mol_type = genomic DNA

SEQ ID NO: 20354 - DNA, 263 bp, Homo sapiens
  misc_feature 1..263: note = chr9:95569984-95570247
  misc_feature 1..263: note = hyper
  source 1..263: mol_type = genomic DNA
tgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccg

SEQ ID NO: 20355 - DNA, 67 bp, Homo sapiens
  misc_feature 1..67: note = chr9:95570434-95570501
  misc_feature 1..67: note = hyper
  source 1..67: mol_type = genomic DNA
ccagacaaggcaaccgaagttcatcctctctgagttgacttcgtgcgggcagcgggccggcgcccag

SEQ ID NO: 20356 - DNA, 73 bp, Homo sapiens
  misc_feature 1..73: note = chr9:95571544-95571617
  misc_feature 1..73: note = hyper
  source 1..73: mol_type = genomic DNA
ctcgggagcggtttccggagtccgagctggcgctgagctgcaggcgcgagcctaaaggcttagccggggccca

SEQ ID NO: 20357 - DNA, 171 bp, Homo sapiens
  misc_feature 1..171: note = chr9:95571760-95571931
  misc_feature 1..171: note = hyper
  source 1..171: mol_type = genomic DNA
atcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtc

SEQ ID NO: 20358 - DNA, 109 bp, Homo sapiens; identical to SEQ ID NO: 9965
  misc_feature 1..109: note = chr9:95572141-95572250
  misc_feature 1..109: note = hyper
  source 1..109: mol_type = genomic DNA

SEQ ID NO: 20359 - DNA, 37 bp, Homo sapiens
  misc_feature 1..37: note = chr9:96588885-96588922
  misc_feature 1..37: note = hyper
  source 1..37: mol_type = genomic DNA
tacgggcggaggcaggggcgggcgggggctttcagca

SEQ ID NO: 20360 - DNA, 129 bp, Homo sapiens; identical to SEQ ID NO: 9967
  misc_feature 1..129: note = chr9:96708329-96708458
  misc_feature 1..129: note = hyper
  source 1..129: mol_type = genomic DNA

SEQ ID NO: 20361 - DNA, 267 bp, Homo sapiens
  misc_feature 1..267: note = chr9:96710991-96711258
  misc_feature 1..267: note = hyper
  source 1..267: mol_type = genomic DNA
ccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccg

SEQ ID NO: 20362 - DNA, 68 bp, Homo sapiens
  misc_feature 1..68: note = chr9:96717466-96717534
  misc_feature 1..68: note = hyper
  source 1..68: mol_type = genomic DNA
ggcggcgacggcttggctccggcgcggggcccgcgcggggctctaggccggcccgcagctcggggcgg

SEQ ID NO: 20363 - DNA, 50 bp, Homo sapiens
  misc_feature 1..50: note = chr9:96718149-96718199
  misc_feature 1..50: note = hyper
  source 1..50: mol_type = genomic DNA
cccggaaaggtcgggaggaggaggggcaaaggccgcgctcctcagctggg

SEQ ID NO: 20364 - DNA, 16 bp, Homo sapiens
  misc_feature 1..16: note = chr9:98111349-98111365
  misc_feature 1..16: note = hyper
  source 1..16: mol_type = genomic DNA
ctaccaggacacatgc

SEQ ID NO: 20365 - DNA, 47 bp, Homo sapiens; identical to SEQ ID NO: 9980
  misc_feature 1..47: note = chr9:98783352-98783399
  misc_feature 1..47: note = hyper
  source 1..47: mol_type = genomic DNA

SEQ ID NO: 20366 - DNA, 33 bp, Homo sapiens; identical to SEQ ID NO: 9981
  misc_feature 1..33: note = chr9:98784201-98784234
  misc_feature 1..33: note = hyper
  source 1..33: mol_type = genomic DNA

SEQ ID NO: 20367 - DNA, 13 bp, Homo sapiens
  misc_feature 1..13: note = chr9:98790000-98790013
  misc_feature 1..13: note = hyper
  source 1..13: mol_type = genomic DNA
cctccaaggcccc

SEQ ID NO: 20368 - DNA, 20 bp, Homo sapiens
  misc_feature 1..20: note = chr9:99639601-99639621
  misc_feature 1..20: note = hyper
  source 1..20: mol_type = genomic DNA
aacacccccagatgccgctg

SEQ ID NO: 20369 - DNA, 91 bp, Homo sapiens
  misc_feature 1..91: note = chr9:99639942-99640033
  misc_feature 1..91: note = hyper
  source 1..91: mol_type = genomic DNA
gcggtcttgaagcaatttcccggcaaagtcccgggacagcgggaaagaaactggtctccctgcctggggtcgttcccggtggatgtgcctc

SEQ ID NO: 20370 - DNA, 27 bp, Homo sapiens
  misc_feature 1..27: note = chr9:99983988-99984015
  misc_feature 1..27: note = hyper
  source 1..27: mol_type = genomic DNA
tcgcgcaggacatcccggaatcgcagg

SEQ ID NO: 20371 - DNA, 110 bp, Homo sapiens
  misc_feature 1..110: note = chr9:100503515-100503625
  misc_feature 1..110: note = hyper
  source 1..110: mol_type = genomic DNA
cggaactagaacaggcgggccccactgcctgcagcctgcgaggagacgccagggctgcaagcccccccgccctcctccgcccctgccgggacagtcagccgctaggggat

SEQ ID NO: 20372 - DNA, 103 bp, Homo sapiens
  misc_feature 1..103: note = chr9:100610218-100610321
  misc_feature 1..103: note = hyper
  source 1..103: mol_type = genomic DNA
cttgcactccaggcccggggggtgggggggcgggggagaagccttagggagagtggggaggaggccagaggagagctggctgctctctcgtgttgaggttcaa

SEQ ID NO: 20373 - DNA, 38 bp, Homo sapiens; identical to SEQ ID NO: 9993
  misc_feature 1..38: note = chr9:100613747-100613785
  misc_feature 1..38: note = hyper
  source 1..38: mol_type = genomic DNA

SEQ ID NO: 20374 - skipped

SEQ ID NO: 20375 - DNA, 28 bp, Homo sapiens
  misc_feature 1..28: note = chr9:100620069-100620097
  misc_feature 1..28: note = hyper
  source 1..28: mol_type = genomic DNA
ctcgcgcaccggccgggccaggtgggaa

SEQ ID NO: 20376 - DNA, 47 bp, Homo sapiens; identical to SEQ ID NO: 10004
  misc_feature 1..47: note = chr9:101469203-101469250
  misc_feature 1..47: note = hyper
  source 1..47: mol_type = genomic DNA

SEQ ID NO: 20377 - DNA, 76 bp, Homo sapiens
  misc_feature 1..76: note = chr9:101469527-101469603
  misc_feature 1..76: note = hyper
  source 1..76: mol_type = genomic DNA
ggactccagcagaagcgcccggagagtcccaggaagccaggatcaagcccagcgcctcggccccgttccgcgcgat

SEQ ID NO: 20378 - DNA, 46 bp, Homo sapiens
  misc_feature 1..46: note = chr9:101469796-101469842
  misc_feature 1..46: note = hyper
  source 1..46: mol_type = genomic DNA
ctggggcttcaggcagaacccaaaccgagggcgtggggaggggtct

SEQ ID NO: 20379 - DNA, 100 bp, Homo sapiens
  misc_feature 1..100: note = chr9:101470868-101470968
  misc_feature 1..100: note = hyper
  source 1..100: mol_type = genomic DNA
gcggcggccggggggcgccccgcgcccagccccaggccccgggcgccagaggcagcagcagcggcagcagcagtagcagtagcaggcgcgcgggcggcgg

SEQ ID NO: 20380 - DNA, 166 bp, Homo sapiens
  misc_feature 1..166: note = chr9:101471071-101471237
  misc_feature 1..166: note = hyper
  source 1..166: mol_type = genomic DNA
ggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtg

SEQ ID NO: 20381 - DNA, 47 bp, Homo sapiens; identical to SEQ ID NO: 10008
  misc_feature 1..47: note = chr9:101471465-101471512
  misc_feature 1..47: note = hyper
  source 1..47: mol_type = genomic DNA

SEQ ID NO: 20382 - DNA, 84 bp, Homo sapiens
  misc_feature 1..84: note = chr9:101706695-101706779
  misc_feature 1..84: note = hyper
  source 1..84: mol_type = genomic DNA
agtgcaggggttatagctgtgaatgggatccctgggcagctggggcggttggagcgttgtctgggcacccgagatgtctgagct

SEQ ID NO: 20383 - DNA, 92 bp, Homo sapiens; identical to SEQ ID NO: 10011
  misc_feature 1..92: note = chr9:102586697-102586789
  misc_feature 1..92: note = hyper
  source 1..92: mol_type = genomic DNA

SEQ ID NO: 20384 - DNA, 30 bp, Homo sapiens; identical to SEQ ID NO: 10012
  misc_feature 1..30: note = chr9:103790612-103790642
  misc_feature 1..30: note = hyper
  source 1..30: mol_type = genomic DNA

SEQ ID NO: 20385 - DNA, 16 bp, Homo sapiens
  misc_feature 1..16: note = chr9:104248563-104248579
  misc_feature 1..16: note = hyper
  source 1..16: mol_type = genomic DNA
cctcagtttcccaccc

SEQ ID NO: 20386 - DNA, 61 bp, Homo sapiens; identical to SEQ ID NO: 10014
  misc_feature 1..61: note = chr9:104500256-104500317
  misc_feature 1..61: note = hyper
  source 1..61: mol_type = genomic DNA

SEQ ID NO: 20387 - DNA, 174 bp, Homo sapiens; identical to SEQ ID NO: 10015
  misc_feature 1..174: note = chr9:104500856-104501030
  misc_feature 1..174: note = hyper
  source 1..174: mol_type = genomic DNA

SEQ ID NO: 20388 - DNA, 193 bp, Homo sapiens; identical to SEQ ID NO: 10016
  misc_feature 1..193: note = chr9:104501031-104501224
  misc_feature 1..193: note = hyper
  source 1..193: mol_type = genomic DNA

SEQ ID NO: 20389 - DNA, 460 bp, Homo sapiens; identical to SEQ ID NO: 10017
  misc_feature 1..460: note = chr9:108418487-108418947
  misc_feature 1..460: note = hyper
  source 1..460: mol_type = genomic DNA

SEQ ID NO: 20390 - DNA, 153 bp, Homo sapiens; identical to SEQ ID NO: 10018
  misc_feature 1..153: note = chr9:109623063-109623216
  misc_feature 1..153: note = hyper
  source 1..153: mol_type = genomic DNA

SEQ ID NO: 20391 - DNA, 170 bp, Homo sapiens; identical to SEQ ID NO: 10019
  misc_feature 1..170: note = chr9:110227815-110227985
  misc_feature 1..170: note = hyper
  source 1..170: mol_type = genomic DNA

SEQ ID NO: 20392 - DNA, 30 bp, Homo sapiens
  misc_feature 1..30: note = chr9:110228602-110228632
  misc_feature 1..30: note = hyper
  source 1..30: mol_type = genomic DNA
gccacagccagcgggcgctctggccctcgc

SEQ ID NO: 20393 - DNA, 30 bp, Homo sapiens; identical to SEQ ID NO: 10021
  misc_feature 1..30: note = chr9:111929340-111929370
  misc_feature 1..30: note = hyper
  source 1..30: mol_type = genomic DNA

SEQ ID NO: 20394 - DNA, 86 bp, Homo sapiens; identical to SEQ ID NO: 10022
  misc_feature 1..86: note = chr9:112402752-112402838
  misc_feature 1..86: note = hyper
  source 1..86: mol_type = genomic DNA

SEQ ID NO: 20395 - DNA, 79 bp, Homo sapiens; identical to SEQ ID NO: 10023
  misc_feature 1..79: note = chr9:112403209-112403288
  misc_feature 1..79: note = hyper
  source 1..79: mol_type = genomic DNA

SEQ ID NO: 20396 - DNA, 99 bp, Homo sapiens; identical to SEQ ID NO: 10024
  misc_feature 1..99: note = chr9:112542259-112542358
  misc_feature 1..99: note = hyper
  source 1..99: mol_type = genomic DNA

SEQ ID NO: 20397 - DNA, 30 bp, Homo sapiens; identical to SEQ ID NO: 10027
  misc_feature 1..30: note = chr9:113801304-113801334
  misc_feature 1..30: note = hyper
  source 1..30: mol_type = genomic DNA

SEQ ID NO: 20398 - DNA, 136 bp, Homo sapiens; identical to SEQ ID NO: 10028
  misc_feature 1..136: note = chr9:114287491-114287627
  misc_feature 1..136: note = hyper
  source 1..136: mol_type = genomic DNA

SEQ ID NO: 20399 - DNA, 96 bp, Homo sapiens; identical to SEQ ID NO: 10029
  misc_feature 1..96: note = chr9:114288004-114288100
  misc_feature 1..96: note = hyper
  source 1..96: mol_type = genomic DNA

SEQ ID NO: 20400 - DNA, 132 bp, Homo sapiens
  misc_feature 1..132: note = chr9:115653425-115653557
  misc_feature 1..132: note = hyper
  source 1..132: mol_type = genomic DNA
tctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 20401 - DNA, 147 bp, Homo sapiens; identical to SEQ ID NO: 10031
  misc_feature 1..147: note = chr9:118916648-118916795
  misc_feature 1..147: note = hyper
  source 1..147: mol_type = genomic DNA

SEQ ID NO: 20402 - DNA, 30 bp, Homo sapiens; identical to SEQ ID NO: 10032
  misc_feature 1..30: note = chr9:118917350-118917380
  misc_feature 1..30: note = hyper
  source 1..30: mol_type = genomic DNA

SEQ ID NO: 20403 - DNA, 231 bp, Homo sapiens
  misc_feature 1..231: note = chr9:120175564-120175795
  misc_feature 1..231: note = hyper
  source 1..231: mol_type = genomic DNA
cggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaa

SEQ ID NO: 20404 - DNA, 30 bp, Homo sapiens; identical to SEQ ID NO: 10034
  misc_feature 1..30: note = chr9:120176040-120176070
  misc_feature 1..30: note = hyper
  source 1..30: mol_type = genomic DNA

SEQ ID NO: 20405 - DNA, 42 bp, Homo sapiens
  misc_feature 1..42: note = chr9:120176825-120176867
  misc_feature 1..42: note = hyper
  source 1..42: mol_type = genomic DNA
tgcgccccggcagctcgttacgcacaaagagcaggaggcgcg

SEQ ID NO: 20406 - DNA, 424 bp, Homo sapiens
  misc_feature 1..424: note = chr9:120176897-120177321
  misc_feature 1..424: note = hyper
  source 1..424: mol_type = genomic DNA
agcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccagga

SEQ ID NO: 20407 - DNA, 95 bp, Homo sapiens; identical to SEQ ID NO: 3457
  misc_feature 1..95: note = chr9:120177898-120177993
  misc_feature 1..95: note = hyper
  source 1..95: mol_type = genomic DNA

SEQ ID NO: 20408 - DNA, 30 bp, Homo sapiens; identical to SEQ ID NO: 10037
  misc_feature 1..30: note = chr9:122131178-122131208
  misc_feature 1..30: note = hyper
  source 1..30: mol_type = genomic DNA

SEQ ID NO: 20409 - DNA, 42 bp, Homo sapiens
  misc_feature 1..42: note = chr9:122131838-122131880
  misc_feature 1..42: note = hyper
  source 1..42: mol_type = genomic DNA
gagggaggagctgaacgccggggttgcttccgaggagtgttt

SEQ ID NO: 20410 - DNA, 36 bp, Homo sapiens; identical to SEQ ID NO: 10040
  misc_feature 1..36: note = chr9:124990570-124990606
  misc_feature 1..36: note = hyper
  source 1..36: mol_type = genomic DNA

SEQ ID NO: 20411 - DNA, 710 bp, Homo sapiens; identical to SEQ ID NO: 10041
  misc_feature 1..710: note = chr9:126770648-126771358
  misc_feature 1..710: note = hyper
  source 1..710: mol_type = genomic DNA

SEQ ID NO: 20412 - DNA, 35 bp, Homo sapiens
  misc_feature 1..35: note = chr9:126771705-126771740
  misc_feature 1..35: note = hyper
  source 1..35: mol_type = genomic DNA
cacgtttcttgagcagcccgcggcaagagttgctg

SEQ ID NO: 20413 - DNA, 286 bp, Homo sapiens; identical to SEQ ID NO: 10043
  misc_feature 1..286: note = chr9:126773494-126773780
  misc_feature 1..286: note = hyper
  source 1..286: mol_type = genomic DNA

SEQ ID NO: 20414 - DNA, 51 bp, Homo sapiens; identical to SEQ ID NO: 10044
  misc_feature 1..51: note = chr9:126774198-126774249
  misc_feature 1..51: note = hyper
  source 1..51: mol_type = genomic DNA

SEQ ID NO: 20415 - DNA, 30 bp, Homo sapiens; identical to SEQ ID NO: 10050
  misc_feature 1..30: note = chr9:126780564-126780594
  misc_feature 1..30: note = hyper
  source 1..30: mol_type = genomic DNA

SEQ ID NO: 20416 - DNA, 30 bp, Homo sapiens; identical to SEQ ID NO: 10052
  misc_feature 1..30: note = chr9:126781276-126781306
  misc_feature 1..30: note = hyper
  source 1..30: mol_type = genomic DNA

SEQ ID NO: 20417 - DNA, 133 bp, Homo sapiens; identical to SEQ ID NO: 10054
  misc_feature 1..133: note = chr9:126785171-126785304
  misc_feature 1..133: note = hyper
  source 1..133: mol_type = genomic DNA

SEQ ID NO: 20418 - DNA, 41 bp, Homo sapiens
  misc_feature 1..41: note = chr9:127266346-127266387
  misc_feature 1..41: note = hyper
  source 1..41: mol_type = genomic DNA
agagagaaacgaggggtgggggattggatcagagactcgga

SEQ ID NO: 20419 - DNA, 54 bp, Homo sapiens
  misc_feature 1..54: note = chr9:127266534-127266588
  misc_feature 1..54: note = hyper
  source 1..54: mol_type = genomic DNA
gaggcggaagcgcccagcccgagggtcggggacaggggacgcgcggaaacctgc

SEQ ID NO: 20420 - DNA, 219 bp, Homo sapiens; identical to SEQ ID NO: 10058
  misc_feature 1..219: note = chr9:127266628-127266847
  misc_feature 1..219: note = hyper
  source 1..219: mol_type = genomic DNA

SEQ ID NO: 20421 - DNA, 172 bp, Homo sapiens; identical to SEQ ID NO: 10059
  misc_feature 1..172: note = chr9:127266865-127267037
  misc_feature 1..172: note = hyper
  source 1..172: mol_type = genomic DNA

SEQ ID NO: 20422 - DNA, 91 bp, Homo sapiens; identical to SEQ ID NO: 10060
  misc_feature 1..91: note = chr9:127267360-127267451
  misc_feature 1..91: note = hyper
  source 1..91: mol_type = genomic DNA

SEQ ID NO: 20423 - DNA, 274 bp, Homo sapiens
  misc_feature 1..274: note = chr9:128651926-128652200
  misc_feature 1..274: note = hyper
  source 1..274: mol_type = genomic DNA
taaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcg

SEQ ID NO: 20424 - DNA, 18 bp, Homo sapiens
  misc_feature 1..18: note = chr9:128652232-128652250
  misc_feature 1..18: note = hyper
  source 1..18: mol_type = genomic DNA
ctgcgccccgctgtagca

SEQ ID NO: 20425 - DNA, 51 bp, Homo sapiens
  misc_feature 1..51: note = chr9:129276667-129276718
  misc_feature 1..51: note = hyper
  source 1..51: mol_type = genomic DNA
gggcgcccggctccccggccctcgctgggccctgcgggaacgccccggccg

SEQ ID NO: 20426 - DNA, 83 bp, Homo sapiens
  misc_feature 1..83: note = chr9:129276820-129276903
  misc_feature 1..83: note = hyper
  source 1..83: mol_type = genomic DNA
aggctagcccgccgcgcaagtccccgcagcgccccgccggcctcccaccccctgcggcgtccggacctcgtggacctggggtg

SEQ ID NO: 20427 - DNA, 36 bp, Homo sapiens; identical to SEQ ID NO: 10063
  misc_feature 1..36: note = chr9:129372722-129372758
  misc_feature 1..36: note = hyper
  source 1..36: mol_type = genomic DNA

SEQ ID NO: 20428 - DNA, 30 bp, Homo sapiens; identical to SEQ ID NO: 10064
  misc_feature 1..30: note = chr9:129373250-129373280
  misc_feature 1..30: note = hyper
  source 1..30: mol_type = genomic DNA

SEQ ID NO: 20429 - DNA, 55 bp, Homo sapiens
  misc_feature 1..55: note = chr9:129377159-129377214
  misc_feature 1..55: note = hyper
  source 1..55: mol_type = genomic DNA
tagcaatcaccttggcgagcttgggagaggcgcaaggtcacctggggtgggggag

SEQ ID NO: 20430 - DNA, 12 bp, Homo sapiens
  misc_feature 1..12: note = chr9:129377592-129377604
  misc_feature 1..12: note = hyper
  source 1..12: mol_type = genomic DNA
ggtgcgaccggg

SEQ ID NO: 20431 - DNA, 15 bp, Homo sapiens
  misc_feature 1..15: note = chr9:129386182-129386197
  misc_feature 1..15: note = hyper
  source 1..15: mol_type = genomic DNA
tccaggcccacctct

SEQ ID NO: 20432 - skipped

SEQ ID NO: 20433 - DNA, 104 bp, Homo sapiens
  misc_feature 1..104: note = chr9:129388200-129388304
  misc_feature 1..104: note = hyper
  source 1..104: mol_type = genomic DNA
cgggcgtcggagaagcggccgcgctgttccgggtcactgcaccggctgaaaaaaccaaaagcaaaaccaacacccagaaacgaagcctgcgtgcccccgggggc

SEQ ID NO: 20434 - DNA, 25 bp, Homo sapiens
  misc_feature 1..25: note = chr9:129389192-129389217
  misc_feature 1..25: note = hyper
  source 1..25: mol_type = genomic DNA
tcagcccggccgggcccgcagcgtc

SEQ ID NO: 20435 - DNA, 46 bp, Homo sapiens
  misc_feature 1..46: note = chr9:129400940-129400986
  misc_feature 1..46: note = hyper
  source 1..46: mol_type = genomic DNA
aaagacctcggggcgcgtggcgcagcggcggctcggagctcccatt

SEQ ID NO: 20436 - DNA, 65 bp, Homo sapiens
  misc_feature 1..65: note = chr9:129445813-129445878
  misc_feature 1..65: note = hyper
  source 1..65: mol_type = genomic DNA
gtctagggtcctgtcgcctagctcctgtgaactgcagctcatccttcagccggcatcatcagagc

SEQ ID NO: 20437 - DNA, 189 bp, Homo sapiens
  misc_feature 1..189: note = chr9:130461742-130461931
  misc_feature 1..189: note = hyper
  source 1..189: mol_type = genomic DNA
ctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 20438 - DNA, 319 bp, Homo sapiens; identical to SEQ ID NO: 10076
  misc_feature 1..319: note = chr9:131872526-131872845
  misc_feature 1..319: note = hyper
  source 1..319: mol_type = genomic DNA

SEQ ID NO: 20439 - DNA, 30 bp, Homo sapiens; identical to SEQ ID NO: 10077
  misc_feature 1..30: note = chr9:131872856-131872886
  misc_feature 1..30: note = hyper
  source 1..30: mol_type = genomic DNA

SEQ ID NO: 20440 - DNA, 69 bp, Homo sapiens; identical to SEQ ID NO: 3468
  misc_feature 1..69: note = chr9:132382286-132382355
  misc_feature 1..69: note = hyper
  source 1..69: mol_type = genomic DNA

SEQ ID NO: 20441 - DNA, 181 bp, Homo sapiens; identical to SEQ ID NO: 10080
  misc_feature 1..181: note = chr9:132428476-132428657
  misc_feature 1..181: note = hyper
  source 1..181: mol_type = genomic DNA

SEQ ID NO: 20442 - DNA, 26 bp, Homo sapiens
  misc_feature 1..26: note = chr9:133308867-133308893
  misc_feature 1..26: note = hyper
  source 1..26: mol_type = genomic DNA
ggcgtccccgccaaccgcaccgagct

SEQ ID NO: 20443 - DNA, 32 bp, Homo sapiens
  misc_feature 1..32: note = chr9:133308941-133308973
  misc_feature 1..32: note = hyper
  source 1..32: mol_type = genomic DNA
gcgcgcgggccttggcgcggtctacacccgtc

SEQ ID NO: 20444 - DNA, 100 bp, Homo sapiens
  misc_feature 1..100: note = chr9:133534583-133534683
  misc_feature 1..100: note = hyper
  source 1..100: mol_type = genomic DNA
gtctttgtacccctgcgtctccgactcggcctttcatctgctccctccacctcggcatcgccttgcctcagtctcccccgacccctgtctcgccccctct

SEQ ID NO: 20445 - DNA, 220 bp, Homo sapiens
  misc_feature 1..220: note = chr9:133534713-133534933
  misc_feature 1..220: note = hyper
  source 1..220: mol_type = genomic DNA
caccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcc

SEQ ID NO: 20446 - DNA, 174 bp, Homo sapiens; identical to SEQ ID NO: 10083
  misc_feature 1..174: note = chr9:133535311-133535485
  misc_feature 1..174: note = hyper
  source 1..174: mol_type = genomic DNA

SEQ ID NO: 20447 - DNA, 95 bp, Homo sapiens
  misc_feature 1..95: note = chr9:133535839-133535934
  misc_feature 1..95: note = hyper
  source 1..95: mol_type = genomic DNA
gaggaggaggcgcgcggagctcccgggaggggggacaaatctctccctccgaggggcgagaacaggagactttcttctaaagttcaaaagaaaga

SEQ ID NO: 20448 - DNA, 126 bp, Homo sapiens
  misc_feature 1..126: note = chr9:133535971-133536097
  misc_feature 1..126: note = hyper
  source 1..126: mol_type = genomic DNA
cggacaatgggcttctttctgcgcctctgagggccggcggggcgggcagggcggggacccgtgcgctttggccccgcctgaccgactcgcacccccctcccccgcacccaggcccgggccccagag

SEQ ID NO: 20449 - skipped

SEQ ID NO: 20450 - DNA, 160 bp, Homo sapiens; identical to SEQ ID NO: 3474
  misc_feature 1..160: note = chr9:133536346-133536506
  misc_feature 1..160: note = hyper
  source 1..160: mol_type = genomic DNA

SEQ ID NO: 20451 - skipped

SEQ ID NO: 20452 - DNA, 112 bp, Homo sapiens
  misc_feature 1..112: note = chr9:133537070-133537182
  misc_feature 1..112: note = hyper
  source 1..112: mol_type = genomic DNA
caccttgagactgggcgctacctacgggctcctttttccccgggcgggggtccaggtgggttttgccgctagactagaagcacaaaatgtgagcgcggtggagatttgggcg

SEQ ID NO: 20453 - DNA, 264 bp, Homo sapiens; identical to SEQ ID NO: 10090
  misc_feature 1..264: note = chr9:133537606-133537870
  misc_feature 1..264: note = hyper
  source 1..264: mol_type = genomic DNA

SEQ ID NO: 20454 - DNA, 452 bp, Homo sapiens
  misc_feature 1..452: note = chr9:133538728-133539180
  misc_feature 1..452: note = hyper
  source 1..452: mol_type = genomic DNA
tttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggg

SEQ ID NO: 20455 - DNA, 37 bp, Homo sapiens; identical to SEQ ID NO: 10093
  misc_feature 1..37: note = chr9:133540453-133540490
  misc_feature 1..37: note = hyper
  source 1..37: mol_type = genomic DNA

SEQ ID NO: 20456 - DNA, 273 bp, Homo sapiens
  misc_feature 1..273: note = chr9:133541192-133541465
  misc_feature 1..273: note = hyper
  source 1..273: mol_type = genomic DNA
gtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggc

SEQ ID NO: 20457 - DNA, 24 bp, Homo sapiens
  misc_feature 1..24: note = chr9:133541665-133541689
  misc_feature 1..24: note = hyper
  source 1..24: mol_type = genomic DNA
attcttaaacttatccggggcaga

SEQ ID NO: 20458 - DNA, 70 bp, Homo sapiens
  misc_feature 1..70: note = chr9:133542337-133542407
  misc_feature 1..70: note = hyper
  source 1..70: mol_type = genomic DNA
cccgagcctggagctcaccccgcctctaggctcctcccaacccgtgccgaaaatccgaccctccttcccc

SEQ ID NO: 20459 - DNA, 394 bp, Homo sapiens; identical to SEQ ID NO: 10096
  misc_feature 1..394: note = chr9:134151976-134152370
  misc_feature 1..394: note = hyper
  source 1..394: mol_type = genomic DNA

SEQ ID NO: 20460 - DNA, 34 bp, Homo sapiens; identical to SEQ ID NO: 10097
  misc_feature 1..34: note = chr9:135285831-135285865
  misc_feature 1..34: note = hyper
  source 1..34: mol_type = genomic DNA

SEQ ID NO: 20461 - DNA, 169 bp, Homo sapiens; identical to SEQ ID NO: 10098
  misc_feature 1..169: note = chr9:135285880-135286049
  misc_feature 1..169: note = hyper
  source 1..169: mol_type = genomic DNA

SEQ ID NO: 20462 - DNA, 107 bp, Homo sapiens; identical to SEQ ID NO: 10099
  misc_feature 1..107: note = chr9:135455044-135455151
  misc_feature 1..107: note = hyper
  source 1..107: mol_type = genomic DNA

SEQ ID NO: 20463 - DNA, 411 bp, Homo sapiens
  misc_feature 1..411: note = chr9:135455585-135455996
  misc_feature 1..411: note = hyper
  source 1..411: mol_type = genomic DNA
agtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgacc

SEQ ID NO: 20464 - DNA, 70 bp, Homo sapiens
  misc_feature 1..70: note = chr9:135456827-135456897
  misc_feature 1..70: note = hyper
  source 1..70: mol_type = genomic DNA
ctacatgggaaacaccgagagcccaacagaaatgccgcaaacaacataacttgaattttcttccccacac

SEQ ID NO: 20465 - DNA, 383 bp, Homo sapiens; identical to SEQ ID NO: 10102
  misc_feature 1..383: note = chr9:135456970-135457353
  misc_feature 1..383: note = hyper
  source 1..383: mol_type = genomic DNA

SEQ ID NO: 20466 - skipped

SEQ ID NO: 20467 - DNA, 39 bp, Homo sapiens
  misc_feature 1..39: note = chr9:135461773-135461812
  misc_feature 1..39: note = hyper
  source 1..39: mol_type = genomic DNA
aggagggtgagcattgagcttgttcgattaagtgttttc

SEQ ID NO: 20468 - DNA, 21 bp, Homo sapiens
  misc_feature 1..21: note = chr9:135464918-135464939
  misc_feature 1..21: note = hyper
  source 1..21: mol_type = genomic DNA
cggctccggggcctcctcccg

SEQ ID NO: 20469 - DNA, 61 bp, Homo sapiens
  misc_feature 1..61: note = chr9:135465887-135465948
  misc_feature 1..61: note = hyper
  source 1..61: mol_type = genomic DNA
ccatctggttcctagcggctcccagacggtcccgagggccggggcgggggtccgtgccgga

SEQ ID NO: 20470 - DNA, 64 bp, Homo sapiens; identical to SEQ ID NO: 10111
  misc_feature 1..64: note = chr9:135646011-135646075
  misc_feature 1..64: note = hyper
  source 1..64: mol_type = genomic DNA

SEQ ID NO: 20471 - DNA, 144 bp, Homo sapiens; identical to SEQ ID NO: 3484
  misc_feature 1..144: note = chr9:137533823-137533967
  misc_feature 1..144: note = hyper
  source 1..144: mol_type = genomic DNA

SEQ ID NO: 20472 - DNA, 136 bp, Homo sapiens; identical to SEQ ID NO: 10116
  misc_feature 1..136: note = chr9:137534360-137534496
  misc_feature 1..136: note = hyper
  source 1..136: mol_type = genomic DNA

SEQ ID NO: 20473 - DNA, 110 bp, Homo sapiens; identical to SEQ ID NO: 10117
  misc_feature 1..110: note = chr9:137979517-137979627
  misc_feature 1..110: note = hyper
  source 1..110: mol_type = genomic DNA

SEQ ID NO: 20474 - DNA, 190 bp, Homo sapiens
  misc_feature 1..190: note = chr9:137980288-137980478
  misc_feature 1..190: note = hyper
  source 1..190: mol_type = genomic DNA
ctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctggga

SEQ ID NO: 20475 - DNA, 166 bp, Homo sapiens
  misc_feature 1..166: note = chr9:137980714-137980880
  misc_feature 1..166: note = hyper
  source 1..166: mol_type = genomic DNA
ccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaa

SEQ ID NO: 20476 - DNA, 50 bp, Homo sapiens
  misc_feature 1..50: note = chr9:137980910-137980960
  misc_feature 1..50: note = hyper
  source 1..50: mol_type = genomic DNA
ctctctctttttgctgccaggggtttagtgccctgcgaagagggctccgt

SEQ ID NO: 20477 - DNA, 95 bp, Homo sapiens; identical to SEQ ID NO: 3486
  misc_feature 1..95: note = chr9:138606154-138606249
  misc_feature 1..95: note = hyper
  source 1..95: mol_type = genomic DNA

SEQ ID NO: 20478 - DNA, 200 bp, Homo sapiens; identical to SEQ ID NO: 10121
  misc_feature 1..200: note = chr9:138628543-138628743
  misc_feature 1..200: note = hyper
  source 1..200: mol_type = genomic DNA

SEQ ID NO: 20479 - DNA, 109 bp, Homo sapiens
  misc_feature 1..109: note = chr9:139024782-139024891
  misc_feature 1..109: note = hyper
  source 1..109: mol_type = genomic DNA
cctgttcgtggggtccctggggtgcaggggtggaggacataggagtgtgggggtcgtgggcagacccaggcgggacgctgtgccagtgccgccccgaaggcccagtgcg

SEQ ID NO: 20480 - DNA, 54 bp, Homo sapiens; identical to SEQ ID NO: 10123
  misc_feature 1..54: note = chr9:139025663-139025717
  misc_feature 1..54: note = hyper
  source 1..54: mol_type = genomic DNA

SEQ ID NO: 20481 - DNA, 408 bp, Homo sapiens; identical to SEQ ID NO: 10124
  misc_feature 1..408: note = chr9:139084662-139085070
  misc_feature 1..408: note = hyper
  source 1..408: mol_type = genomic DNA

SEQ ID NO: 20482 - DNA, 161 bp, Homo sapiens; identical to SEQ ID NO: 10126
  misc_feature 1..161: note = chr9:139085372-139085533
  misc_feature 1..161: note = hyper
  source 1..161: mol_type = genomic DNA

SEQ ID NO: 20483 - DNA, 73 bp, Homo sapiens; identical to SEQ ID NO: 10127
  misc_feature 1..73: note = chr9:139089123-139089196
  misc_feature 1..73: note = hyper
  source 1..73: mol_type = genomic DNA

SEQ ID NO: 20484 - DNA, 44 bp, Homo sapiens; identical to SEQ ID NO: 10128
  misc_feature 1..44: note = chr9:139089415-139089459
  misc_feature 1..44: note = hyper
  source 1..44: mol_type = genomic DNA

SEQ ID NO: 20485 - DNA, 156 bp, Homo sapiens; identical to SEQ ID NO: 10130
  misc_feature 1..156: note = chr9:139090586-139090742
  misc_feature 1..156: note = hyper
  source 1..156: mol_type = genomic DNA

SEQ ID NO: 20486 - DNA, 156 bp, Homo sapiens
  misc_feature 1..156: note = chr9:139091369-139091525
  misc_feature 1..156: note = hyper
  source 1..156: mol_type = genomic DNA
cccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacct

SEQ ID NO: 20487 - DNA, 33 bp, Homo sapiens
  misc_feature 1..33: note = chr9:139093890-139093923
  misc_feature 1..33: note = hyper
  source 1..33: mol_type = genomic DNA
cgggggctcctgtgtcagggatggcggggtcgg

SEQ ID NO: 20488 - DNA, 37 bp, Homo sapiens; identical to SEQ ID NO: 10133
  misc_feature 1..37: note = chr9:139094162-139094199
  misc_feature 1..37: note = hyper
  source 1..37: mol_type = genomic DNA

SEQ ID NO: 20489 - DNA, 51 bp, Homo sapiens
  misc_feature 1..51: note = chr9:139094654-139094705
  misc_feature 1..51: note = hyper
  source 1..51: mol_type = genomic DNA
caggcgcggacgttccggggtcctcgcgcccactcccgcccagatcctcta

SEQ ID NO: 20490 - skipped

SEQ ID NO: 20491 - DNA, 55 bp, Homo sapiens
  misc_feature 1..55: note = chr9:139095285-139095340
  misc_feature 1..55: note = hyper
  source 1..55: mol_type = genomic DNA
ctgagctggagcacacgccaggagggctaaggttcccgggagaggggtcgagaag

SEQ ID NO: 20492 - DNA, 52 bp, Homo sapiens
  misc_feature 1..52: note = chr9:139096598-139096650
  misc_feature 1..52: note = hyper
  source 1..52: mol_type = genomic DNA
gcgtcaggccctccccgccaccctgggatctggaaactcactctctgcagtt

SEQ ID NO: 20493 - DNA, 37 bp, Homo sapiens
  misc_feature 1..37: note = chr9:139097006-139097043
  misc_feature 1..37: note = hyper
  source 1..37: mol_type = genomic DNA
cgcccgctgcccgccccgcccgcgcgcccgcccacct

SEQ ID NO: 20494 - DNA, 183 bp, Homo sapiens; identical to SEQ ID NO: 10138
  misc_feature 1..183: note = chr9:139606480-139606663
  misc_feature 1..183: note = hyper
  source 1..183: mol_type = genomic DNA

SEQ ID NO: 20495 - DNA, 147 bp, Homo sapiens
  misc_feature 1..147: note = chr9:140033762-140033909
  misc_feature 1..147: note = hyper
  source 1..147: mol_type = genomic DNA
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgcc

SEQ ID NO: 20496 - DNA, 65 bp, Homo sapiens
  misc_feature 1..65: note = chr9:140034079-140034144
  misc_feature 1..65: note = hyper
  source 1..65: mol_type = genomic DNA
caggccaacaagcggcacggctcctggaagattcagctcaatgccacctccgtcacgcacaagcc

SEQ ID NO: 20497 - DNA, 13 bp, Homo sapiens
  misc_feature 1..13: note = chr9:140050956-140050969
  misc_feature 1..13: note = hyper
  source 1..13: mol_type = genomic DNA
tcctgggttctgg

SEQ ID NO: 20498 - DNA, 137 bp, Homo sapiens
  misc_feature 1..137: note = chr9:140051354-140051491
  misc_feature 1..137: note = hyper
  source 1..137: mol_type = genomic DNA
ggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggt

SEQ ID NO: 20499 - DNA, 40 bp, Homo sapiens; identical to SEQ ID NO: 10147
  misc_feature 1..40: note = chr10:1778568-1778608
  misc_feature 1..40: note = hyper
  source 1..40: mol_type = genomic DNA

SEQ ID NO: 20500 - DNA, 239 bp, Homo sapiens; identical to SEQ ID NO: 3493
  misc_feature 1..239: note = chr10:1778844-1779083
  misc_feature 1..239: note = hyper
  source 1..239: mol_type = genomic DNA

SEQ ID NO: 20501 - DNA, 29 bp, Homo sapiens
  misc_feature 1..29: note = chr10:1779111-1779140
  misc_feature 1..29: note = hyper
  source 1..29: mol_type = genomic DNA
cggagcagccatcccgccagcaccccaaa

SEQ ID NO: 20502 - DNA, 91 bp, Homo sapiens
  misc_feature 1..91: note = chr10:1779744-1779835
  misc_feature 1..91: note = hyper
  source 1..91: mol_type = genomic DNA
tatttgctgcagcagcgtctaattagatccaatcacaactgctttctggctctgacatcagcagcagcaccagccgcaccgccgcctggcc

SEQ ID NO: 20503 - DNA, 195 bp, Homo sapiens; identical to SEQ ID NO: 10151
  misc_feature 1..195: note = chr10:1779836-1780031
  misc_feature 1..195: note = hyper
  source 1..195: mol_type = genomic DNA

SEQ ID NO: 20504 - DNA, 30 bp, Homo sapiens; identical to SEQ ID NO: 10152
  misc_feature 1..30: note = chr10:3109104-3109134
  misc_feature 1..30: note = hyper
  source 1..30: mol_type = genomic DNA

SEQ ID NO: 20505 - DNA, 837 bp, Homo sapiens
  misc_feature 1..837: note = chr10:7451390-7452227
  misc_feature 1..837: note = hyper
  source 1..837: mol_type = genomic DNA
caaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaa

SEQ ID NO: 20506 - DNA, 215 bp, Homo sapiens
  misc_feature 1..215: note = chr10:7452777-7452992
  misc_feature 1..215: note = hyper
  source 1..215: mol_type = genomic DNA
cggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattcca

SEQ ID NO: 20507 - DNA, 261 bp, Homo sapiens
  misc_feature 1..261: note = chr10:7453052-7453313
  misc_feature 1..261: note = hyper
  source 1..261: mol_type = genomic DNA
tttaagattttgtgtgtgtgtgtatgtgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatct

SEQ ID NO: 20508 - DNA, 65 bp, Homo sapiens
  misc_feature 1..65: note = chr10:7453930-7453995
  misc_feature 1..65: note = hyper
  source 1..65: mol_type = genomic DNA
gcggaaaagccggtgacgccctggtagcaagaccaagagcttccgaagaacgctgcgcccttaac

SEQ ID NO: 20509 - DNA, 100 bp, Homo sapiens; identical to SEQ ID NO: 10158
  misc_feature 1..100: note = chr10:7454472-7454572
  misc_feature 1..100: note = hyper
  source 1..100: mol_type = genomic DNA

SEQ ID NO: 20510 - DNA, 121 bp, Homo sapiens
  misc_feature 1..121: note = chr10:7708669-7708790
  misc_feature 1..121: note = hyper
  source 1..121: mol_type = genomic DNA
cggtcgaagggggcccgggcagaagctccgcggccgggccggcggagggaagggggcggccgcgcccgggacccggctcccctcggctccacttacctgctccgaagagtggccccagctc

SEQ ID NO: 20511 - DNA, 124 bp, Homo sapiens; identical to SEQ ID NO: 3501
  misc_feature 1..124: note = chr10:8076053-8076177
  misc_feature 1..124: note = hyper
  source 1..124: mol_type = genomic DNA

SEQ ID NO: 20512 - DNA, 99 bp, Homo sapiens
  misc_feature 1..99: note = chr10:8076705-8076804
  misc_feature 1..99: note = hyper
  source 1..99: mol_type = genomic DNA
cccgccccaaccctccgcagagaagccgaggaccacatccatccgcttcctaggaacctgcccgcaccagcaggccctgtttcctggacaaactgggca

SEQ ID NO: 20513 - DNA, 254 bp, Homo sapiens
  misc_feature 1..254: note = chr10:8085721-8085975
  misc_feature 1..254: note = hyper
  source 1..254: mol_type = genomic DNA
ggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtgg

SEQ ID NO: 20514 - DNA, 81 bp, Homo sapiens; identical to SEQ ID NO: 10167
  misc_feature 1..81: note = chr10:8090494-8090575
  misc_feature 1..81: note = hyper
  source 1..81: mol_type = genomic DNA

SEQ ID NO: 20515 - DNA, 37 bp, Homo sapiens
  misc_feature 1..37: note = chr10:8091858-8091895
  misc_feature 1..37: note = hyper
  source 1..37: mol_type = genomic DNA
cacggcccggtcctccggcttctctcctttgaacagg

SEQ ID NO: 20516-20517 - skipped (2 entries)

SEQ ID NO: 20518 - DNA, 72 bp, Homo sapiens; identical to SEQ ID NO: 10173
  misc_feature 1..72: note = chr10:8095387-8095459
  misc_feature 1..72: note = hyper
  source 1..72: mol_type = genomic DNA

SEQ ID NO: 20519 - DNA, 111 bp, Homo sapiens
  misc_feature 1..111: note = chr10:8095492-8095603
  misc_feature 1..111: note = hyper
  source 1..111: mol_type = genomic DNA
cgcggctcggccacagcctcgcccgctgattggtccctccaggccccgcccccgctcgccccgcccctctcgctggggcgcctcggagccgcgtgccctccgccccggggt

SEQ ID NO: 20520 - DNA, 73 bp, Homo sapiens; identical to SEQ ID NO: 10175
  misc_feature 1..73: note = chr10:8096204-8096277
  misc_feature 1..73: note = hyper
  source 1..73: mol_type = genomic DNA

SEQ ID NO: 20521 - DNA, 41 bp, Homo sapiens; identical to SEQ ID NO: 10177
  misc_feature 1..41: note = chr10:8374499-8374540
  misc_feature 1..41: note = hyper
  source 1..41: mol_type = genomic DNA

SEQ ID NO: 20522 - DNA, 172 bp, Homo sapiens; identical to SEQ ID NO: 3506
  misc_feature 1..172: note = chr10:11059492-11059664
  misc_feature 1..172: note = hyper
  source 1..172: mol_type = genomic DNA

SEQ ID NO: 20523 - DNA, 121 bp, Homo sapiens; identical to SEQ ID NO: 10180
  misc_feature 1..121: note = chr10:11060314-11060435
  misc_feature 1..121: note = hyper
  source 1..121: mol_type = genomic DNA

SEQ ID NO: 20524 - DNA, 69 bp, Homo sapiens
  misc_feature 1..69: note = chr10:13043317-13043386
  misc_feature 1..69: note = hyper
  source 1..69: mol_type = genomic DNA
ggtcgcacagcatctcgacctcggccgagtagaagaggcccccctggccggcgtggtactgccagggca

SEQ ID NO: 20525 - DNA, 109 bp, Homo sapiens
  misc_feature 1..109: note = chr10:13043425-13043534
  misc_feature 1..109: note = hyper
  source 1..109: mol_type = genomic DNA
gcaccctggcgtacacgatggtctcggccagctcggcgcggcagccctcgctcaggggcctccactcggagggcagctggcaggcgcgcgcgggcgctgggggacccgc

SEQ ID NO: 20526 - DNA, 60 bp, Homo sapiens
  misc_feature 1..60: note = chr10:13934183-13934243
  misc_feature 1..60: note = hyper
  source 1..60: mol_type = genomic DNA
gggggacccctggctcccccacaaaacccacccaaagccaccgctcgaggccctctccta

SEQ ID NO: 20527 - DNA, 125 bp, Homo sapiens; identical to SEQ ID NO: 10187
  misc_feature 1..125: note = chr10:14215748-14215873
  misc_feature 1..125: note = hyper
  source 1..125: mol_type = genomic DNA

SEQ ID NO: 20528 - DNA, 296 bp, Homo sapiens
  misc_feature 1..296: note = chr10:15760996-15761292
  misc_feature 1..296: note = hyper
  source 1..296: mol_type = genomic DNA
cgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttct

SEQ ID NO: 20529 - DNA, 183 bp, Homo sapiens
  misc_feature 1..183: note = chr10:15761671-15761854
  misc_feature 1..183: note = hyper
  source 1..183: mol_type = genomic DNA
ggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 20530 - DNA, 111 bp, Homo sapiens; identical to SEQ ID NO: 873
  misc_feature 1..111: note = chr10:15761855-15761966
  misc_feature 1..111: note = hyper
  source 1..111: mol_type = genomic DNA

SEQ ID NO: 20531 - DNA, 42 bp, Homo sapiens
  misc_feature 1..42: note = chr10:16563909-16563951
  misc_feature 1..42: note = hyper
  source 1..42: mol_type = genomic DNA
gcacccaaggcacagaggaaggggagccgctttggcatctca

SEQ ID NO: 20532 - DNA, 116 bp, Homo sapiens
  misc_feature 1..116: note = chr10:17271625-17271741
  misc_feature 1..116: note = hyper
  source 1..116: mol_type = genomic DNA
cgcctgcggagcagcgtgcccggggtgcggctcctgcaggactcggtggacttctcgctggccgacgccatcaacaccgagttcaagaacacccgcaccaacgagaaggtggagct

SEQ ID NO: 20533 - DNA, 102 bp, Homo sapiens; identical to SEQ ID NO: 10197
  misc_feature 1..102: note = chr10:17495534-17495636
  misc_feature 1..102: note = hyper
  source 1..102: mol_type = genomic DNA

SEQ ID NO: 20534 - DNA, 110 bp, Homo sapiens
  misc_feature 1..110: note = chr10:17496734-17496844
  misc_feature 1..110: note = hyper
  source 1..110: mol_type = genomic DNA
cacaccacaactctgcctgcggagagaggagaggagaaaaaggggccgcttcaaaaactttcaaaactgtgcagtcgcttggctggatcctcccacgcatgaagaaagct

SEQ ID NO: 20535 - DNA, 19 bp, Homo sapiens
  misc_feature 1..19: note = chr10:18429774-18429793
  misc_feature 1..19: note = hyper
  source 1..19: mol_type = genomic DNA
ccgccgcacaggtagcgag

SEQ ID NO: 20536 - DNA, 55 bp, Homo sapiens; identical to SEQ ID NO: 10200
  misc_feature 1..55: note = chr10:18430183-18430238
  misc_feature 1..55: note = hyper
  source 1..55: mol_type = genomic DNA

SEQ ID NO: 20537 - DNA, 33 bp, Homo sapiens; identical to SEQ ID NO: 10201
  misc_feature 1..33: note = chr10:20105577-20105610
  misc_feature 1..33: note = hyper
  source 1..33: mol_type = genomic DNA

SEQ ID NO: 20538 - DNA, 30 bp, Homo sapiens; identical to SEQ ID NO: 10202
  misc_feature 1..30: note = chr10:20106628-20106658
  misc_feature 1..30: note = hyper
  source 1..30: mol_type = genomic DNA

SEQ ID NO: 20539 - DNA, 59 bp, Homo sapiens; identical to SEQ ID NO: 10203
  misc_feature 1..59: note = chr10:21783695-21783754
  misc_feature 1..59: note = hyper
  source 1..59: mol_type = genomic DNA

SEQ ID NO: 20540 - DNA, 108 bp, Homo sapiens
  misc_feature 1..108: note = chr10:21805109-21805217
  misc_feature 1..108: note = hyper
  source 1..108: mol_type = genomic DNA
cgttccttatctcagcgaaacaactccccaggctggccgggcagtacaccggagatgctttgggggcccagctctgcagattccactccgccggcgactccgctttga

SEQ ID NO: 20541 - DNA, 21 bp, Homo sapiens
  misc_feature 1..21: note = chr10:21805277-21805298
  misc_feature 1..21: note = hyper
  source 1..21: mol_type = genomic DNA
cggcggcggaggccagatggt

SEQ ID NO: 20542 - DNA, 30 bp, Homo sapiens; identical to SEQ ID NO: 10205
  misc_feature 1..30: note = chr10:22518011-22518041
  misc_feature 1..30: note = hyper
  source 1..30: mol_type = genomic DNA

SEQ ID NO: 20543 - DNA, 402 bp, Homo sapiens
  misc_feature 1..402: note = chr10:22541236-22541638
  misc_feature 1..402: note = hyper
  source 1..402: mol_type = genomic DNA
ctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcg

SEQ ID NO: 20544 - DNA, 125 bp, Homo sapiens
  misc_feature 1..125: note = chr10:22625978-22626103
  misc_feature 1..125: note = hyper
  source 1..125: mol_type = genomic DNA
taataacatcgacacaaagaagagctcatggttgcgtctgcgcttggtaacagtggctttcctctgggttagagccacaggcacaagcacccgctgctatctttcttcttcgcctaccatgaata

SEQ ID NO: 20545 - DNA, 77 bp, Homo sapiens
  misc_feature 1..77: note = chr10:22634578-22634655
  misc_feature 1..77: note = hyper
  source 1..77: mol_type = genomic DNA
gggcaggtgccctaactagctggcgccgaggagacccgggtgcggtgggctccaccgactctctctcccgcagtgtt

SEQ ID NO: 20546 - skipped

SEQ ID NO: 20547 - DNA, 185 bp, Homo sapiens
  misc_feature 1..185: note = chr10:23216945-23217130
  misc_feature 1..185: note = hyper
  source 1..185: mol_type = genomic DNA
cgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 20548 - DNA, 22 bp, Homo sapiens
  misc_feature 1..22: note = chr10:23462910-23462932
  misc_feature 1..22: note = hyper
  source 1..22: mol_type = genomic DNA
catggtccgcaaaagacaggtg

SEQ ID NO: 20549 - DNA, 18 bp, Homo sapiens
  misc_feature 1..18: note = chr10:23481303-23481321
  misc_feature 1..18: note = hyper
  source 1..18: mol_type = genomic DNA
gggcactccagggaggcc

SEQ ID NO: 20550 - DNA, 271 bp, Homo sapiens
  misc_feature 1..271: note = chr10:23481515-23481786
  misc_feature 1..271: note = hyper
  source 1..271: mol_type = genomic DNA
gtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggc

SEQ ID NO: 20551 - DNA, 149 bp, Homo sapiens
  misc_feature 1..149: note = chr10:23481787-23481936
  misc_feature 1..149: note = hyper
  source 1..149: mol_type = genomic DNA
gcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcg

SEQ ID NO: 20552 - DNA, 15 bp, Homo sapiens
  misc_feature 1..15: note = chr10:23482445-23482460
  misc_feature 1..15: note = hyper
  source 1..15: mol_type = genomic DNA
cgcgtccccgccaga

SEQ ID NO: 20553 - DNA, 51 bp, Homo sapiens
  misc_feature 1..51: note = chr10:23483777-23483828
  misc_feature 1..51: note = hyper
  source 1..51: mol_type = genomic DNA
aaggtaggaagaagccgcccgctacccctgccaccttcgcaacaggcttac

SEQ ID NO: 20554 - DNA, 30 bp, Homo sapiens; identical to SEQ ID NO: 10232
  misc_feature 1..30: note = chr10:23486384-23486414
  misc_feature 1..30: note = hyper
  source 1..30: mol_type = genomic DNA

SEQ ID NO: 20555 - DNA, 177 bp, Homo sapiens
  misc_feature 1..177: note = chr10:23487978-23488155
  misc_feature 1..177: note = hyper
  source 1..177: mol_type = genomic DNA
gggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtg

SEQ ID NO: 20556 - DNA, 251 bp, Homo sapiens
  misc_feature 1..251: note = chr10:23489158-23489409
  misc_feature 1..251: note = hyper
  source 1..251: mol_type = genomic DNA
ttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaa

SEQ ID NO: 20557 - DNA, 51 bp, Homo sapiens
  misc_feature 1..51: note = chr10:23489439-23489490
  misc_feature 1..51: note = hyper
  source 1..51: mol_type = genomic DNA
tgctaattacaaattttaaaacaagccacttctaagcgaaggacgcctggc

SEQ ID NO: 20558 - DNA, 55 bp, Homo sapiens; identical to SEQ ID NO: 10235
  misc_feature 1..55: note = chr10:23633401-23633456
  misc_feature 1..55: note = hyper
  source 1..55: mol_type = genomic DNA

SEQ ID NO: 20559 - DNA, 44 bp, Homo sapiens
  misc_feature 1..44: note = chr10:23982394-23982438
  misc_feature 1..44: note = hyper
  source 1..44: mol_type = genomic DNA
aaaaccgttgccactcgacggtggcaaaattgctggctgcactg

SEQ ID NO: 20560 - DNA, 374 bp, Homo sapiens
  misc_feature 1..374: note = chr10:23982820-23983194
  misc_feature 1..374: note = hyper
  source 1..374: mol_type = genomic DNA
ctcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaac

SEQ ID NO: 20561 - DNA, 33 bp, Homo sapiens
  misc_feature 1..33: note = chr10:23983247-23983280
  misc_feature 1..33: note = hyper
  source 1..33: mol_type = genomic DNA
tcccccctaaacctctagcgcagctttttaaag

SEQ ID NO: 20562 - DNA, 107 bp, Homo sapiens
  misc_feature 1..107: note = chr10:23983700-23983807
  misc_feature 1..107: note = hyper
  source 1..107: mol_type = genomic DNA
gcaagcgggaggcgcactggggccgccgccgttcccgcgctcctccctctcctctgcacccactgtcacgctacccgcccgcgggggagcctcgagagcctccaggt

SEQ ID NO: 20563 - DNA, 240 bp, Homo sapiens; identical to SEQ ID NO: 10239
  misc_feature 1..240: note = chr10:23984535-23984775
  misc_feature 1..240: note = hyper
  source 1..240: mol_type = genomic DNA

SEQ ID NO: 20564 - DNA, 82 bp, Homo sapiens
  misc_feature 1..82: note = chr10:23984841-23984923
  misc_feature 1..82: note = hyper
  source 1..82: mol_type = genomic DNA
cgacagcgcccgggagcagggtgacccccacagcggccggccttccggctggctgccctccccgctcgccgctctccccgcg

SEQ ID NO: 20565 - DNA, 147 bp, Homo sapiens; identical to SEQ ID NO: 3542
  misc_feature 1..147: note = chr10:25465203-25465350
  misc_feature 1..147: note = hyper
  source 1..147: mol_type = genomic DNA

SEQ ID NO: 20566 - DNA, 70 bp, Homo sapiens
  misc_feature 1..70: note = chr10:25465351-25465421
  misc_feature 1..70: note = hyper
  source 1..70: mol_type = genomic DNA
cgaacgcttctcaccctcagagtagagacccgggctgagggacaccccacgcgggcgcgggtgcttgggg

SEQ ID NO: 20567 - DNA, 38 bp, Homo sapiens
  misc_feature 1..38: note = chr10:25465517-25465555
  misc_feature 1..38: note = hyper
  source 1..38: mol_type = genomic DNA
ccttggcaggacggagacacccccgctgctctgtgctt

SEQ ID NO: 20568 - DNA, 110 bp, Homo sapiens
  misc_feature 1..110: note = chr10:26055841-26055951
  misc_feature 1..110: note = hyper
  source 1..110: mol_type = genomic DNA
cctatctgcgcgctgtcaatcatcccccacctgtggatcgcgcagcccagccaaaaaattaattgcttagaaatataaaatcggtggactcagatcggaaaggattagga

SEQ ID NO: 20569 - DNA, 104 bp, Homo sapiens; identical to SEQ ID NO: 10246
  misc_feature 1..104: note = chr10:26223766-26223870
  misc_feature 1..104: note = hyper
  source 1..104: mol_type = genomic DNA

SEQ ID NO: 20570 - DNA, 27 bp, Homo sapiens
  misc_feature 1..27: note = chr10:26500592-26500619
  misc_feature 1..27: note = hyper
  source 1..27: mol_type = genomic DNA
cctgttgagaattatcgcagatacgtt

SEQ ID NO: 20571 - DNA, 30 bp, Homo sapiens; identical to SEQ ID NO: 10248
  misc_feature 1..30: note = chr10:26501132-26501162
  misc_feature 1..30: note = hyper
  source 1..30: mol_type = genomic DNA

SEQ ID NO: 20572 - DNA, 39 bp, Homo sapiens; identical to SEQ ID NO: 10249
  misc_feature 1..39: note = chr10:26501446-26501485
  misc_feature 1..39: note = hyper
  source 1..39: mol_type = genomic DNA

SEQ ID NO: 20573 - DNA, 100 bp, Homo sapiens
  misc_feature 1..100: note = chr10:26504014-26504114
  misc_feature 1..100: note = hyper
  source 1..100: mol_type = genomic DNA
cccagacgggatccccgggtctctgctttgttagcagctttggtggctggttcaggaggtcagagaaataaaacgacttgtgaacacaatggaaatgaca

SEQ ID NO: 20574 - DNA, 301 bp, Homo sapiens
  misc_feature 1..301: note = chr10:26504190-26504491
  misc_feature 1..301: note = hyper
  source 1..301: mol_type = genomic DNA
cgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaa

SEQ ID NO: 20575 - DNA, 20 bp, Homo sapiens
  misc_feature 1..20: note = chr10:26507400-26507420
  misc_feature 1..20: note = hyper
  source 1..20: mol_type = genomic DNA
tgcacttacacaccgtctcc

SEQ ID NO: 20576 - DNA, 23 bp, Homo sapiens
  misc_feature 1..23: note = chr10:26727368-26727391
  misc_feature 1..23: note = hyper
  source 1..23: mol_type = genomic DNA
ggcgcgcgcggcacaggtagggg

SEQ ID NO: 20577 - DNA, 183 bp, Homo sapiens; identical to SEQ ID NO: 891
  misc_feature 1..183: note = chr10:26727867-26728050
  misc_feature 1..183: note = hyper
  source 1..183: mol_type = genomic DNA

SEQ ID NO: 20578 - DNA, 220 bp, Homo sapiens
  misc_feature 1..220: note = chr10:27547726-27547946
  misc_feature 1..220: note = hyper
  source 1..220: mol_type = genomic DNA
gcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtc

SEQ ID NO: 20579 - DNA, 173 bp, Homo sapiens; identical to SEQ ID NO: 10263
  misc_feature 1..173: note = chr10:28032490-28032663
  misc_feature 1..173: note = hyper
  source 1..173: mol_type = genomic DNA

SEQ ID NO: 20580 - DNA, 123 bp, Homo sapiens; identical to SEQ ID NO: 10267
  misc_feature 1..123: note = chr10:28034396-28034519
  misc_feature 1..123: note = hyper
  source 1..123: mol_type = genomic DNA

SEQ ID NO: 20581 - DNA, 136 bp, Homo sapiens
  misc_feature 1..136: note = chr10:28288070-28288206
  misc_feature 1..136: note = hyper
  source 1..136: mol_type = genomic DNA
ttcaactttgcatctccctttctcaaacacttttatgcaactcccgagtgtgcaccctaactcactccacgcggtgggaaaggttgactttgacagaggtcgtgagcagttgcggggtcggcggcaagttagcaga

SEQ ID NO: 20582 - DNA, 355 bp, Homo sapiens; identical to SEQ ID NO: 10271
  misc_feature 1..355: note = chr10:28957640-28957995
  misc_feature 1..355: note = hyper
  source 1..355: mol_type = genomic DNA

SEQ ID NO: 20583 - DNA, 15 bp, Homo sapiens
  misc_feature 1..15: note = chr10:28958043-28958058
  misc_feature 1..15: note = hyper
  source 1..15: mol_type = genomic DNA
cgatctttttggatg

SEQ ID NO: 20584 - DNA, 30 bp, Homo sapiens; identical to SEQ ID NO: 10273
  misc_feature 1..30: note = chr10:28965689-28965719
  misc_feature 1..30: note = hyper
  source 1..30: mol_type = genomic DNA

SEQ ID NO: 20585 - skipped

SEQ ID NO: 20586 - DNA, 47 bp, Homo sapiens; identical to SEQ ID NO: 10276
  misc_feature 1..47: note = chr10:31608931-31608978
  misc_feature 1..47: note = hyper
  source 1..47: mol_type = genomic DNA

SEQ ID NO: 20587 - DNA, 81 bp, Homo sapiens; identical to SEQ ID NO: 10277
  misc_feature 1..81: note = chr10:31609959-31610040
  misc_feature 1..81: note = hyper
  source 1..81: mol_type = genomic DNA

SEQ ID NO: 20588 - DNA, 41 bp, Homo sapiens; identical to SEQ ID NO: 10278
  misc_feature 1..41: note = chr10:43248734-43248775
  misc_feature 1..41: note = hyper
  source 1..41: mol_type = genomic DNA

SEQ ID NO: 20589 - DNA, 65 bp, Homo sapiens
  misc_feature 1..65: note = chr10:43249944-43250009
  misc_feature 1..65: note = hyper
  source 1..65: mol_type = genomic DNA
caggctgaggacctgcgacttggtgggacttcggtgcccgcccctccgccactacagggagcaga

SEQ ID NO: 20590 - DNA, 80 bp, Homo sapiens
  misc_feature 1..80: note = chr10:43250039-43250119
  misc_feature 1..80: note = hyper
  source 1..80: mol_type = genomic DNA
accgcgaccggaggagcgcagaacgctcctcccagcgtcctgggctccgcaggcacaatttttaaaccagaggcgaaatc

SEQ ID NO: 20591 - DNA, 15 bp, Homo sapiens
  misc_feature 1..15: note = chr10:43250136-43250151
  misc_feature 1..15: note = hyper
  source 1..15: mol_type = genomic DNA
cggggagggagcgtg

SEQ ID NO: 20592 - skipped

SEQ ID NO: 20593 - DNA, 78 bp, Homo sapiens; identical to SEQ ID NO: 10283
  misc_feature 1..78: note = chr10:43393565-43393643
  misc_feature 1..78: note = hyper
  source 1..78: mol_type = genomic DNA

SEQ ID NO: 20594 - DNA, 58 bp, Homo sapiens
  misc_feature 1..58: note = chr10:43429100-43429158
  misc_feature 1..58: note = hyper
  source 1..58: mol_type = genomic DNA
tctgaatggagtgatgcgcctggacttttgttcggaaatcccgcgtggagggcggcct

SEQ ID NO: 20595 - DNA, 15 bp, Homo sapiens
  misc_feature 1..15: note = chr10:43429361-43429376
  misc_feature 1..15: note = hyper
  source 1..15: mol_type = genomic DNA
tagcccagctgcagc

SEQ ID NO: 20596 - DNA, 27 bp, Homo sapiens
  misc_feature 1..27: note = chr10:43429411-43429438
  misc_feature 1..27: note = hyper
  source 1..27: mol_type = genomic DNA
ccccgacagctgcgcaagtctattcct

SEQ ID NO: 20597 - DNA, 192 bp, Homo sapiens; identical to SEQ ID NO: 10287
  misc_feature 1..192: note = chr10:43571989-43572181
  misc_feature 1..192: note = hyper
  source 1..192: mol_type = genomic DNA

SEQ ID NO: 20598 - DNA, 67 bp, Homo sapiens; identical to SEQ ID NO: 10290
  misc_feature 1..67: note = chr10:43724529-43724596
  misc_feature 1..67: note = hyper
  source 1..67: mol_type = genomic DNA

SEQ ID NO: 20599 - DNA, 117 bp, Homo sapiens; identical to SEQ ID NO: 10291
  misc_feature 1..117: note = chr10:44185390-44185507
  misc_feature 1..117: note = hyper
  source 1..117: mol_type = genomic DNA

SEQ ID NO: 20600 - DNA, 18 bp, Homo sapiens
  misc_feature 1..18: note = chr10:44879926-44879944
  misc_feature 1..18: note = hyper
  source 1..18: mol_type = genomic DNA
gcgaactttgcaaagcgc

SEQ ID NO: 20601 - DNA, 78 bp, Homo sapiens; identical to SEQ ID NO: 10293
  misc_feature 1..78: note = chr10:44880377-44880455
  misc_feature 1..78: note = hyper
  source 1..78: mol_type = genomic DNA

SEQ ID NO: 20602 - DNA, 110 bp, Homo sapiens
  misc_feature 1..110: note = chr10:44880759-44880869
  misc_feature 1..110: note = hyper
  source 1..110: mol_type = genomic DNA
ggctccgctgggccccgcaccgctggcccggtctgcagtgaggtccgcagcctgagcgacgccggctggagggccgcttattgtccctgtgacagggccccactggagag

SEQ ID NO: 20603 - DNA, 33 bp, Homo sapiens
  misc_feature 1..33: note = chr10:44880915-44880948
  misc_feature 1..33: note = hyper
  source 1..33: mol_type = genomic DNA
gacggggcctttcgatggcgggaactgaatgag

SEQ ID NO: 20604 - DNA, 52 bp, Homo sapiens
  misc_feature 1..52: note = chr10:49731749-49731801
  misc_feature 1..52: note = hyper
  source 1..52: mol_type = genomic DNA
cccggccgtggacttggcggacctgcagccggcgccgcggccagccccgggc

SEQ ID NO: 20605 - DNA, 45 bp, Homo sapiens
  misc_feature 1..45: note = chr10:49732498-49732543
  misc_feature 1..45: note = hyper
  source 1..45: mol_type = genomic DNA
cccaggagccgccagggggcgccacggagccggggctgcctccgc

SEQ ID NO: 20606 - DNA, 340 bp, Homo sapiens; identical to SEQ ID NO: 10299
  misc_feature 1..340: note = chr10:50323347-50323687
  misc_feature 1..340: note = hyper
  source 1..340: mol_type = genomic DNA

SEQ ID NO: 20607 - DNA, 205 bp, Homo sapiens; identical to SEQ ID NO: 10300
  misc_feature 1..205: note = chr10:50603003-50603208
  misc_feature 1..205: note = hyper
  source 1..205: mol_type = genomic DNA

SEQ ID NO: 20608 - DNA, 58 bp, Homo sapiens
  misc_feature 1..58: note = chr10:50603909-50603967
  misc_feature 1..58: note = hyper
  source 1..58: mol_type = genomic DNA
ggccaggaaggcagccgagccccaaggcccggcgctcggggcccggcgagtgggtcag

SEQ ID NO: 20609 - DNA, 11 bp, Homo sapiens
  misc_feature 1..11: note = chr10:50604159-50604170
  misc_feature 1..11: note = hyper
  source 1..11: mol_type = genomic DNA
tttataatctc

SEQ ID NO: 20610 - DNA, 373 bp, Homo sapiens
  misc_feature 1..373: note = chr10:50605654-50606027
  misc_feature 1..373: note = hyper
  source 1..373: mol_type = genomic DNA
gctgggagcccctagagctgatcctcccttagcccaggtcaagagactggctcgcgcgcgctgtctctctccctgtctccctcagagggcccctgctctctggagctcttgacaagagcccgaggctcctcttgccgcctaggtctgccgaaagtcccctcgggttccctcctgccctaggcagcagttccctgcctgtgcgctttgggaacccggtggccgtgaagtgaggtgcggacagcttctgggccgcctcggccaagatgctcaggcgcacctgggggtgtgtgcgggaaccctcagcggcagcagcccagcccggggtgcagtgttggccccagaaaccaatgaggtccaaacgccagtctcagtt

SEQ ID NO: 20611 - DNA, 238 bp, Homo sapiens
  misc_feature 1..238: note = chr10:50606433-50606671
  misc_feature 1..238: note = hyper
  source 1..238: mol_type = genomic DNA
gctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcacca

SEQ ID NO: 20612 - DNA, 30 bp, Homo sapiens; identical to SEQ ID NO: 10305
  misc_feature 1..30: note = chr10:50817434-50817464
  misc_feature 1..30: note = hyper
  source 1..30: mol_type = genomic DNA

SEQ ID NO: 20613 - DNA, 230 bp, Homo sapiens
  misc_feature 1..230: note = chr10:50818152-50818382
  misc_feature 1..230: note = hyper
  source 1..230: mol_type = genomic DNA
cgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcg

SEQ ID NO: 20614 - DNA, 180 bp, Homo sapiens
  misc_feature 1..180: note = chr10:50818432-50818612
  misc_feature 1..180: note = hyper
  source 1..180: mol_type = genomic DNA
cctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacgg

SEQ ID NO: 20615 - DNA, 52 bp, Homo sapiens; identical to SEQ ID NO: 10308
  misc_feature 1..52: note = chr10:50822142-50822194
  misc_feature 1..52: note = hyper
  source 1..52: mol_type = genomic DNA

SEQ ID NO: 20616 - DNA, 30 bp, Homo sapiens; identical to SEQ ID NO: 10309
  misc_feature 1..30: note = chr10:50887488-50887518
  misc_feature 1..30: note = hyper
  source 1..30: mol_type = genomic DNA

SEQ ID NO: 20617 - DNA, 196 bp, Homo sapiens; identical to SEQ ID NO: 10311
  misc_feature 1..196: note = chr10:50969916-50970112
  misc_feature 1..196: note = hyper
  source 1..196: mol_type = genomic DNA

SEQ ID NO: 20618 - DNA, 88 bp, Homo sapiens; identical to SEQ ID NO: 10312
  misc_feature 1..88: note = chr10:52177735-52177823
  misc_feature 1..88: note = hyper
  source 1..88: mol_type = genomic DNA

SEQ ID NO: 20619 - DNA, 30 bp, Homo sapiens; identical to SEQ ID NO: 10313
  misc_feature 1..30: note = chr10:52178275-52178305
  misc_feature 1..30: note = hyper
  source 1..30: mol_type = genomic DNA

SEQ ID NO: 20620 - DNA, 137 bp, Homo sapiens; identical to SEQ ID NO: 10314
  misc_feature 1..137: note = chr10:52750888-52751025
  misc_feature 1..137: note = hyper
  source 1..137: mol_type = genomic DNA

SEQ ID NO: 20621 - DNA, 88 bp, Homo sapiens; identical to SEQ ID NO: 10315
  misc_feature 1..88: note = chr10:52833568-52833656
  misc_feature 1..88: note = hyper
  source 1..88: mol_type = genomic DNA

SEQ ID NO: 20622 - DNA, 87 bp, Homo sapiens; identical to SEQ ID NO: 10316
  misc_feature 1..87: note = chr10:52834409-52834496
  misc_feature 1..87: note = hyper
  source 1..87: mol_type = genomic DNA

SEQ ID NO: 20623 - DNA, 80 bp, Homo sapiens
  misc_feature 1..80: note = chr10:54068446-54068526
  misc_feature 1..80: note = hyper
  source 1..80: mol_type = genomic DNA
aagtctgattaagaccgggggtccccaggccgtttgatcttcgctcatcaaagagagtctttaaacaagcttcattttac

SEQ ID NO: 20624 - DNA, 103 bp, Homo sapiens
  misc_feature 1..103: note = chr10:54073162-54073265
  misc_feature 1..103: note = hyper
  source 1..103: mol_type = genomic DNA
acgttggaccctgtccgctttggtcccggccactttgatctcacgcgtctgcctaatcaagttcatctaccgccgcgattgccctgattcaaagaacaacatt

SEQ ID NO: 20625 - skipped

SEQ ID NO: 20626 - DNA, 58 bp, Homo sapiens
  misc_feature 1..58: note = chr10:57388267-57388325
  misc_feature 1..58: note = hyper
  source 1..58: mol_type = genomic DNA
gacgtcagcaccagtcgagctcgctgggtgagcgccaggtctccccgccccacggatt

SEQ ID NO: 20627 - DNA, 46 bp, Homo sapiens; identical to SEQ ID NO: 10322
  misc_feature 1..46: note = chr10:57389890-57389936
  misc_feature 1..46: note = hyper
  source 1..46: mol_type = genomic DNA

SEQ ID NO: 20628 - DNA, 30 bp, Homo sapiens; identical to SEQ ID NO: 10324
  misc_feature 1..30: note = chr10:57390646-57390676
  misc_feature 1..30: note = hyper
  source 1..30: mol_type = genomic DNA

SEQ ID NO: 20629 - DNA, 94 bp, Homo sapiens; identical to SEQ ID NO: 10325
  misc_feature 1..94: note = chr10:57391255-57391349
  misc_feature 1..94: note = hyper
  source 1..94: mol_type = genomic DNA

SEQ ID NO: 20630 - DNA, 188 bp, Homo sapiens; identical to SEQ ID NO: 10326
  misc_feature 1..188: note = chr10:60272637-60272825
  misc_feature 1..188: note = hyper
  source 1..188: mol_type = genomic DNA

SEQ ID NO: 20631 - DNA, 48 bp, Homo sapiens; identical to SEQ ID NO: 10328
  misc_feature 1..48: note = chr10:60936403-60936451
  misc_feature 1..48: note = hyper
  source 1..48: mol_type = genomic DNA

SEQ ID NO: 20632 - DNA, 128 bp, Homo sapiens
  misc_feature 1..128: note = chr10:63212701-63212829
  misc_feature 1..128: note = hyper
  source 1..128: mol_type = genomic DNA
gagcaagaggttgagcagcgcaagcagccagtaccgcggctccttcttcacctcggtcactcgccagaccccgaccagcgagtgcagcaggaacagcaaccgagtggccagggcgttaaggaagacca

SEQ ID NO: 20633 - DNA, 92 bp, Homo sapiens; identical to SEQ ID NO: 10332
  misc_feature 1..92: note = chr10:63213120-63213212
  misc_feature 1..92: note = hyper
  source 1..92: mol_type = genomic DNA

SEQ ID NO: 20634 - DNA, 250 bp, Homo sapiens; identical to SEQ ID NO: 10333
  misc_feature 1..250: note = chr10:64133867-64134117
  misc_feature 1..250: note = hyper
  source 1..250: mol_type = genomic DNA

SEQ ID NO: 20635 - DNA, 354 bp, Homo sapiens; identical to SEQ ID NO: 10334
  misc_feature 1..354: note = chr10:64574714-64575068
  misc_feature 1..354: note = hyper
  source 1..354: mol_type = genomic DNA

SEQ ID NO: 20636 - DNA, 399 bp, Homo sapiens
  misc_feature 1..399: note = chr10:64575127-64575526
  misc_feature 1..399: note = hyper
  source 1..399: mol_type = genomic DNA
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagc

SEQ ID NO: 20637 - DNA, 156 bp, Homo sapiens
  misc_feature 1..156: note = chr10:64575638-64575794
  misc_feature 1..156: note = hyper
  source 1..156: mol_type = genomic DNA
tctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgct

SEQ ID NO: 20638 - DNA, 89 bp, Homo sapiens
  misc_feature 1..89: note = chr10:64578540-64578629
  misc_feature 1..89: note = hyper
  source 1..89: mol_type = genomic DNA
cgcttcgctcctctctgcgcacgtgggcggaccggcaggcgggcgagttgcccgggccgccccgcgactggcgctgctgccaaacccgc

SEQ ID NO: 20639 - skipped

SEQ ID NO: 20640 - DNA, 106 bp, Homo sapiens
  misc_feature 1..106: note = chr10:71328821-71328927
  misc_feature 1..106: note = hyper
  source 1..106: mol_type = genomic DNA
gggggtggggtgggatgggggcagggcaccataaatctacctgcttgtgtgccagcgcggcttgactggaaggaggagcaagattcatgtgcggtttttctggaag

SEQ ID NO: 20641 - DNA, 102 bp, Homo sapiens; identical to SEQ ID NO: 10340
  misc_feature 1..102: note = chr10:71331570-71331672
  misc_feature 1..102: note = hyper
  source 1..102: mol_type = genomic DNA

SEQ ID NO: 20642 - DNA, 72 bp, Homo sapiens
  misc_feature 1..72: note = chr10:71331980-71332052
  misc_feature 1..72: note = hyper
  source 1..72: mol_type = genomic DNA
atgaacccagcctgccgcccccgtggaggcctgggccggccaggggtcagccagggagaagcagaaggaaca

SEQ ID NO: 20643 - DNA, 33 bp, Homo sapiens
  misc_feature 1..33: note = chr10:71333018-71333051
  misc_feature 1..33: note = hyper
  source 1..33: mol_type = genomic DNA
gctcagcgggcttctggtcgccaagttcagctg

SEQ ID NO: 20644 - DNA, 57 bp, Homo sapiens; identical to SEQ ID NO: 10343
  misc_feature 1..57: note = chr10:71338223-71338280
  misc_feature 1..57: note = hyper
  source 1..57: mol_type = genomic DNA

SEQ ID NO: 20645 - DNA, 49 bp, Homo sapiens; identical to SEQ ID NO: 10344
  misc_feature 1..49: note = chr10:71562537-71562586
  misc_feature 1..49: note = hyper
  source 1..49: mol_type = genomic DNA

SEQ ID NO: 20646 - DNA, 51 bp, Homo sapiens; identical to SEQ ID NO: 10345
  misc_feature 1..51: note = chr10:71813722-71813773
  misc_feature 1..51: note = hyper
  source 1..51: mol_type = genomic DNA

SEQ ID NO: 20647 - DNA, 43 bp, Homo sapiens
  misc_feature 1..43: note = chr10:72015339-72015382
  misc_feature 1..43: note = hyper
  source 1..43: mol_type = genomic DNA
cgagaagagcacagtggtgtagaccctgcgcatgcccttctcg

SEQ ID NO: 20648 - DNA, 15 bp, Homo sapiens
  misc_feature 1..15: note = chr10:72200050-72200065
  misc_feature 1..15: note = hyper
  source 1..15: mol_type = genomic DNA
gccccctcccatccc

SEQ ID NO: 20649 - DNA, 216 bp, Homo sapiens
  misc_feature 1..216: note = chr10:72200138-72200354
  misc_feature 1..216: note = hyper
  source 1..216: mol_type = genomic DNA
gtctggctggtccccagatgacccttccggagagggtcaccggctgtctgaccccaggcgcgggagcgaagggcccccggcaccaggtcacaaggggcgggcaggcggcaggtcggatcagattagcgtttgtggattgcgccccggccccagggagggccgtctggcccccgcaggcggagggaggcgtgggcggccgcggctgcccaggcggca

SEQ ID NO: 20650 - DNA, 96 bp, Homo sapiens
  misc_feature 1..96: note = chr10:72201285-72201381
  misc_feature 1..96: note = hyper
  source 1..96: mol_type = genomic DNA
gctcagcatgtacgccagaggggatggcgacgagggctgcccccgcgtacgcaggagcgcagtggccaccgtcgcagcacccgcctggagtagggc

SEQ ID NO: 20651 - DNA, 49 bp, Homo sapiens; identical to SEQ ID NO: 10351
  misc_feature 1..49: note = chr10:72431989-72432038
  misc_feature 1..49: note = hyper
  source 1..49: mol_type = genomic DNA

SEQ ID NO: 20652 - DNA, 56 bp, Homo sapiens; identical to SEQ ID NO: 10352
  misc_feature 1..56: note = chr10:73156679-73156735
  misc_feature 1..56: note = hyper
  source 1..56: mol_type = genomic DNA

SEQ ID NO: 20653 - DNA, 135 bp, Homo sapiens; identical to SEQ ID NO: 10353
  misc_feature 1..135: note = chr10:73157113-73157248
  misc_feature 1..135: note = hyper
  source 1..135: mol_type = genomic DNA

SEQ ID NO: 20654 - DNA, 30 bp, Homo sapiens; identical to SEQ ID NO: 10354
  misc_feature 1..30: note = chr10:73157660-73157690
  misc_feature 1..30: note = hyper
  source 1..30: mol_type = genomic DNA

SEQ ID NO: 20655 - DNA, 72 bp, Homo sapiens; identical to SEQ ID NO: 3574
  misc_feature 1..72: note = chr10:73847720-73847792
  misc_feature 1..72: note = hyper
  source 1..72: mol_type = genomic DNA

SEQ ID NO: 20656 - DNA, 14 bp, Homo sapiens
  misc_feature 1..14: note = chr10:73848208-73848222
  misc_feature 1..14: note = hyper
  source 1..14: mol_type = genomic DNA
ggtgactggcggag

SEQ ID NO: 20657 - DNA, 15 bp, Homo sapiens
  misc_feature 1..15: note = chr10:75407398-75407413
  misc_feature 1..15: note = hyper
  source 1..15: mol_type = genomic DNA
cagattctgcacccc

SEQ ID NO: 20658 - DNA, 93 bp, Homo sapiens
  misc_feature 1..93: note = chr10:75407477-75407570
  misc_feature 1..93: note = hyper
  source 1..93: mol_type = genomic DNA
cgtctcctcctttcccggccggaacatctgcttccgggtcccccggcgccgggcctcctgcaggatacccgtgcgggcagctggcacagagat

SEQ ID NO: 20659 - DNA, 30 bp, Homo sapiens; identical to SEQ ID NO: 10359
  misc_feature 1..30: note = chr10:77191554-77191584
  misc_feature 1..30: note = hyper
  source 1..30: mol_type = genomic DNA

SEQ ID NO: 20660 - DNA, 235 bp, Homo sapiens
  misc_feature 1..235: note = chr10:79396686-79396921
  misc_feature 1..235: note = hyper
  source 1..235: mol_type = genomic DNA
tggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatg

SEQ ID NO: 20661 - DNA, 374 bp, Homo sapiens
  misc_feature 1..374: note = chr10:79397089-79397463
  misc_feature 1..374: note = hyper
  source 1..374: mol_type = genomic DNA
atgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccacccc

SEQ ID NO: 20662 - DNA, 581 bp, Homo sapiens; identical to SEQ ID NO: 10361
  misc_feature 1..581: note = chr10:79398015-79398596
  misc_feature 1..581: note = hyper
  source 1..581: mol_type = genomic DNA

SEQ ID NO: 20663 - DNA, 30 bp, Homo sapiens; identical to SEQ ID NO: 10362
  misc_feature 1..30: note = chr10:79470990-79471020
  misc_feature 1..30: note = hyper
  source 1..30: mol_type = genomic DNA

SEQ ID NO: 20664 - DNA, 269 bp, Homo sapiens
  misc_feature 1..269: note = chr10:81664598-81664867
  misc_feature 1..269: note = hyper
  source 1..269: mol_type = genomic DNA
gcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactggga

SEQ ID NO: 20665 - DNA, 91 bp, Homo sapiens
  misc_feature 1..91: note = chr10:81664899-81664990
  misc_feature 1..91: note = hyper
  source 1..91: mol_type = genomic DNA
cggctcatctttgctccccaggagcagcatatttcgcatctgccagaggtgtgcccgggggtcgttgggagagggacggggtgaatccctg

SEQ ID NO: 20666 - DNA, 127 bp, Homo sapiens; identical to SEQ ID NO: 10364
  misc_feature 1..127: note = chr10:81892288-81892415
  misc_feature 1..127: note = hyper
  source 1..127: mol_type = genomic DNA

SEQ ID NO: 20667 - DNA, 329 bp, Homo sapiens; identical to SEQ ID NO: 10365
  misc_feature 1..329: note = chr10:82116699-82117028
  misc_feature 1..329: note = hyper
  source 1..329: mol_type = genomic DNA

SEQ ID NO: 20668 - DNA, 246 bp, Homo sapiens; identical to SEQ ID NO: 10366
  misc_feature 1..246: note = chr10:83633868-83634114
  misc_feature 1..246: note = hyper
  source 1..246: mol_type = genomic DNA

SEQ ID NO: 20669 - DNA, 282 bp, Homo sapiens; identical to SEQ ID NO: 10367
  misc_feature 1..282: note = chr10:83634933-83635215
  misc_feature 1..282: note = hyper
  source 1..282: mol_type = genomic DNA

SEQ ID NO: 20670 - DNA, 15 bp, Homo sapiens
  misc_feature 1..15: note = chr10:83635484-83635499
  misc_feature 1..15: note = hyper
  source 1..15: mol_type = genomic DNA
ctaccacttccacca

SEQ ID NO: 20671 - DNA, 14 bp, Homo sapiens
  misc_feature 1..14: note = chr10:83635545-83635559
  misc_feature 1..14: note = hyper
  source 1..14: mol_type = genomic DNA
gcccaaccggatta

SEQ ID NO: 20672 - DNA, 59 bp, Homo sapiens; identical to SEQ ID NO: 10370
  misc_feature 1..59: note = chr10:83636287-83636346
  misc_feature 1..59: note = hyper
  source 1..59: mol_type = genomic DNA

SEQ ID NO: 20673 - DNA, 30 bp, Homo sapiens; identical to SEQ ID NO: 10371
  misc_feature 1..30: note = chr10:85954715-85954745
  misc_feature 1..30: note = hyper
  source 1..30: mol_type = genomic DNA

SEQ ID NO: 20674 - DNA, 516 bp, Homo sapiens; identical to SEQ ID NO: 10372
  misc_feature 1..516: note = chr10:88125592-88126108
  misc_feature 1..516: note = hyper
  source 1..516: mol_type = genomic DNA

SEQ ID NO: 20675 - DNA, 20 bp, Homo sapiens
  misc_feature 1..20: note = chr10:88126833-88126853
  misc_feature 1..20: note = hyper
  source 1..20: mol_type = genomic DNA
agaatggaggagggccggcc

SEQ ID NO: 20676 - DNA, 279 bp, Homo sapiens; identical to SEQ ID NO: 10374
  misc_feature 1..279: note = chr10:88126854-88127133
  misc_feature 1..279: note = hyper
  source 1..279: mol_type = genomic DNA

SEQ ID NO: 20677 - DNA, 14 bp, Homo sapiens
  misc_feature 1..14: note = chr10:88127346-88127360
  misc_feature 1..14: note = hyper
  source 1..14: mol_type = genomic DNA
ggtgcctgcctcgg

SEQ ID NO: 20678 - DNA, 132 bp, Homo sapiens; identical to SEQ ID NO: 10377
  misc_feature 1..132: note = chr10:88391908-88392040
  misc_feature 1..132: note = hyper
  source 1..132: mol_type = genomic DNA

SEQ ID NO: 20679 - DNA, 42 bp, Homo sapiens; identical to SEQ ID NO: 10378
  misc_feature 1..42: note = chr10:90343138-90343180
  misc_feature 1..42: note = hyper
  source 1..42: mol_type = genomic DNA

SEQ ID NO: 20680 - DNA, 30 bp, Homo sapiens; identical to SEQ ID NO: 10379
  misc_feature 1..30: note = chr10:90966573-90966603
  misc_feature 1..30: note = hyper
  source 1..30: mol_type = genomic DNA

SEQ ID NO: 20681 - DNA, 153 bp, Homo sapiens; identical to SEQ ID NO: 10380
  misc_feature 1..153: note = chr10:90967173-90967326
  misc_feature 1..153: note = hyper
  source 1..153: mol_type = genomic DNA

SEQ ID NO: 20682 - DNA, 27 bp, Homo sapiens
  misc_feature 1..27: note = chr10:90967644-90967671
  misc_feature 1..27: note = hyper
  source 1..27: mol_type = genomic DNA
gtccccgaacgccggcggtgaccgtca

SEQ ID NO: 20683 - DNA, 116 bp, Homo sapiens
  misc_feature 1..116: note = chr10:90968040-90968156
  misc_feature 1..116: note = hyper
  source 1..116: mol_type = genomic DNA
atgtgagttcctgaagcctcccgggaggctattgaaggaccaggtgatgtcgtcactaccctacccttccccttgttggctttgcggggccaacttgcagtcgccctctgccaccg

SEQ ID NO: 20684 - DNA, 87 bp, Homo sapiens; identical to SEQ ID NO: 10382
  misc_feature 1..87: note = chr10:91295259-91295346
  misc_feature 1..87: note = hyper
  source 1..87: mol_type = genomic DNA

SEQ ID NO: 20685 - DNA, 145 bp, Homo sapiens; identical to SEQ ID NO: 10383
  misc_feature 1..145: note = chr10:91295347-91295492
  misc_feature 1..145: note = hyper
  source 1..145: mol_type = genomic DNA

SEQ ID NO: 20686 - DNA, 154 bp, Homo sapiens
  misc_feature 1..154: note = chr10:91295725-91295879
  misc_feature 1..154: note = hyper
  source 1..154: mol_type = genomic DNA
gccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccc

SEQ ID NO: 20687 - DNA, 15 bp, Homo sapiens
  misc_feature 1..15: note = chr10:92617227-92617242
  misc_feature 1..15: note = hyper
  source 1..15: mol_type = genomic DNA
ggcattgtccggggg

SEQ ID NO: 20688 - DNA, 58 bp, Homo sapiens
  misc_feature 1..58: note = chr10:92617308-92617366
  misc_feature 1..58: note = hyper
  source 1..58: mol_type = genomic DNA
gaccgggtcggcgccaccgtcggggctcaagtcgggcagcccgcgccccacttctggc

SEQ ID NO: 20689 - DNA, 97 bp, Homo sapiens
  misc_feature 1..97: note = chr10:93647119-93647216
  misc_feature 1..97: note = hyper
  source 1..97: mol_type = genomic DNA
ggccagtgggaaggtcggacgccgaggggcgaaatcaccccaccggcatcagaccaccgcctccattcagcggaggaatgtgggcgggcagaggacg

SEQ ID NO: 20690 - DNA, 262 bp, Homo sapiens
  misc_feature 1..262: note = chr10:93647300-93647562
  misc_feature 1..262: note = hyper
  source 1..262: mol_type = genomic DNA
ggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcac

SEQ ID NO: 20691 - skipped

SEQ ID NO: 20692 - DNA, 70 bp, Homo sapiens; identical to SEQ ID NO: 10388
  misc_feature 1..70: note = chr10:94180377-94180447
  misc_feature 1..70: note = hyper
  source 1..70: mol_type = genomic DNA

SEQ ID NO: 20693 - DNA, 30 bp, Homo sapiens; identical to SEQ ID NO: 10390
  misc_feature 1..30: note = chr10:94822377-94822407
  misc_feature 1..30: note = hyper
  source 1..30: mol_type = genomic DNA

SEQ ID NO: 20694 - DNA, 23 bp, Homo sapiens
  misc_feature 1..23: note = chr10:94828498-94828521
  misc_feature 1..23: note = hyper
  source 1..23: mol_type = genomic DNA
gcacgcagcgccacccatctgcc

SEQ ID NO: 20695 - DNA, 66 bp, Homo sapiens
  misc_feature 1..66: note = chr10:94828828-94828894
  misc_feature 1..66: note = hyper
  source 1..66: mol_type = genomic DNA
aggggagtgggaatattgcaactcggggacattgcagagacccgacgcacgcggtgggacctgcaa

SEQ ID NO: 20696 - DNA, 53 bp, Homo sapiens; identical to SEQ ID NO: 10393
  misc_feature 1..53: note = chr10:94831830-94831883
  misc_feature 1..53: note = hyper
  source 1..53: mol_type = genomic DNA

SEQ ID NO: 20697 - DNA, 92 bp, Homo sapiens; identical to SEQ ID NO: 10394
  misc_feature 1..92: note = chr10:94833030-94833122
  misc_feature 1..92: note = hyper
  source 1..92: mol_type = genomic DNA

SEQ ID NO: 20698 - DNA, 380 bp, Homo sapiens
  misc_feature 1..380: note = chr10:94834033-94834413
  misc_feature 1..380: note = hyper
  source 1..380: mol_type = genomic DNA
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccagg

SEQ ID NO: 20699 - DNA, 36 bp, Homo sapiens; identical to SEQ ID NO: 10396
  misc_feature 1..36: note = chr10:95361207-95361243
  misc_feature 1..36: note = hyper
  source 1..36: mol_type = genomic DNA

SEQ ID NO: 20700 - DNA, 243 bp, Homo sapiens; identical to SEQ ID NO: 10397
  misc_feature 1..243: note = chr10:98945514-98945757
  misc_feature 1..243: note = hyper
  source 1..243: mol_type = genomic DNA

SEQ ID NO: 20701 - DNA, 29 bp, Homo sapiens
  misc_feature 1..29: note = chr10:98945992-98946021
  misc_feature 1..29: note = hyper
  source 1..29: mol_type = genomic DNA
gggtgtgactcgacccgccaagtcctggc

SEQ ID NO: 20702 - DNA, 76 bp, Homo sapiens; identical to SEQ ID NO: 10399
  misc_feature 1..76: note = chr10:98946094-98946170
  misc_feature 1..76: note = hyper
  source 1..76: mol_type = genomic DNA

SEQ ID NO: 20703 - DNA, 71 bp, Homo sapiens
  misc_feature 1..71: note = chr10:99531148-99531219
  misc_feature 1..71: note = hyper
  source 1..71: mol_type = genomic DNA
caggccaggggaagccgtaggcctccatgagcggcgcgcagccggcgcgcacggcctcgcacagcgagcgg

SEQ ID NO: 20704 - DNA, 98 bp, Homo sapiens; identical to SEQ ID NO: 10402
  misc_feature 1..98: note = chr10:99531512-99531610
  misc_feature 1..98: note = hyper
  source 1..98: mol_type = genomic DNA

SEQ ID NO: 20705 - DNA, 16 bp, Homo sapiens
  misc_feature 1..16: note = chr10:99531863-99531879
  misc_feature 1..16: note = hyper
  source 1..16: mol_type = genomic DNA
gccctcagcccctccc

SEQ ID NO: 20706 - DNA, 101 bp, Homo sapiens; identical to SEQ ID NO: 10404
  misc_feature 1..101: note = chr10:99531880-99531981
  misc_feature 1..101: note = hyper
  source 1..101: mol_type = genomic DNA

SEQ ID NO: 20707 - DNA, 12 bp, Homo sapiens
  misc_feature 1..12: note = chr10:99789282-99789294
  misc_feature 1..12: note = hyper
  source 1..12: mol_type = genomic DNA
cggcagcagcag

SEQ ID NO: 20708 - DNA, 44 bp, Homo sapiens; identical to SEQ ID NO: 10406
  misc_feature 1..44: note = chr10:99789739-99789783
  misc_feature 1..44: note = hyper
  source 1..44: mol_type = genomic DNA

SEQ ID NO: 20709 - DNA, 22 bp, Homo sapiens
  misc_feature 1..22: note = chr10:99790318-99790340
  misc_feature 1..22: note = hyper
  source 1..22: mol_type = genomic DNA
agccccggtcccgggctggcct

SEQ ID NO: 20710 - DNA, 153 bp, Homo sapiens
  misc_feature 1..153: note = chr10:99790437-99790590
  misc_feature 1..153: note = hyper
  source 1..153: mol_type = genomic DNA
cgcggcagctggagccgggggcccggggtggggggcgccggcgcggccaatcgcggccccgagagcccggagagccgggcgtggggagggagcgcctccccgcgctgatttaggagccgggattgcggtggcagcagccggcagccaggctgg

SEQ ID NO: 20711 - DNA, 96 bp, Homo sapiens
  misc_feature 1..96: note = chr10:99790664-99790760
  misc_feature 1..96: note = hyper
  source 1..96: mol_type = genomic DNA
gccactgcgtcgcgtaaccttcaggcggcagcgaggcctggcgaggaggggagagggcgcctggctgggcgctgggggccccaggccggagggaag

SEQ ID NO: 20712 - DNA, 30 bp, Homo sapiens
  misc_feature 1..30: note = chr10:99790917-99790947
  misc_feature 1..30: note = hyper
  source 1..30: mol_type = genomic DNA
cgtcgccgggccgggccaaagcggccgagc

SEQ ID NO: 20713 - DNA, 16 bp, Homo sapiens
  misc_feature 1..16: note = chr10:99791161-99791177
  misc_feature 1..16: note = hyper
  source 1..16: mol_type = genomic DNA
ccgtccccaccagcag

SEQ ID NO: 20714 - DNA, 49 bp, Homo sapiens; identical to SEQ ID NO: 10412
  misc_feature 1..49: note = chr10:100992458-100992507
  misc_feature 1..49: note = hyper
  source 1..49: mol_type = genomic DNA

SEQ ID NO: 20715 - DNA, 50 bp, Homo sapiens
  misc_feature 1..50: note = chr10:100993487-100993537
  misc_feature 1..50: note = hyper
  source 1..50: mol_type = genomic DNA
tgtaaccagaatggtcgtttggcagaagtctccgggaccgcactccagga

SEQ ID NO: 20716 - DNA, 379 bp, Homo sapiens
  misc_feature 1..379: note = chr10:100994016-100994395
  misc_feature 1..379: note = hyper
  source 1..379: mol_type = genomic DNA
cacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgag

SEQ ID NO: 20717 - DNA, 62 bp, Homo sapiens; identical to SEQ ID NO: 10415
  misc_feature 1..62: note = chr10:100994599-100994661
  misc_feature 1..62: note = hyper
  source 1..62: mol_type = genomic DNA

SEQ ID NO: 20718 - DNA, 249 bp, Homo sapiens
  misc_feature 1..249: note = chr10:100995797-100996046
  misc_feature 1..249: note = hyper
  source 1..249: mol_type = genomic DNA
ttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggta

SEQ ID NO: 20719 - DNA, 53 bp, Homo sapiens
  misc_feature 1..53: note = chr10:101089855-101089908
  misc_feature 1..53: note = hyper
  source 1..53: mol_type = genomic DNA
ctgttcagcggcctgcgcctgagcctgctgtcgctggacccggtggagttacg

SEQ ID NO: 20720 - DNA, 11 bp, Homo sapiens
  misc_feature 1..11: note = chr10:101280193-101280204
  misc_feature 1..11: note = hyper
  source 1..11: mol_type = genomic DNA
cacataaatca

SEQ ID NO: 20721 - DNA, 253 bp, Homo sapiens; identical to SEQ ID NO: 10421
  misc_feature 1..253: note = chr10:101283181-101283434
  misc_feature 1..253: note = hyper
  source 1..253: mol_type = genomic DNA

SEQ ID NO: 20722 - DNA, 111 bp, Homo sapiens
  misc_feature 1..111: note = chr10:101293343-101293454
  misc_feature 1..111: note = hyper
  source 1..111: mol_type = genomic DNA
ctttaccctttggctggggccatgcctccgccctggtcaccgacagctccacaaagcgcaggtacctgcaagggagccggggtggagagacaaggacgaggtgaccctgac

SEQ ID NO: 20723 - DNA, 19 bp, Homo sapiens
  misc_feature 1..19: note = chr10:102322260-102322279
  misc_feature 1..19: note = hyper
  source 1..19: mol_type = genomic DNA
tggccgcagcccagctcgg

SEQ ID NO: 20724 - DNA, 30 bp, Homo sapiens; identical to SEQ ID NO: 10430
  misc_feature 1..30: note = chr10:102414410-102414440
  misc_feature 1..30: note = hyper
  source 1..30: mol_type = genomic DNA

SEQ ID NO: 20725 - DNA, 166 bp, Homo sapiens
  misc_feature 1..166: note = chr10:102419681-102419847
  misc_feature 1..166: note = hyper
  source 1..166: mol_type = genomic DNA
aggagaggctcagggagtgggacagagggtatctctctttccccagcgtccacccccagacgcctcctacccccaaccagggaggttagaggggcagatgggagtacgaggcttacacccagctctcctatgccacttcctctccctaagacgtggccttttcccc

SEQ ID NO: 20726 - DNA, 17 bp, Homo sapiens
  misc_feature 1..17: note = chr10:102430682-102430699
  misc_feature 1..17: note = hyper
  source 1..17: mol_type = genomic DNA
tactcctgacaggatcg

SEQ ID NO: 20727 - DNA, 37 bp, Homo sapiens
  misc_feature 1..37: note = chr10:102430761-102430798
  misc_feature 1..37: note = hyper
  source 1..37: mol_type = genomic DNA
tccaaaggctccgcggccattacgggaaagttagtgt

SEQ ID NO: 20728 - DNA, 39 bp, Homo sapiens; identical to SEQ ID NO: 10433
  misc_feature 1..39: note = chr10:102470136-102470175
  misc_feature 1..39: note = hyper
  source 1..39: mol_type = genomic DNA

SEQ ID NO: 20729 - DNA, 30 bp, Homo sapiens; identical to SEQ ID NO: 10434
  misc_feature 1..30: note = chr10:102470378-102470408
  misc_feature 1..30: note = hyper
  source 1..30: mol_type = genomic DNA

SEQ ID NO: 20730 - DNA, 197 bp, Homo sapiens; identical to SEQ ID NO: 10435
  misc_feature 1..197: note = chr10:102473519-102473716
  misc_feature 1..197: note = hyper
  source 1..197: mol_type = genomic DNA

SEQ ID NO: 20731 - DNA, 97 bp, Homo sapiens
  misc_feature 1..97: note = chr10:102473759-102473856
  misc_feature 1..97: note = hyper
  source 1..97: mol_type = genomic DNA
cggaggtgggactggggagcagggcctgggactccgctggtgggggtacacgcaggggcactggcgggggcggggggcgacggcactcagaattgcg

SEQ ID NO: 20732 - DNA, 77 bp, Homo sapiens
  misc_feature 1..77: note = chr10:102473932-102474009
  misc_feature 1..77: note = hyper
  source 1..77: mol_type = genomic DNA
ccccactccccatccccttcctggaccccacgtctagggccgctggcggctcctgcgattagcgctccagatgtttg

SEQ ID NO: 20733 - DNA, 50 bp, Homo sapiens; identical to SEQ ID NO: 10437
  misc_feature 1..50: note = chr10:102475641-102475691
  misc_feature 1..50: note = hyper
  source 1..50: mol_type = genomic DNA

SEQ ID NO: 20734 - DNA, 41 bp, Homo sapiens; identical to SEQ ID NO: 10438
  misc_feature 1..41: note = chr10:102475904-102475945
  misc_feature 1..41: note = hyper
  source 1..41: mol_type = genomic DNA

SEQ ID NO: 20735 - DNA, 30 bp, Homo sapiens; identical to SEQ ID NO: 10439
  misc_feature 1..30: note = chr10:102483765-102483795
  misc_feature 1..30: note = hyper
  source 1..30: mol_type = genomic DNA

SEQ ID NO: 20736 - DNA, 60 bp, Homo sapiens; identical to SEQ ID NO: 10441
  misc_feature 1..60: note = chr10:102489604-102489664
  misc_feature 1..60: note = hyper
  source 1..60: mol_type = genomic DNA

SEQ ID NO: 20737 - DNA, 15 bp, Homo sapiens
  misc_feature 1..15: note = chr10:102489700-102489715
  misc_feature 1..15: note = hyper
  source 1..15: mol_type = genomic DNA
cgccatggacccagg

SEQ ID NO: 20738 - DNA, 16 bp, Homo sapiens
  misc_feature 1..16: note = chr10:102495125-102495141
  misc_feature 1..16: note = hyper
  source 1..16: mol_type = genomic DNA
ggctgggctgcggtcc

SEQ ID NO: 20739 - DNA, 51 bp, Homo sapiens; identical to SEQ ID NO: 10444
  misc_feature 1..51: note = chr10:102495142-102495193
  misc_feature 1..51: note = hyper
  source 1..51: mol_type = genomic DNA

SEQ ID NO: 20740 - DNA, 15 bp, Homo sapiens
  misc_feature 1..15: note = chr10:102497161-102497176
  misc_feature 1..15: note = hyper
  source 1..15: mol_type = genomic DNA
gggcggccgcttacc

SEQ ID NO: 20741 - DNA, 21 bp, Homo sapiens
  misc_feature 1..21: note = chr10:102497252-102497273
  misc_feature 1..21: note = hyper
  source 1..21: mol_type = genomic DNA
cgggtgcgggtctcgtgttcc

SEQ ID NO: 20742 - DNA, 58 bp, Homo sapiens
  misc_feature 1..58: note = chr10:102497708-102497766
  misc_feature 1..58: note = hyper
  source 1..58: mol_type = genomic DNA
ggggattgaatcagcaactagggcaattgtggtcttcagctatcgctgcctatacccc

SEQ ID NO: 20743 - DNA, 32 bp, Homo sapiens; identical to SEQ ID NO: 10450
  misc_feature 1..32: note = chr10:102498739-102498771
  misc_feature 1..32: note = hyper
  source 1..32: mol_type = genomic DNA

SEQ ID NO: 20744 - DNA, 211 bp, Homo sapiens; identical to SEQ ID NO: 10451
  misc_feature 1..211: note = chr10:102498831-102499042
  misc_feature 1..211: note = hyper
  source 1..211: mol_type = genomic DNA

SEQ ID NO: 20745 - DNA, 112 bp, Homo sapiens
  misc_feature 1..112: note = chr10:102501247-102501359
  misc_feature 1..112: note = hyper
  source 1..112: mol_type = genomic DNA
aggagggggaaaggccgggcaggagccggtcaggcctttctgcggaaggggctggggtgtaagtttcggctccctgggatctgacagccgagggtatgcgccctggggtgcg

SEQ ID NO: 20746 - DNA, 181 bp, Homo sapiens; identical to SEQ ID NO: 10453
  misc_feature 1..181: note = chr10:102501875-102502056
  misc_feature 1..181: note = hyper
  source 1..181: mol_type = genomic DNA

SEQ ID NO: 20747 - DNA, 30 bp, Homo sapiens; identical to SEQ ID NO: 10454
  misc_feature 1..30: note = chr10:102502378-102502408
  misc_feature 1..30: note = hyper
  source 1..30: mol_type = genomic DNA

SEQ ID NO: 20748 - DNA, 216 bp, Homo sapiens; identical to SEQ ID NO: 10455
  misc_feature 1..216: note = chr10:102504302-102504518
  misc_feature 1..216: note = hyper
  source 1..216: mol_type = genomic DNA

SEQ ID NO: 20749 - DNA, 42 bp, Homo sapiens
  misc_feature 1..42: note = chr10:102507467-102507509
  misc_feature 1..42: note = hyper
  source 1..42: mol_type = genomic DNA
taagtaatttccaagcgcaggaaagccgcgccgagggcatca

SEQ ID NO: 20750 - DNA, 43 bp, Homo sapiens; identical to SEQ ID NO: 10457
  misc_feature 1..43: note = chr10:102507908-102507951
  misc_feature 1..43: note = hyper
  source 1..43: mol_type = genomic DNA

SEQ ID NO: 20751 - DNA, 470 bp, Homo sapiens; identical to SEQ ID NO: 10458
  misc_feature 1..470: note = chr10:102508341-102508811
  misc_feature 1..470: note = hyper
  source 1..470: mol_type = genomic DNA

SEQ ID NO: 20752 - DNA, 48 bp, Homo sapiens; identical to SEQ ID NO: 10460
  misc_feature 1..48: note = chr10:102509494-102509542
  misc_feature 1..48: note = hyper
  source 1..48: mol_type = genomic DNA

SEQ ID NO: 20753 - DNA, 175 bp, Homo sapiens
  misc_feature 1..175: note = chr10:102589250-102589425
  misc_feature 1..175: note = hyper
  source 1..175: mol_type = genomic DNA
gccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaa

SEQ ID NO: 20754 - DNA, 293 bp, Homo sapiens
  misc_feature 1..293: note = chr10:102589493-102589786
  misc_feature 1..293: note = hyper
  source 1..293: mol_type = genomic DNA
cgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcc

SEQ ID NO: 20755 - DNA, 237 bp, Homo sapiens
  misc_feature 1..237: note = chr10:102589915-102590152
  misc_feature 1..237: note = hyper
  source 1..237: mol_type = genomic DNA
gggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccg

SEQ ID NO: 20756 - DNA, 241 bp, Homo sapiens
  misc_feature 1..241: note = chr10:102891582-102891823
  misc_feature 1..241: note = hyper
  source 1..241: mol_type = genomic DNA
tcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccc

SEQ ID NO: 20757 - DNA, 41 bp, Homo sapiens
  misc_feature 1..41: note = chr10:102893583-102893624
  misc_feature 1..41: note = hyper
  source 1..41: mol_type = genomic DNA
ctgaggggaggggagcgtgaccattagctcgccttagactg

SEQ ID NO: 20758 - DNA, 206 bp, Homo sapiens
  misc_feature 1..206: note = chr10:102899601-102899807
  misc_feature 1..206: note = hyper
  source 1..206: mol_type = genomic DNA
cacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacaggg

SEQ ID NO: 20759 - DNA, 59 bp, Homo sapiens
  misc_feature 1..59: note = chr10:102900575-102900634
  misc_feature 1..59: note = hyper
  source 1..59: mol_type = genomic DNA
caggaacccaggcagggatggggtcctagaggccctgtgcagtgcggtgggtggcacac

SEQ ID NO: 20760 - DNA, 40 bp, Homo sapiens; identical to SEQ ID NO: 10469
  misc_feature 1..40: note = chr10:102905699-102905739
  misc_feature 1..40: note = hyper
  source 1..40: mol_type = genomic DNA

SEQ ID NO: 20761 - DNA, 125 bp, Homo sapiens; identical to SEQ ID NO: 10470
  misc_feature 1..125: note = chr10:102975199-102975324
  misc_feature 1..125: note = hyper
  source 1..125: mol_type = genomic DNA

SEQ ID NO: 20762 - DNA, 25 bp, Homo sapiens
  misc_feature 1..25: note = chr10:102975834-102975859
  misc_feature 1..25: note = hyper
  source 1..25: mol_type = genomic DNA
tgcccggctccggaggtcttagcag

SEQ ID NO: 20763 - DNA, 70 bp, Homo sapiens; identical to SEQ ID NO: 10472
  misc_feature 1..70: note = chr10:102976414-102976484
  misc_feature 1..70: note = hyper
  source 1..70: mol_type = genomic DNA

SEQ ID NO: 20764 - DNA, 536 bp, Homo sapiens
  misc_feature 1..536: note = chr10:102977412-102977948
  misc_feature 1..536: note = hyper
  source 1..536: mol_type = genomic DNA
cagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattg

SEQ ID NO: 20765 - DNA, 280 bp, Homo sapiens; identical to SEQ ID NO: 10474
  misc_feature 1..280: note = chr10:102978742-102979022
  misc_feature 1..280: note = hyper
  source 1..280: mol_type = genomic DNA

SEQ ID NO: 20766 - DNA, 224 bp, Homo sapiens; identical to SEQ ID NO: 10475
  misc_feature 1..224: note = chr10:102982567-102982791
  misc_feature 1..224: note = hyper
  source 1..224: mol_type = genomic DNA

SEQ ID NO: 20767 - DNA, 30 bp, Homo sapiens; identical to SEQ ID NO: 10476
  misc_feature 1..30: note = chr10:102983002-102983032
  misc_feature 1..30: note = hyper
  source 1..30: mol_type = genomic DNA

SEQ ID NO: 20768 - DNA, 316 bp, Homo sapiens
  misc_feature 1..316: note = chr10:102985456-102985772
  misc_feature 1..316: note = hyper
  source 1..316: mol_type = genomic DNA
caaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcagg

SEQ ID NO: 20769 - DNA, 571 bp, Homo sapiens
  misc_feature 1..571: note = chr10:102985963-102986534
  misc_feature 1..571: note = hyper
  source 1..571: mol_type = genomic DNA
ggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaagga

SEQ ID NO: 20770 - DNA, 256 bp, Homo sapiens; identical to SEQ ID NO: 10482
  misc_feature 1..256: note = chr10:102989238-102989494
  misc_feature 1..256: note = hyper
  source 1..256: mol_type = genomic DNA

SEQ ID NO: 20771 - DNA, 329 bp, Homo sapiens; identical to SEQ ID NO: 10483
  misc_feature 1..329: note = chr10:102989968-102990297
  misc_feature 1..329: note = hyper
  source 1..329: mol_type = genomic DNA

SEQ ID NO: 20772 - DNA, 90 bp, Homo sapiens
  misc_feature 1..90: note = chr10:102996026-102996116
  misc_feature 1..90: note = hyper
  source 1..90: mol_type = genomic DNA
actactgtcggggggcgccgggcgcaggccgggcatggggcctgagcttaggccaggtggaaaggtggaaggacctagtggggacagacg

SEQ ID NO: 20773 - DNA, 81 bp, Homo sapiens
  misc_feature 1..81: note = chr10:102996638-102996719
  misc_feature 1..81: note = hyper
  source 1..81: mol_type = genomic DNA
ctgcttcgtcctggccaggactttccttgccctgaagtgaggcgccagggaagctgcagggccctccgccctctctgaact

SEQ ID NO: 20774 - DNA, 142 bp, Homo sapiens; identical to SEQ ID NO: 3618
  misc_feature 1..142: note = chr10:102997086-102997228
  misc_feature 1..142: note = hyper
  source 1..142: mol_type = genomic DNA

SEQ ID NO: 20775 - DNA, 48 bp, Homo sapiens
  misc_feature 1..48: note = chr10:102997281-102997329
  misc_feature 1..48: note = hyper
  source 1..48: mol_type = genomic DNA
cgccacagccctgtcccctagggagaggcctggactaactttgccgtc

SEQ ID NO: 20776 - DNA, 178 bp, Homo sapiens
  misc_feature 1..178: note = chr10:102997406-102997584
  misc_feature 1..178: note = hyper
  source 1..178: mol_type = genomic DNA
ggtgggctggcgattccctagcctcagatggctctgccaccagccagctctgtgatcctgggtaagtctttcaacctctctgagtcttgacgttggtaaaaggcaggagatttagagaaggtgttgggagactaaatcttttcattcgtttgagaaagggagtcgcctgtgttgggac

SEQ ID NO: 20777 - DNA, 220 bp, Homo sapiens
  misc_feature 1..220: note = chr10:102998356-102998576
  misc_feature 1..220: note = hyper
  source 1..220: mol_type = genomic DNA
ggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtg

SEQ ID NO: 20778 - DNA, 31 bp, Homo sapiens
  misc_feature 1..31: note = chr10:102998828-102998859
  misc_feature 1..31: note = hyper
  source 1..31: mol_type = genomic DNA
aggggtttggaagagccgaattcaagcaccc

SEQ ID NO: 20779 - DNA, 51 bp, Homo sapiens
  misc_feature 1..51: note = chr10:103043924-103043975
  misc_feature 1..51: note = hyper
  source 1..51: mol_type = genomic DNA
cggatggagctgttaatgtaagtggagtttctgcaatggtaattaggaggg

SEQ ID NO: 20780 - DNA, 33 bp, Homo sapiens
  misc_feature 1..33: note = chr10:103044366-103044399
  misc_feature 1..33: note = hyper
  source 1..33: mol_type = genomic DNA
ggccagacagagttggggcgggaggcgggtata

SEQ ID NO: 20781 - DNA, 36 bp, Homo sapiens; identical to SEQ ID NO: 10491
  misc_feature 1..36: note = chr10:103051231-103051267
  misc_feature 1..36: note = hyper
  source 1..36: mol_type = genomic DNA

SEQ ID NO: 20782 - DNA, 553 bp, Homo sapiens; identical to SEQ ID NO: 10492
  misc_feature 1..553: note = chr10:103534896-103535449
  misc_feature 1..553: note = hyper
  source 1..553: mol_type = genomic DNA

SEQ ID NO: 20783 - DNA, 81 bp, Homo sapiens
  misc_feature 1..81: note = chr10:103536416-103536497
  misc_feature 1..81: note = hyper
  source 1..81: mol_type = genomic DNA
gaatggctgcgcacccggccctcgcgcagtgcgtgccggtgccacccggaccccgctcccctgtttcggccgcgtgccccg

SEQ ID NO: 20784 - DNA, 108 bp, Homo sapiens; identical to SEQ ID NO: 10495
  misc_feature 1..108: note = chr10:103986112-103986220
  misc_feature 1..108: note = hyper
  source 1..108: mol_type = genomic DNA

SEQ ID NO: 20785 - DNA, 142 bp, Homo sapiens; identical to SEQ ID NO: 10496
  misc_feature 1..142: note = chr10:104000843-104000985
  misc_feature 1..142: note = hyper
  source 1..142: mol_type = genomic DNA

SEQ ID NO: 20786 - DNA, 69 bp, Homo sapiens
  misc_feature 1..69: note = chr10:104170732-104170801
  misc_feature 1..69: note = hyper
  source 1..69: mol_type = genomic DNA
ttggagggcccttggcctcccaggtcctgcatgtctggccaggggtttgttttccggctcctgcccgcc

SEQ ID NO: 20787 - DNA, 92 bp, Homo sapiens
  misc_feature 1..92: note = chr10:105036450-105036542
  misc_feature 1..92: note = hyper
  source 1..92: mol_type = genomic DNA
gtaactggaaaaacacgacctcgccctcgggaaggctttctgtgcgcctcacctcaggatgagggtgggtgtaggggacacctcccagaaac

SEQ ID NO: 20788 - DNA, 19 bp, Homo sapiens
  misc_feature 1..19: note = chr10:105036864-105036883
  misc_feature 1..19: note = hyper
  source 1..19: mol_type = genomic DNA
ccttaaaagccgggcgcac

SEQ ID NO: 20789 - DNA, 330 bp, Homo sapiens
  misc_feature 1..330: note = chr10:105036893-105037223
  misc_feature 1..330: note = hyper
  source 1..330: mol_type = genomic DNA
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaac

SEQ ID NO: 20790 - DNA, 86 bp, Homo sapiens; identical to SEQ ID NO: 10504
  misc_feature 1..86: note = chr10:105041683-105041769
  misc_feature 1..86: note = hyper
  source 1..86: mol_type = genomic DNA

SEQ ID NO: 20791 - DNA, 139 bp, Homo sapiens
  misc_feature 1..139: note = chr10:106399442-106399581
  misc_feature 1..139: note = hyper
  source 1..139: mol_type = genomic DNA
atcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggat

SEQ ID NO: 20792 - DNA, 110 bp, Homo sapiens; identical to SEQ ID NO: 3632
  misc_feature 1..110: note = chr10:106400808-106400918
  misc_feature 1..110: note = hyper
  source 1..110: mol_type = genomic DNA

SEQ ID NO: 20793 - DNA, 26 bp, Homo sapiens
  misc_feature 1..26: note = chr10:106402325-106402351
  misc_feature 1..26: note = hyper
  source 1..26: mol_type = genomic DNA
agtccagggagcggccctggaaagcc

SEQ ID NO: 20794 - DNA, 92 bp, Homo sapiens
  misc_feature 1..92: note = chr10:106402620-106402712
  misc_feature 1..92: note = hyper
  source 1..92: mol_type = genomic DNA
cggtctggcctactccggcattccgaactgggcgcccgactgagcatcgcgcctgcctggcagctgcagcggcccgcagcgcgtgcccggag

SEQ ID NO: 20795 - DNA, 30 bp, Homo sapiens; identical to SEQ ID NO: 10512
  misc_feature 1..30: note = chr10:108923969-108923999
  misc_feature 1..30: note = hyper
  source 1..30: mol_type = genomic DNA

SEQ ID NO: 20796 - DNA, 19 bp, Homo sapiens
  misc_feature 1..19: note = chr10:108924382-108924401
  misc_feature 1..19: note = hyper
  source 1..19: mol_type = genomic DNA
actccatccaagttgcgcc

SEQ ID NO: 20797 - skipped

SEQ ID NO: 20798 - DNA, 68 bp, Homo sapiens; identical to SEQ ID NO: 10515
  misc_feature 1..68: note = chr10:109674855-109674923
  misc_feature 1..68: note = hyper
  source 1..68: mol_type = genomic DNA

SEQ ID NO: 20799 - DNA, 257 bp, Homo sapiens; identical to SEQ ID NO: 10516
  misc_feature 1..257: note = chr10:110225912-110226169
  misc_feature 1..257: note = hyper
  source 1..257: mol_type = genomic DNA

SEQ ID NO: 20800 - DNA, 71 bp, Homo sapiens; identical to SEQ ID NO: 10517
  misc_feature 1..71: note = chr10:110671709-110671780
  misc_feature 1..71: note = hyper
  source 1..71: mol_type = genomic DNA

SEQ ID NO: 20801 - DNA, 51 bp, Homo sapiens; identical to SEQ ID NO: 3638
  misc_feature 1..51: note = chr10:111216345-111216396
  misc_feature 1..51: note = hyper
  source 1..51: mol_type = genomic DNA

SEQ ID NO: 20802 - DNA, 559 bp, Homo sapiens
  misc_feature 1..559: note = chr10:112403297-112403856
  misc_feature 1..559: note = hyper
  source 1..559: mol_type = genomic DNA
tcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtg

SEQ ID NO: 20803 - DNA, 56 bp, Homo sapiens; identical to SEQ ID NO: 10522
  misc_feature 1..56: note = chr10:112404226-112404282
  misc_feature 1..56: note = hyper
  source 1..56: mol_type = genomic DNA

SEQ ID NO: 20804 - DNA, 76 bp, Homo sapiens; identical to SEQ ID NO: 10523
  misc_feature 1..76: note = chr10:112431872-112431948
  misc_feature 1..76: note = hyper
  source 1..76: mol_type = genomic DNA

SEQ ID NO: 20805 - DNA, 70 bp, Homo sapiens; identical to SEQ ID NO: 10524
  misc_feature 1..70: note = chr10:115804051-115804121
  misc_feature 1..70: note = hyper
  source 1..70: mol_type = genomic DNA

SEQ ID NO: 20806 - DNA, 41 bp, Homo sapiens
  misc_feature 1..41: note = chr10:115805014-115805055
  misc_feature 1..41: note = hyper
  source 1..41: mol_type = genomic DNA
tcatctactgccgcagccccgacttccgcaaggccttccag

SEQ ID NO: 20807 - DNA, 154 bp, Homo sapiens; identical to SEQ ID NO: 10526
  misc_feature 1..154: note = chr10:116852264-116852418
  misc_feature 1..154: note = hyper
  source 1..154: mol_type = genomic DNA

SEQ ID NO: 20808 - DNA, 262 bp, Homo sapiens
  misc_feature 1..262: note = chr10:118032547-118032809
  misc_feature 1..262: note = hyper
  source 1..262: mol_type = genomic DNA
aaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaa

SEQ ID NO: 20809 - DNA, 135 bp, Homo sapiens
  misc_feature 1..135: note = chr10:118033542-118033677
  misc_feature 1..135: note = hyper
  source 1..135: mol_type = genomic DNA
ttagaaaatttataagctgacctccattttggctgtttcgagagtaaattaacaacaacaaaaaaagcctaacatgtacacagcccttcgccccaacccctgggaccgctggttcccagtcgtgctgctcacccc

SEQ ID NO: 20810 - DNA, 42 bp, Homo sapiens
  misc_feature 1..42: note = chr10:118890938-118890980
  misc_feature 1..42: note = hyper
  source 1..42: mol_type = genomic DNA
gatctcagcaaaaagcggagctcaaggctcagggactccgcc

SEQ ID NO: 20811 - DNA, 14 bp, Homo sapiens
  misc_feature 1..14: note = chr10:118894477-118894491
  misc_feature 1..14: note = hyper
  source 1..14: mol_type = genomic DNA
ggaatttccggtgg

SEQ ID NO: 20812 - DNA, 89 bp, Homo sapiens
  misc_feature 1..89: note = chr10:118896540-118896629
  misc_feature 1..89: note = hyper
  source 1..89: mol_type = genomic DNA
cagctctgggcttgccgaccagaccgtgatccagacgtccccacccccaccctcgagtctccttccctccggagtccgcgcggcggaag

SEQ ID NO: 20813 - DNA, 30 bp, Homo sapiens; identical to SEQ ID NO: 10543
  misc_feature 1..30: note = chr10:118897545-118897575
  misc_feature 1..30: note = hyper
  source 1..30: mol_type = genomic DNA

SEQ ID NO: 20814 - DNA, 18 bp, Homo sapiens
  misc_feature 1..18: note = chr10:118897895-118897913
  misc_feature 1..18: note = hyper
  source 1..18: mol_type = genomic DNA
tcaggtagcgaacagcgc

SEQ ID NO: 20815 - DNA, 187 bp, Homo sapiens
  misc_feature 1..187: note = chr10:118897968-118898155
  misc_feature 1..187: note = hyper
  source 1..187: mol_type = genomic DNA
cgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 20816 - DNA, 209 bp, Homo sapiens
  misc_feature 1..209: note = chr10:118899957-118900166
  misc_feature 1..209: note = hyper
  source 1..209: mol_type = genomic DNA
ggggtccctgcagcagatggggcattcacttccctgcagagctcggcccgagggagctcctgggcctccttgggcagggaggggtgcgaccgaattccctggcacaccggcccttccttgccccctaccctggaggggttggaggggtcggaccctcggactacgcgagatcgggtgcgcaggaggattctaggccttcctcagccctt

SEQ ID NO: 20817 - DNA, 353 bp, Homo sapiens
  misc_feature 1..353: note = chr10:118922208-118922561
  misc_feature 1..353: note = hyper
  source 1..353: mol_type = genomic DNA
tctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtc

SEQ ID NO: 20818 - DNA, 75 bp, Homo sapiens
  misc_feature 1..75: note = chr10:118923063-118923138
  misc_feature 1..75: note = hyper
  source 1..75: mol_type = genomic DNA
gcggagaaccctctccgagctggggtccccgcctgctgggcaacctcacctcaacgtctggcctggcctggggcc

SEQ ID NO: 20819 - DNA, 46 bp, Homo sapiens
  misc_feature 1..46: note = chr10:118923259-118923305
  misc_feature 1..46: note = hyper
  source 1..46: mol_type = genomic DNA
ggacagcccaagctgtcccgcccgctgcgcccgaggagcatcccct

SEQ ID NO: 20820 - DNA, 173 bp, Homo sapiens
  misc_feature 1..173: note = chr10:118924431-118924604
  misc_feature 1..173: note = hyper
  source 1..173: mol_type = genomic DNA
tttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatc

SEQ ID NO: 20821 - DNA, 480 bp, Homo sapiens; identical to SEQ ID NO: 10551
  misc_feature 1..480: note = chr10:118925062-118925542
  misc_feature 1..480: note = hyper
  source 1..480: mol_type = genomic DNA

SEQ ID NO: 20822 - DNA, 86 bp, Homo sapiens; identical to SEQ ID NO: 10552
  misc_feature 1..86: note = chr10:118925816-118925902
  misc_feature 1..86: note = hyper
  source 1..86: mol_type = genomic DNA

SEQ ID NO: 20823 - DNA, 60 bp, Homo sapiens
  misc_feature 1..60: note = chr10:118927026-118927086
  misc_feature 1..60: note = hyper
  source 1..60: mol_type = genomic DNA
ttcggtttccattcacgctaccctctctgagccgcaattctctctcctgcgttggcactg

SEQ ID NO: 20824 - DNA, 267 bp, Homo sapiens
  misc_feature 1..267: note = chr10:118927296-118927563
  misc_feature 1..267: note = hyper
  source 1..267: mol_type = genomic DNA
cctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggc

SEQ ID NO: 20825 - DNA, 30 bp, Homo sapiens; identical to SEQ ID NO: 10554
  misc_feature 1..30: note = chr10:118928412-118928442
  misc_feature 1..30: note = hyper
  source 1..30: mol_type = genomic DNA

SEQ ID NO: 20826 - DNA, 113 bp, Homo sapiens; identical to SEQ ID NO: 10555
  misc_feature 1..113: note = chr10:119000479-119000592
  misc_feature 1..113: note = hyper
  source 1..113: mol_type = genomic DNA

SEQ ID NO: 20827 - DNA, 200 bp, Homo sapiens; identical to SEQ ID NO: 3656
  misc_feature 1..200: note = chr10:119001328-119001528
  misc_feature 1..200: note = hyper
  source 1..200: mol_type = genomic DNA

SEQ ID NO: 20828 - DNA, 83 bp, Homo sapiens; identical to SEQ ID NO: 10561
  misc_feature 1..83: note = chr10:119297144-119297227
  misc_feature 1..83: note = hyper
  source 1..83: mol_type = genomic DNA

SEQ ID NO: 20829 - DNA, 115 bp, Homo sapiens
  misc_feature 1..115: note = chr10:119297529-119297644
  misc_feature 1..115: note = hyper
  source 1..115: mol_type = genomic DNA
aagggctcgcccttcacgggcgtcggtgcggtccgcggcgagccgcgggagcacagggcgggctcagcattctggttcaacgtgaggaccagaacctcggcgatcagggaccagg

SEQ ID NO: 20830 - DNA, 81 bp, Homo sapiens; identical to SEQ ID NO: 10563
  misc_feature 1..81: note = chr10:119300926-119301007
  misc_feature 1..81: note = hyper
  source 1..81: mol_type = genomic DNA

SEQ ID NO: 20831 - DNA, 42 bp, Homo sapiens
  misc_feature 1..42: note = chr10:119301323-119301365
  misc_feature 1..42: note = hyper
  source 1..42: mol_type = genomic DNA
ctagagaccgtggggcgagagagggagagagttggaagccca

SEQ ID NO: 20832 - DNA, 53 bp, Homo sapiens
  misc_feature 1..53: note = chr10:119302909-119302962
  misc_feature 1..53: note = hyper
  source 1..53: mol_type = genomic DNA
aaatccgttcctcaacggcttccactcggccgccgccgccgccgccggtaggg

SEQ ID NO: 20833 - DNA, 409 bp, Homo sapiens; identical to SEQ ID NO: 10566
  misc_feature 1..409: note = chr10:119303312-119303721
  misc_feature 1..409: note = hyper
  source 1..409: mol_type = genomic DNA

SEQ ID NO: 20834 - DNA, 37 bp, Homo sapiens; identical to SEQ ID NO: 10567
  misc_feature 1..37: note = chr10:119304504-119304541
  misc_feature 1..37: note = hyper
  source 1..37: mol_type = genomic DNA

SEQ ID NO: 20835 - DNA, 33 bp, Homo sapiens; identical to SEQ ID NO: 10571
  misc_feature 1..33: note = chr10:119494374-119494407
  misc_feature 1..33: note = hyper
  source 1..33: mol_type = genomic DNA

SEQ ID NO: 20836 - DNA, 15 bp, Homo sapiens
  misc_feature 1..15: note = chr10:119494848-119494863
  misc_feature 1..15: note = hyper
  source 1..15: mol_type = genomic DNA
cgggagaagttcagg

SEQ ID NO: 20837 - DNA, 85 bp, Homo sapiens; identical to SEQ ID NO: 10575
  misc_feature 1..85: note = chr10:121301528-121301613
  misc_feature 1..85: note = hyper
  source 1..85: mol_type = genomic DNA

SEQ ID NO: 20838 - DNA, 112 bp, Homo sapiens; identical to SEQ ID NO: 10576
  misc_feature 1..112: note = chr10:122216112-122216224
  misc_feature 1..112: note = hyper
  source 1..112: mol_type = genomic DNA

SEQ ID NO: 20839 - DNA, 232 bp, Homo sapiens; identical to SEQ ID NO: 10577
  misc_feature 1..232: note = chr10:122216525-122216757
  misc_feature 1..232: note = hyper
  source 1..232: mol_type = genomic DNA

SEQ ID NO: 20840 - DNA, 42 bp, Homo sapiens; identical to SEQ ID NO: 10578
  misc_feature 1..42: note = chr10:122216793-122216835
  misc_feature 1..42: note = hyper
  source 1..42: mol_type = genomic DNA

SEQ ID NO: 20841 - DNA, 34 bp, Homo sapiens; identical to SEQ ID NO: 10579
  misc_feature 1..34: note = chr10:122217317-122217351
  misc_feature 1..34: note = hyper
  source 1..34: mol_type = genomic DNA

SEQ ID NO: 20842 - DNA, 30 bp, Homo sapiens; identical to SEQ ID NO: 10581
  misc_feature 1..30: note = chr10:123356872-123356902
  misc_feature 1..30: note = hyper
  source 1..30: mol_type = genomic DNA

SEQ ID NO: 20843 - DNA, 35 bp, Homo sapiens; identical to SEQ ID NO: 10583
  misc_feature 1..35: note = chr10:124221715-124221750
  misc_feature 1..35: note = hyper
  source 1..35: mol_type = genomic DNA

SEQ ID NO: 20844 - DNA, 41 bp, Homo sapiens
  misc_feature 1..41: note = chr10:124893594-124893635
  misc_feature 1..41: note = hyper
  source 1..41: mol_type = genomic DNA
agcaaaaatggggttcgctgctgtagatgaatgcagaaaga

SEQ ID NO: 20845 - DNA, 200 bp, Homo sapiens
  misc_feature 1..200: note = chr10:124893765-124893965
  misc_feature 1..200: note = hyper
  source 1..200: mol_type = genomic DNA
cgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtct

SEQ ID NO: 20846 - DNA, 128 bp, Homo sapiens
  misc_feature 1..128: note = chr10:124894479-124894607
  misc_feature 1..128: note = hyper
  source 1..128: mol_type = genomic DNA
gaagacgcagtgcgaggacttacacctggattcccttactatcggctggatggtgggtggggaacccaaatccctctcttcttggcctcgcccttcctagcaggctttaggaaaaataccgaggtcgc

SEQ ID NO: 20847 - DNA, 19 bp, Homo sapiens
  misc_feature 1..19: note = chr10:124894870-124894889
  misc_feature 1..19: note = hyper
  source 1..19: mol_type = genomic DNA
gggctcgcggccgttagtg

SEQ ID NO: 20848 - DNA, 265 bp, Homo sapiens
  misc_feature 1..265: note = chr10:124895161-124895426
  misc_feature 1..265: note = hyper
  source 1..265: mol_type = genomic DNA
ccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttgg

SEQ ID NO: 20849 - DNA, 33 bp, Homo sapiens
  misc_feature 1..33: note = chr10:124899116-124899149
  misc_feature 1..33: note = hyper
  source 1..33: mol_type = genomic DNA
tctcccctgtactttccgcggcctgaaacgccc

SEQ ID NO: 20850 - DNA, 69 bp, Homo sapiens
  misc_feature 1..69: note = chr10:124903238-124903307
  misc_feature 1..69: note = hyper
  source 1..69: mol_type = genomic DNA
atccctttgggtttaggcctgggagaggtatagagccagcgagagagcgcgttgcgcctatcactgagg

SEQ ID NO: 20851 - DNA, 46 bp, Homo sapiens
  misc_feature 1..46: note = chr10:124905119-124905165
  misc_feature 1..46: note = hyper
  source 1..46: mol_type = genomic DNA
tcactgtttcagggcctgggagttgcttttccgaggcccacttcga

SEQ ID NO: 20852 - DNA, 19 bp, Homo sapiens
  misc_feature 1..19: note = chr10:124907293-124907312
  misc_feature 1..19: note = hyper
  source 1..19: mol_type = genomic DNA
cgtcgcctgcggaggcgtc

SEQ ID NO: 20853 - DNA, 55 bp, Homo sapiens
  misc_feature 1..55: note = chr10:124907534-124907589
  misc_feature 1..55: note = hyper
  source 1..55: mol_type = genomic DNA
ttttccggggccgctcggcggcgctgcgattggccgcgttcgggtaacctctatg

SEQ ID NO: 20854 - DNA, 112 bp, Homo sapiens
  misc_feature 1..112: note = chr10:124907979-124908091
  misc_feature 1..112: note = hyper
  source 1..112: mol_type = genomic DNA
gcccctcggaggcaccgcgggagcccgtcggctggccagccaggaagcgcagcctgtccgtgtcctcggaggaggaggagccggacgacggctggaaggcgcccgcctgctt

SEQ ID NO: 20855 - DNA, 174 bp, Homo sapiens
  misc_feature 1..174: note = chr10:124908121-124908295
  misc_feature 1..174: note = hyper
  source 1..174: mol_type = genomic DNA
gggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggag

SEQ ID NO: 20856 - DNA, 145 bp, Homo sapiens; identical to SEQ ID NO: 10603
  misc_feature 1..145: note = chr10:125425698-125425843
  misc_feature 1..145: note = hyper
  source 1..145: mol_type = genomic DNA

SEQ ID NO: 20857 - DNA, 88 bp, Homo sapiens; identical to SEQ ID NO: 3676
  misc_feature 1..88: note = chr10:125651372-125651460
  misc_feature 1..88: note = hyper
  source 1..88: mol_type = genomic DNA

SEQ ID NO: 20858 - DNA, 155 bp, Homo sapiens
  misc_feature 1..155: note = chr10:125851173-125851328
  misc_feature 1..155: note = hyper
  source 1..155: mol_type = genomic DNA
tcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaaga

SEQ ID NO: 20859 - DNA, 50 bp, Homo sapiens
  misc_feature 1..50: note = chr10:126135877-126135927
  misc_feature 1..50: note = hyper
  source 1..50: mol_type = genomic DNA
cgcggcgggcaggggtgcgctgacacccgcgcacctgcacccccggtgga

SEQ ID NO: 20860 - DNA, 36 bp, Homo sapiens; identical to SEQ ID NO: 10610
  misc_feature 1..36: note = chr10:126137640-126137676
  misc_feature 1..36: note = hyper
  source 1..36: mol_type = genomic DNA

SEQ ID NO: 20861 - DNA, 698 bp, Homo sapiens; identical to SEQ ID NO: 10611
  misc_feature 1..698: note = chr10:126138211-126138909
  misc_feature 1..698: note = hyper
  source 1..698: mol_type = genomic DNA

SEQ ID NO: 20862 - DNA, 70 bp, Homo sapiens; identical to SEQ ID NO: 10612
  misc_feature 1..70: note = chr10:128075707-128075777
  misc_feature 1..70: note = hyper
  source 1..70: mol_type = genomic DNA

SEQ ID NO: 20863 - DNA, 46 bp, Homo sapiens; identical to SEQ ID NO: 10613
  misc_feature 1..46: note = chr10:128075978-128076024
  misc_feature 1..46: note = hyper
  source 1..46: mol_type = genomic DNA

SEQ ID NO: 20864 - DNA, 128 bp, Homo sapiens; identical to SEQ ID NO: 10614
  misc_feature 1..128: note = chr10:128076940-128077068
  misc_feature 1..128: note = hyper
  source 1..128: mol_type = genomic DNA

SEQ ID NO: 20865 - DNA, 17 bp, Homo sapiens
  misc_feature 1..17: note = chr10:128993505-128993522
  misc_feature 1..17: note = hyper
  source 1..17: mol_type = genomic DNA
cgaccccgggctgcccg

SEQ ID NO: 20866 - DNA, 41 bp, Homo sapiens; identical to SEQ ID NO: 10616
  misc_feature 1..41: note = chr10:128993580-128993621
  misc_feature 1..41: note = hyper
  source 1..41: mol_type = genomic DNA

SEQ ID NO: 20867 - DNA, 95 bp, Homo sapiens
  misc_feature 1..95: note = chr10:129948016-129948111
  misc_feature 1..95: note = hyper
  source 1..95: mol_type = genomic DNA
accgtcagctgccgccgacggagcccacagaggaggctcgggcgcccgcgccccctgcgcagcggcccctccgcagcggccccagcccgcgtccc

SEQ ID NO: 20868 - DNA, 116 bp, Homo sapiens; identical to SEQ ID NO: 10623
  misc_feature 1..116: note = chr10:130008498-130008614
  misc_feature 1..116: note = hyper
  source 1..116: mol_type = genomic DNA

SEQ ID NO: 20869 - DNA, 61 bp, Homo sapiens; identical to SEQ ID NO: 10624
  misc_feature 1..61: note = chr10:130008816-130008877
  misc_feature 1..61: note = hyper
  source 1..61: mol_type = genomic DNA

SEQ ID NO: 20870 - DNA, 73 bp, Homo sapiens; identical to SEQ ID NO: 10625
  misc_feature 1..73: note = chr10:130008906-130008979
  misc_feature 1..73: note = hyper
  source 1..73: mol_type = genomic DNA

SEQ ID NO: 20871 - DNA, 146 bp, Homo sapiens; identical to SEQ ID NO: 946
  misc_feature 1..146: note = chr10:130085053-130085199
  misc_feature 1..146: note = hyper
  source 1..146: mol_type = genomic DNA

SEQ ID NO: 20872 - DNA, 76 bp, Homo sapiens; identical to SEQ ID NO: 947
  misc_feature 1..76: note = chr10:130085200-130085276
  misc_feature 1..76: note = hyper
  source 1..76: mol_type = genomic DNA

SEQ ID NO: 20873 - DNA, 47 bp, Homo sapiens
  misc_feature 1..47: note = chr10:130085362-130085409
  misc_feature 1..47: note = hyper
  source 1..47: mol_type = genomic DNA
gtccccgggccgcggcgcgctccccgccacgccgcacatcaaggccc

SEQ ID NO: 20874 - DNA, 30 bp, Homo sapiens; identical to SEQ ID NO: 10630
  misc_feature 1..30: note = chr10:130339734-130339764
  misc_feature 1..30: note = hyper
  source 1..30: mol_type = genomic DNA

SEQ ID NO: 20875 - DNA, 127 bp, Homo sapiens
  misc_feature 1..127: note = chr10:131761725-131761852
  misc_feature 1..127: note = hyper
  source 1..127: mol_type = genomic DNA
tggatttccggaggttggaaggcggctgcttctcgaagtgcgcccgcgccagccccacgccgctgcgggaggaaagagacagcggcccggtgaggagcgcggcgccggccggcggagggggccgggc

SEQ ID NO: 20876 - DNA, 42 bp, Homo sapiens
  misc_feature 1..42: note = chr10:131762124-131762166
  misc_feature 1..42: note = hyper
  source 1..42: mol_type = genomic DNA
ccctcgccctgctcggcgcctgcggtccggccccgccgccgg

SEQ ID NO: 20877 - DNA, 265 bp, Homo sapiens
  misc_feature 1..265: note = chr10:131762639-131762904
  misc_feature 1..265: note = hyper
  source 1..265: mol_type = genomic DNA
cctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaa

SEQ ID NO: 20878 - DNA, 397 bp, Homo sapiens
  misc_feature 1..397: note = chr10:131762940-131763337
  misc_feature 1..397: note = hyper
  source 1..397: mol_type = genomic DNA
ggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 20879 - DNA, 37 bp, Homo sapiens
  misc_feature 1..37: note = chr10:131769496-131769533
  misc_feature 1..37: note = hyper
  source 1..37: mol_type = genomic DNA
aagaaagaaagaaaccggcttctcttctagactatta

SEQ ID NO: 20880 - DNA, 39 bp, Homo sapiens
  misc_feature 1..39: note = chr10:131770237-131770276
  misc_feature 1..39: note = hyper
  source 1..39: mol_type = genomic DNA
atgaaacactgattgctagttatgcggacttttaagcac

SEQ ID NO: 20881 - DNA, 54 bp, Homo sapiens
  misc_feature 1..54: note = chr10:131770603-131770657
  misc_feature 1..54: note = hyper
  source 1..54: mol_type = genomic DNA
tgcttcctgcgttgtcgtccaggcatctaggcgcttcgaccttccccatccctc

SEQ ID NO: 20882 - DNA, 301 bp, Homo sapiens
  misc_feature 1..301: note = chr10:131770687-131770988
  misc_feature 1..301: note = hyper
  source 1..301: mol_type = genomic DNA
aagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgc

SEQ ID NO: 20883 - DNA, 21 bp, Homo sapiens
  misc_feature 1..21: note = chr10:131771281-131771302
  misc_feature 1..21: note = hyper
  source 1..21: mol_type = genomic DNA
gggagagcccacgggcccggc

SEQ ID NO: 20884 - DNA, 121 bp, Homo sapiens; identical to SEQ ID NO: 3684
  misc_feature 1..121: note = chr10:133110064-133110185
  misc_feature 1..121: note = hyper
  source 1..121: mol_type = genomic DNA

SEQ ID NO: 20885 - DNA, 139 bp, Homo sapiens
  misc_feature 1..139: note = chr10:133110704-133110843
  misc_feature 1..139: note = hyper
  source 1..139: mol_type = genomic DNA
ggggcaggaccacccctctgtgaattcgtcctggatgcccccaggcacagtctgtactcctccctcccccagcacacgcggcctctgacgctgcacgccgagcttcctgggacccaggacgaaccgggctccaaggacc

SEQ ID NO: 20886 - DNA, 252 bp, Homo sapiens
  misc_feature 1..252: note = chr10:133795430-133795682
  misc_feature 1..252: note = hyper
  source 1..252: mol_type = genomic DNA
cggagccccgcagcccggccggaggaactcacagggcagggcggggccgggcggatctgcggccgcgtcgcccattggccgcgacttggggcctgcgcgtgcgcaggggcgtggggtgcgtgtggcacgtgcggcgcgtgcgcggggcgggtcctgcggtgggcgaggggcagaggcctgcggtgcgcgggacgcgggcggggagaggggcggggcgaggggcgcgcaggcgcgagggcggcagcgaccgcc

SEQ ID NO: 20887 - DNA, 127 bp, Homo sapiens
  misc_feature 1..127: note = chr10:133850008-133850135
  misc_feature 1..127: note = hyper
  source 1..127: mol_type = genomic DNA
gagcttgcacagcggctccgcggagaccgggactgcgtgggggaggatcgcggcgggggccgtcgccgagcaaggagcgcggccgcggggaccgcccgggagtgggggcggcggggcgggccgggtt

SEQ ID NO: 20888 - DNA, 137 bp, Homo sapiens; identical to SEQ ID NO: 10644
  misc_feature 1..137: note = chr10:133850156-133850293
  misc_feature 1..137: note = hyper
  source 1..137: mol_type = genomic DNA

SEQ ID NO: 20889 - skipped

SEQ ID NO: 20890 - DNA, 48 bp, Homo sapiens
  misc_feature 1..48: note = chr10:133850774-133850822
  misc_feature 1..48: note = hyper
  source 1..48: mol_type = genomic DNA
ttgcctctcgtggaaagccgctgggagttggagcggctccctcctgcc

SEQ ID NO: 20891 - DNA, 127 bp, Homo sapiens; identical to SEQ ID NO: 10646
  misc_feature 1..127: note = chr10:134000613-134000740
  misc_feature 1..127: note = hyper
  source 1..127: mol_type = genomic DNA

SEQ ID NO: 20892 - DNA, 59 bp, Homo sapiens; identical to SEQ ID NO: 10647
  misc_feature 1..59: note = chr10:134000798-134000857
  misc_feature 1..59: note = hyper
  source 1..59: mol_type = genomic DNA

SEQ ID NO: 20893 - DNA, 157 bp, Homo sapiens; identical to SEQ ID NO: 10649
  misc_feature 1..157: note = chr10:134120760-134120917
  misc_feature 1..157: note = hyper
  source 1..157: mol_type = genomic DNA

SEQ ID NO: 20894 - DNA, 30 bp, Homo sapiens; identical to SEQ ID NO: 10650
  misc_feature 1..30: note = chr10:134122245-134122275
  misc_feature 1..30: note = hyper
  source 1..30: mol_type = genomic DNA

SEQ ID NO: 20895 - DNA, 30 bp, Homo sapiens
  misc_feature 1..30: note = chr10:134599482-134599512
  misc_feature 1..30: note = hyper
  source 1..30: mol_type = genomic DNA
tccgggccccgccgccgccgcccctgcccg

SEQ ID NO: 20896 - DNA, 30 bp, Homo sapiens; identical to SEQ ID NO: 10652
  misc_feature 1..30: note = chr10:134599761-134599791
  misc_feature 1..30: note = hyper
  source 1..30: mol_type = genomic DNA

SEQ ID NO: 20897 - DNA, 30 bp, Homo sapiens; identical to SEQ ID NO: 10655
  misc_feature 1..30: note = chr10:134602360-134602390
  misc_feature 1..30: note = hyper
  source 1..30: mol_type = genomic DNA

SEQ ID NO: 20898 - DNA, 65 bp, Homo sapiens; identical to SEQ ID NO: 10656
  misc_feature 1..65: note = chr10:134676528-134676593
  misc_feature 1..65: note = hyper
  source 1..65: mol_type = genomic DNA

SEQ ID NO: 20899 - DNA, 10 bp, Homo sapiens
  misc_feature 1..10: note = chr10:134901183-134901193
  misc_feature 1..10: note = hyper
  source 1..10: mol_type = genomic DNA
ggaataacac

SEQ ID NO: 20900 - DNA, 42 bp, Homo sapiens; identical to SEQ ID NO: 10659
  misc_feature 1..42: note = chr10:134974307-134974349
  misc_feature 1..42: note = hyper
  source 1..42: mol_type = genomic DNA

SEQ ID NO: 20901 - DNA, 88 bp, Homo sapiens
  misc_feature 1..88: note = chr10:135043538-135043626
  misc_feature 1..88: note = hyper
  source 1..88: mol_type = genomic DNA
aactcctgaggaccctccgtttccaaccgaagccagtctttgctctgcgtcttcccggccgcagcgccaggaccgaccccttaggacc

SEQ ID NO: 20902 - DNA, 142 bp, Homo sapiens
  misc_feature 1..142: note = chr10:135043826-135043968
  misc_feature 1..142: note = hyper
  source 1..142: mol_type = genomic DNA
cgccccccgcgccgccctcgcccgccagccccgaccccgagccgcggacacccggagacgccccggggaccccgccccggaggcccgcctcgcccagcgcgctgggggaactcgggttgccggtgtccccgggctcggcgca

SEQ ID NO: 20903 - DNA, 101 bp, Homo sapiens
  misc_feature 1..101: note = chr10:135044573-135044674
  misc_feature 1..101: note = hyper
  source 1..101: mol_type = genomic DNA
cggctccccgccagctcccgccccgaccgccctcgccacctgcatccccgaggaccgcgcgcccgtccgcggccccgggtccccgccgccacccccggccc

SEQ ID NO: 20904 - DNA, 218 bp, Homo sapiens
  misc_feature 1..218: note = chr10:135048939-135049157
  misc_feature 1..218: note = hyper
  source 1..218: mol_type = genomic DNA
gggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggag

SEQ ID NO: 20905 - DNA, 56 bp, Homo sapiens; identical to SEQ ID NO: 10664
  misc_feature 1..56: note = chr10:135049727-135049783
  misc_feature 1..56: note = hyper
  source 1..56: mol_type = genomic DNA

SEQ ID NO: 20906 - DNA, 43 bp, Homo sapiens
  misc_feature 1..43: note = chr10:135050679-135050722
  misc_feature 1..43: note = hyper
  source 1..43: mol_type = genomic DNA
gggatggagtcagggagccgcccgcgcccgaatgcagaggctc

SEQ ID NO: 20907 - DNA, 574 bp, Homo sapiens
  misc_feature 1..574: note = chr10:135138981-135139555
  misc_feature 1..574: note = hyper
  source 1..574: mol_type = genomic DNA
ggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggat

SEQ ID NO: 20908 - DNA, 100 bp, Homo sapiens; identical to SEQ ID NO: 10667
  misc_feature 1..100: note = chr10:135148986-135149086
  misc_feature 1..100: note = hyper
  source 1..100: mol_type = genomic DNA

SEQ ID NO: 20909 - DNA, 30 bp, Homo sapiens; identical to SEQ ID NO: 10668
  misc_feature 1..30: note = chr11:308110-308140
  misc_feature 1..30: note = hyper
  source 1..30: mol_type = genomic DNA

SEQ ID NO: 20910 - DNA, 103 bp, Homo sapiens
  misc_feature 1..103: note = chr11:406939-407042
  misc_feature 1..103: note = hyper
  source 1..103: mol_type = genomic DNA
aaggtgatgaagatgggtctgcgggtgagctccagcagccggcacaggccctccctgcggggcgggaccgtcaggggggtgggtgctacgctggggcccaccc

SEQ ID NO: 20911 - DNA, 26 bp, Homo sapiens
  misc_feature 1..26: note = chr11:407401-407427
  misc_feature 1..26: note = hyper
  source 1..26: mol_type = genomic DNA
gcacggggtggggcccgggataccag

SEQ ID NO: 20912 - DNA, 26 bp, Homo sapiens
  misc_feature 1..26: note = chr11:637441-637467
  misc_feature 1..26: note = hyper
  source 1..26: mol_type = genomic DNA
cgcggtgctcgcggggaactcgctcg

SEQ ID NO: 20913 - DNA, 101 bp, Homo sapiens
  misc_feature 1..101: note = chr11:726316-726417
  misc_feature 1..101: note = hyper
  source 1..101: mol_type = genomic DNA
catggacgaggtcaacgacgagctcatccggaaaatcagcaacatcagggcgcagccacagaggcacttccgcgtggagcgcagccagcccgtgagccagc

SEQ ID NO: 20914 - DNA, 138 bp, Homo sapiens; identical to SEQ ID NO: 10674
  misc_feature 1..138: note = chr11:1410132-1410270
  misc_feature 1..138: note = hyper
  source 1..138: mol_type = genomic DNA

SEQ ID NO: 20915 - DNA, 34 bp, Homo sapiens; identical to SEQ ID NO: 10675
  misc_feature 1..34: note = chr11:1411655-1411689
  misc_feature 1..34: note = hyper
  source 1..34: mol_type = genomic DNA

SEQ ID NO: 20916 - DNA, 30 bp, Homo sapiens; identical to SEQ ID NO: 10676
  misc_feature 1..30: note = chr11:1412279-1412309
  misc_feature 1..30: note = hyper
  source 1..30: mol_type = genomic DNA

SEQ ID NO: 20917 - DNA, 379 bp, Homo sapiens; identical to SEQ ID NO: 10677
  misc_feature 1..379: note = chr11:1770262-1770641
  misc_feature 1..379: note = hyper
  source 1..379: mol_type = genomic DNA

SEQ ID NO: 20918 - DNA, 81 bp, Homo sapiens
  misc_feature 1..81: note = chr11:2292636-2292717
  misc_feature 1..81: note = hyper
  source 1..81: mol_type = genomic DNA
ggggtgggaggttcaggttcccggggcgccttccccaacccgccccgctttccccgtccctccacgcgcaccctgcctgtg

SEQ ID NO: 20919 - DNA, 86 bp, Homo sapiens; identical to SEQ ID NO: 10682
  misc_feature 1..86: note = chr11:2883674-2883760
  misc_feature 1..86: note = hyper
  source 1..86: mol_type = genomic DNA

SEQ ID NO: 20920 - DNA, 156 bp, Homo sapiens; identical to SEQ ID NO: 10683
  misc_feature 1..156: note = chr11:6280445-6280601
  misc_feature 1..156: note = hyper
  source 1..156: mol_type = genomic DNA

SEQ ID NO: 20921 - DNA, 51 bp, Homo sapiens; identical to SEQ ID NO: 10684
  misc_feature 1..51: note = chr11:6281269-6281320
  misc_feature 1..51: note = hyper
  source 1..51: mol_type = genomic DNA

SEQ ID NO: 20922 - DNA, 104 bp, Homo sapiens; identical to SEQ ID NO: 10685
  misc_feature 1..104: note = chr11:6676726-6676830
  misc_feature 1..104: note = hyper
  source 1..104: mol_type = genomic DNA

SEQ ID NO: 20923 - DNA, 84 bp, Homo sapiens; identical to SEQ ID NO: 10686
  misc_feature 1..84: note = chr11:6677244-6677328
  misc_feature 1..84: note = hyper
  source 1..84: mol_type = genomic DNA

SEQ ID NO: 20924 - DNA, 614 bp, Homo sapiens; identical to SEQ ID NO: 10687
  misc_feature 1..614: note = chr11:6947606-6948220
  misc_feature 1..614: note = hyper
  source 1..614: mol_type = genomic DNA

SEQ ID NO: 20925 - DNA, 30 bp, Homo sapiens; identical to SEQ ID NO: 10688
  misc_feature 1..30: note = chr11:7273118-7273148
  misc_feature 1..30: note = hyper
  source 1..30: mol_type = genomic DNA

SEQ ID NO: 20926 - skipped

SEQ ID NO: 20927 - DNA, 38 bp, Homo sapiens; identical to SEQ ID NO: 10690
  misc_feature 1..38: note = chr11:8040298-8040336
  misc_feature 1..38: note = hyper
  source 1..38: mol_type = genomic DNA

SEQ ID NO: 20928 - skipped

SEQ ID NO: 20929 - DNA, 67 bp, Homo sapiens; identical to SEQ ID NO: 10692
  misc_feature 1..67: note = chr11:8041504-8041571
  misc_feature 1..67: note = hyper
  source 1..67: mol_type = genomic DNA

SEQ ID NO: 20930 - DNA, 344 bp, Homo sapiens; identical to SEQ ID NO: 10693
  misc_feature 1..344: note = chr11:8102616-8102960
  misc_feature 1..344: note = hyper
  source 1..344: mol_type = genomic DNA

SEQ ID NO: 20931 - DNA, 41 bp, Homo sapiens
  misc_feature 1..41: note = chr11:8189946-8189987
  misc_feature 1..41: note = hyper
  source 1..41: mol_type = genomic DNA
gttgaaaaaacataacgacttaaggtttgctgtaccaattc

SEQ ID NO: 20932 - DNA, 35 bp, Homo sapiens; identical to SEQ ID NO: 10695
  misc_feature 1..35: note = chr11:8284256-8284291
  misc_feature 1..35: note = hyper
  source 1..35: mol_type = genomic DNA

SEQ ID NO: 20933 - DNA, 39 bp, Homo sapiens; identical to SEQ ID NO: 10697
  misc_feature 1..39: note = chr11:8284896-8284935
  misc_feature 1..39: note = hyper
  source 1..39: mol_type = genomic DNA

SEQ ID NO: 20934 - DNA, 27 bp, Homo sapiens
  misc_feature 1..27: note = chr11:8289745-8289772
  misc_feature 1..27: note = hyper
  source 1..27: mol_type = genomic DNA
tcccgccgccgccgaagcccgggcgct

SEQ ID NO: 20935 - DNA, 138 bp, Homo sapiens
  misc_feature 1..138: note = chr11:8290057-8290195
  misc_feature 1..138: note = hyper
  source 1..138: mol_type = genomic DNA
cgccgccggccgcctgcgctgctcccgccggccccgcgcgggcgccgagtccggagagccgcgaccgccgacgggggcagacggaccggagtccggagcgcagccccgcgggcagggagcgcaggaggagggactggg

SEQ ID NO: 20936 - DNA, 30 bp, Homo sapiens; identical to SEQ ID NO: 10700
  misc_feature 1..30: note = chr11:8615288-8615318
  misc_feature 1..30: note = hyper
  source 1..30: mol_type = genomic DNA

SEQ ID NO: 20937 - DNA, 890 bp, Homo sapiens
  misc_feature 1..890: note = chr11:9025080-9025970
  misc_feature 1..890: note = hyper
  source 1..890: mol_type = genomic DNA
gggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgc

SEQ ID NO: 20938 - DNA, 205 bp, Homo sapiens
  misc_feature 1..205: note = chr11:9112741-9112946
  misc_feature 1..205: note = hyper
  source 1..205: mol_type = genomic DNA
gccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctc

SEQ ID NO: 20939 - DNA, 26 bp, Homo sapiens
  misc_feature 1..26: note = chr11:12029931-12029957
  misc_feature 1..26: note = hyper
  source 1..26: mol_type = genomic DNA
gcgcaatttgtgctgcgtgtcctcca

SEQ ID NO: 20940 - DNA, 194 bp, Homo sapiens; identical to SEQ ID NO: 10705
  misc_feature 1..194: note = chr11:12030273-12030467
  misc_feature 1..194: note = hyper
  source 1..194: mol_type = genomic DNA

SEQ ID NO: 20941 - DNA, 61 bp, Homo sapiens; identical to SEQ ID NO: 10706
  misc_feature 1..61: note = chr11:13031258-13031319
  misc_feature 1..61: note = hyper
  source 1..61: mol_type = genomic DNA

SEQ ID NO: 20942 - DNA, 33 bp, Homo sapiens
  misc_feature 1..33: note = chr11:15136394-15136427
  misc_feature 1..33: note = hyper
  source 1..33: mol_type = genomic DNA
gggcgggggagaacggggcggggggtggggcgg

SEQ ID NO: 20943 - DNA, 59 bp, Homo sapiens; identical to SEQ ID NO: 10708
  misc_feature 1..59: note = chr11:16626111-16626170
  misc_feature 1..59: note = hyper
  source 1..59: mol_type = genomic DNA

SEQ ID NO: 20944 - DNA, 53 bp, Homo sapiens; identical to SEQ ID NO: 10710
  misc_feature 1..53: note = chr11:16634305-16634358
  misc_feature 1..53: note = hyper
  source 1..53: mol_type = genomic DNA

SEQ ID NO: 20945 - DNA, 143 bp, Homo sapiens; identical to SEQ ID NO: 10713
  misc_feature 1..143: note = chr11:17498038-17498181
  misc_feature 1..143: note = hyper
  source 1..143: mol_type = genomic DNA

SEQ ID NO: 20946 - DNA, 49 bp, Homo sapiens; identical to SEQ ID NO: 10714
  misc_feature 1..49: note = chr11:17717486-17717535
  misc_feature 1..49: note = hyper
  source 1..49: mol_type = genomic DNA

SEQ ID NO: 20947 - DNA, 79 bp, Homo sapiens
  misc_feature 1..79: note = chr11:17740414-17740493
  misc_feature 1..79: note = hyper
  source 1..79: mol_type = genomic DNA
agctgggtttctaagcgtctagggaagaaggactgggcccacgacctgctgagcaactcccaggtcggggactggcgga

SEQ ID NO: 20948 - DNA, 39 bp, Homo sapiens; identical to SEQ ID NO: 10716
  misc_feature 1..39: note = chr11:17741123-17741162
  misc_feature 1..39: note = hyper
  source 1..39: mol_type = genomic DNA

SEQ ID NO: 20949 - DNA, 72 bp, Homo sapiens; identical to SEQ ID NO: 10721
  misc_feature 1..72: note = chr11:17756900-17756972
  misc_feature 1..72: note = hyper
  source 1..72: mol_type = genomic DNA

SEQ ID NO: 20950 - DNA, 15 bp, Homo sapiens
  misc_feature 1..15: note = chr11:17756993-17757008
  misc_feature 1..15: note = hyper
  source 1..15: mol_type = genomic DNA
cgaccacctcacaga

SEQ ID NO: 20951 - DNA, 53 bp, Homo sapiens; identical to SEQ ID NO: 10723
  misc_feature 1..53: note = chr11:17757704-17757757
  misc_feature 1..53: note = hyper
  source 1..53: mol_type = genomic DNA

SEQ ID NO: 20952 - DNA, 306 bp, Homo sapiens; identical to SEQ ID NO: 10724
  misc_feature 1..306: note = chr11:18742729-18743035
  misc_feature 1..306: note = hyper
  source 1..306: mol_type = genomic DNA

SEQ ID NO: 20953 - DNA, 57 bp, Homo sapiens
  misc_feature 1..57: note = chr11:18812557-18812614
  misc_feature 1..57: note = hyper
  source 1..57: mol_type = genomic DNA
gctgggggaggggagcgcgctaagcttgtattctaggggagggtgggacgcgggagg

SEQ ID NO: 20954 - DNA, 138 bp, Homo sapiens
  misc_feature 1..138: note = chr11:18812894-18813032
  misc_feature 1..138: note = hyper
  source 1..138: mol_type = genomic DNA
ccctcccccagcatgcgggcgcccagagccccacgggggcgtggcgggggcgggcgccggctcctcggccgggagggctggagaaggtgtcagttgcggggccgcccgaaggagggacccgcgccctccaccttccgg

SEQ ID NO: 20955 - DNA, 80 bp, Homo sapiens
  misc_feature 1..80: note = chr11:18813086-18813166
  misc_feature 1..80: note = hyper
  source 1..80: mol_type = genomic DNA
ccgggcgccggcgagcaggcgggcaggctggcgggaggatgcgcgcgcgagtgtgcgtgtgtctgcgtgtgtccctgctt

SEQ ID NO: 20956 - DNA, 75 bp, Homo sapiens
  misc_feature 1..75: note = chr11:18813376-18813451
  misc_feature 1..75: note = hyper
  source 1..75: mol_type = genomic DNA
ccccagccccggctccgccccgcccccgggcgggcttccgccgctcgccgggaattgcgcagggctggcggggcg

SEQ ID NO: 20957 - DNA, 88 bp, Homo sapiens
  misc_feature 1..88: note = chr11:18813947-18814035
  misc_feature 1..88: note = hyper
  source 1..88: mol_type = genomic DNA
ttctccctgttcagcctctggggagctagagcgagtggacagcccctccctccactgagtcttgccctcctgacgtgcggcgcggggc

SEQ ID NO: 20958 - DNA, 62 bp, Homo sapiens; identical to SEQ ID NO: 10729
  misc_feature 1..62: note = chr11:19366698-19366760
  misc_feature 1..62: note = hyper
  source 1..62: mol_type = genomic DNA

SEQ ID NO: 20959 - DNA, 124 bp, Homo sapiens
  misc_feature 1..124: note = chr11:19366978-19367102
  misc_feature 1..124: note = hyper
  source 1..124: mol_type = genomic DNA
ctctgtgctgagctccggggtccagagcagggtggggactgccgttggggagagggccggcccctcattgagaggctcgggggccacacctctgctgcgggactctgaccgagggccagggcct

SEQ ID NO: 20960 - DNA, 29 bp, Homo sapiens
  misc_feature 1..29: note = chr11:19367330-19367359
  misc_feature 1..29: note = hyper
  source 1..29: mol_type = genomic DNA
tccctctgggcgtacgtgcctgaggctgt

SEQ ID NO: 20961 - DNA, 39 bp, Homo sapiens; identical to SEQ ID NO: 10732
  misc_feature 1..39: note = chr11:19367898-19367937
  misc_feature 1..39: note = hyper
  source 1..39: mol_type = genomic DNA

SEQ ID NO: 20962 - DNA, 39 bp, Homo sapiens; identical to SEQ ID NO: 10733
  misc_feature 1..39: note = chr11:19367938-19367977
  misc_feature 1..39: note = hyper
  source 1..39: mol_type = genomic DNA

SEQ ID NO: 20963 - DNA, 30 bp, Homo sapiens; identical to SEQ ID NO: 10734
  misc_feature 1..30: note = chr11:19735404-19735434
  misc_feature 1..30: note = hyper
  source 1..30: mol_type = genomic DNA

SEQ ID NO: 20964 - DNA, 19 bp, Homo sapiens
  misc_feature 1..19: note = chr11:20153699-20153718
  misc_feature 1..19: note = hyper
  source 1..19: mol_type = genomic DNA
ccgcccatccacattcggc

SEQ ID NO: 20965 - DNA, 127 bp, Homo sapiens
  misc_feature 1..127: note = chr11:20153764-20153891
  misc_feature 1..127: note = hyper
  source 1..127: mol_type = genomic DNA
ctggaacgattgaaactaagggggtgcgccaactcccccaccttcgcgggtcccctggcaggagacctggtccttgccttaccgcagtaggtgtggctgtgactgaagggagcggcatccctgagca

SEQ ID NO: 20966 - DNA, 73 bp, Homo sapiens; identical to SEQ ID NO: 10736
  misc_feature 1..73: note = chr11:20177730-20177803
  misc_feature 1..73: note = hyper
  source 1..73: mol_type = genomic DNA

SEQ ID NO: 20967 - DNA, 173 bp, Homo sapiens
  misc_feature 1..173: note = chr11:20178305-20178478
  misc_feature 1..173: note = hyper
  source 1..173: mol_type = genomic DNA
ttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctg

SEQ ID NO: 20968 - DNA, 200 bp, Homo sapiens; identical to SEQ ID NO: 10738
  misc_feature 1..200: note = chr11:20178700-20178900
  misc_feature 1..200: note = hyper
  source 1..200: mol_type = genomic DNA

SEQ ID NO: 20969 - DNA, 33 bp, Homo sapiens
  misc_feature 1..33: note = chr11:20180793-20180826
  misc_feature 1..33: note = hyper
  source 1..33: mol_type = genomic DNA
cgaaggtcttgggagggacgctctggagcaagg

SEQ ID NO: 20970 - DNA, 28 bp, Homo sapiens
  misc_feature 1..28: note = chr11:20181185-20181213
  misc_feature 1..28: note = hyper
  source 1..28: mol_type = genomic DNA
tgtctcctagaagctcgaaggcagaaac

SEQ ID NO: 20971 - DNA, 32 bp, Homo sapiens
  misc_feature 1..32: note = chr11:20181254-20181286
  misc_feature 1..32: note = hyper
  source 1..32: mol_type = genomic DNA
tgactgcgcacagtctccgactgcgtgtgctc

SEQ ID NO: 20972 - DNA, 32 bp, Homo sapiens; identical to SEQ ID NO: 10745
  misc_feature 1..32: note = chr11:20184112-20184144
  misc_feature 1..32: note = hyper
  source 1..32: mol_type = genomic DNA

SEQ ID NO: 20973 - DNA, 69 bp, Homo sapiens
  misc_feature 1..69: note = chr11:20184500-20184569
  misc_feature 1..69: note = hyper
  source 1..69: mol_type = genomic DNA
cctgcttcctggggtcggtctccacagcctcctaaagaattcctaaagcgccaaagaggaaaagtgagg

SEQ ID NO: 20974 - DNA, 20 bp, Homo sapiens
  misc_feature 1..20: note = chr11:20185410-20185430
  misc_feature 1..20: note = hyper
  source 1..20: mol_type = genomic DNA
cccgacgcctggctttgggg

SEQ ID NO: 20975 - DNA, 17 bp, Homo sapiens
  misc_feature 1..17: note = chr11:20229550-20229567
  misc_feature 1..17: note = hyper
  source 1..17: mol_type = genomic DNA
gacgctcccttaggacc

SEQ ID NO: 20976 - DNA, 39 bp, Homo sapiens; identical to SEQ ID NO: 10749
  misc_feature 1..39: note = chr11:20230466-20230505
  misc_feature 1..39: note = hyper
  source 1..39: mol_type = genomic DNA

SEQ ID NO: 20977 - DNA, 310 bp, Homo sapiens
  misc_feature 1..310: note = chr11:20619407-20619717
  misc_feature 1..310: note = hyper
  source 1..310: mol_type = genomic DNA
agcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccc

SEQ ID NO: 20978 - skipped

SEQ ID NO: 20979 - DNA, 26 bp, Homo sapiens
  misc_feature 1..26: note = chr11:20691060-20691086
  misc_feature 1..26: note = hyper
  source 1..26: mol_type = genomic DNA
gccagcggtggggggcgggctggggg

SEQ ID NO: 20980 - DNA, 40 bp, Homo sapiens; identical to SEQ ID NO: 956
  misc_feature 1..40: note = chr11:20691121-20691161
  misc_feature 1..40: note = hyper
  source 1..40: mol_type = genomic DNA

SEQ ID NO: 20981 - DNA, 57 bp, Homo sapiens
  misc_feature 1..57: note = chr11:20691162-20691219
  misc_feature 1..57: note = hyper
  source 1..57: mol_type = genomic DNA
cccgctagcaagtttggcggctccaagccaggcgcgcctcaggatccaggctcattt

SEQ ID NO: 20982 - DNA, 164 bp, Homo sapiens
  misc_feature 1..164: note = chr11:20691452-20691616
  misc_feature 1..164: note = hyper
  source 1..164: mol_type = genomic DNA
gggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttc

SEQ ID NO: 20983 - DNA, 36 bp, Homo sapiens; identical to SEQ ID NO: 10761
  misc_feature 1..36: note = chr11:20692310-20692346
  misc_feature 1..36: note = hyper
  source 1..36: mol_type = genomic DNA

SEQ ID NO: 20984 - DNA, 30 bp, Homo sapiens; identical to SEQ ID NO: 10762
  misc_feature 1..30: note = chr11:20692851-20692881
  misc_feature 1..30: note = hyper
  source 1..30: mol_type = genomic DNA

SEQ ID NO: 20985 - DNA, 386 bp, Homo sapiens; identical to SEQ ID NO: 10763
  misc_feature 1..386: note = chr11:22214443-22214829
  misc_feature 1..386: note = hyper
  source 1..386: mol_type = genomic DNA

SEQ ID NO: 20986 - DNA, 15 bp, Homo sapiens
  misc_feature 1..15: note = chr11:22359403-22359418
  misc_feature 1..15: note = hyper
  source 1..15: mol_type = genomic DNA
tcttttatttactca

SEQ ID NO: 20987 - DNA, 105 bp, Homo sapiens; identical to SEQ ID NO: 10766
  misc_feature 1..105: note = chr11:22359777-22359882
  misc_feature 1..105: note = hyper
  source 1..105: mol_type = genomic DNA

SEQ ID NO: 20988 - DNA, 355 bp, Homo sapiens; identical to SEQ ID NO: 10767
  misc_feature 1..355: note = chr11:22362533-22362888
  misc_feature 1..355: note = hyper
  source 1..355: mol_type = genomic DNA

SEQ ID NO: 20989 - DNA, 61 bp, Homo sapiens
  misc_feature 1..61: note = chr11:22364975-22365036
  misc_feature 1..61: note = hyper
  source 1..61: mol_type = genomic DNA
agctggagcagagacaacagcccagaggggtttgaggactcccgggcgaagtcttctagtc

SEQ ID NO: 20990 - DNA, 70 bp, Homo sapiens
  misc_feature 1..70: note = chr11:22365477-22365547
  misc_feature 1..70: note = hyper
  source 1..70: mol_type = genomic DNA
cagctgctttcagtggcctcctgccttgctgcggtgtccacaaccaaggtcctagcgccagttcccagaa

SEQ ID NO: 20991 - DNA, 30 bp, Homo sapiens; identical to SEQ ID NO: 10770
  misc_feature 1..30: note = chr11:22688349-22688379
  misc_feature 1..30: note = hyper
  source 1..30: mol_type = genomic DNA

SEQ ID NO: 20992 - DNA, 25 bp, Homo sapiens
  misc_feature 1..25: note = chr11:27743608-27743633
  misc_feature 1..25: note = hyper
  source 1..25: mol_type = genomic DNA
accagaaaagcgcagcagggagggg

SEQ ID NO: 20993 - DNA, 250 bp, Homo sapiens
  misc_feature 1..250: note = chr11:27743897-27744147
  misc_feature 1..250: note = hyper
  source 1..250: mol_type = genomic DNA
gtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgc

SEQ ID NO: 20994 - DNA, 55 bp, Homo sapiens
  misc_feature 1..55: note = chr11:27744656-27744711
  misc_feature 1..55: note = hyper
  source 1..55: mol_type = genomic DNA
tgttatggagatgtccgtcgctctgaggagcgctagtgccctgggaagtccccag

SEQ ID NO: 20995 - skipped

SEQ ID NO: 20996 - DNA, 195 bp, Homo sapiens; identical to SEQ ID NO: 10775
  misc_feature 1..195: note = chr11:30038294-30038489
  misc_feature 1..195: note = hyper
  source 1..195: mol_type = genomic DNA

SEQ ID NO: 20997 - DNA, 37 bp, Homo sapiens; identical to SEQ ID NO: 10776
  misc_feature 1..37: note = chr11:30038919-30038956
  misc_feature 1..37: note = hyper
  source 1..37: mol_type = genomic DNA

SEQ ID NO: 20998 - DNA, 71 bp, Homo sapiens; identical to SEQ ID NO: 10777
  misc_feature 1..71: note = chr11:30040131-30040202
  misc_feature 1..71: note = hyper
  source 1..71: mol_type = genomic DNA

SEQ ID NO: 20999 - DNA, 34 bp, Homo sapiens; identical to SEQ ID NO: 10778
  misc_feature 1..34: note = chr11:30605841-30605875
  misc_feature 1..34: note = hyper
  source 1..34: mol_type = genomic DNA

SEQ ID NO: 21000 - DNA, 30 bp, Homo sapiens; identical to SEQ ID NO: 10781
  misc_feature 1..30: note = chr11:30606351-30606381
  misc_feature 1..30: note = hyper
  source 1..30: mol_type = genomic DNA

SEQ ID NO: 21001 - DNA, 15 bp, Homo sapiens
  misc_feature 1..15: note = chr11:30606740-30606755
  misc_feature 1..15: note = hyper
  source 1..15: mol_type = genomic DNA
tgtagagaagaaatc

SEQ ID NO: 21002 - DNA, 223 bp, Homo sapiens
  misc_feature 1..223: note = chr11:30606864-30607087
  misc_feature 1..223: note = hyper
  source 1..223: mol_type = genomic DNA
cggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatc

SEQ ID NO: 21003 - DNA, 321 bp, Homo sapiens
  misc_feature 1..321: note = chr11:30607409-30607730
  misc_feature 1..321: note = hyper
  source 1..321: mol_type = genomic DNA
ccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttc

SEQ ID NO: 21004 - DNA, 212 bp, Homo sapiens
  misc_feature 1..212: note = chr11:31819833-31820045
  misc_feature 1..212: note = hyper
  source 1..212: mol_type = genomic DNA
ggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaa

SEQ ID NO: 21005 - DNA, 30 bp, Homo sapiens; identical to SEQ ID NO: 10790
  misc_feature 1..30: note = chr11:31822002-31822032
  misc_feature 1..30: note = hyper
  source 1..30: mol_type = genomic DNA

SEQ ID NO: 21006 - DNA, 221 bp, Homo sapiens; identical to SEQ ID NO: 10791
  misc_feature 1..221: note = chr11:31822487-31822708
  misc_feature 1..221: note = hyper
  source 1..221: mol_type = genomic DNA

SEQ ID NO: 21007 - DNA, 54 bp, Homo sapiens
  misc_feature 1..54: note = chr11:31824246-31824300
  misc_feature 1..54: note = hyper
  source 1..54: mol_type = genomic DNA
atcacctgcagaattcgggaaatgtcgcacggccgggccccgctgtgagctagc

SEQ ID NO: 21008 - DNA, 209 bp, Homo sapiens
  misc_feature 1..209: note = chr11:31824355-31824564
  misc_feature 1..209: note = hyper
  source 1..209: mol_type = genomic DNA
caccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgcc

SEQ ID NO: 21009 - DNA, 284 bp, Homo sapiens
  misc_feature 1..284: note = chr11:31824680-31824964
  misc_feature 1..284: note = hyper
  source 1..284: mol_type = genomic DNA
tgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgct

SEQ ID NO: 21010 - DNA, 26 bp, Homo sapiens
  misc_feature 1..26: note = chr11:31827204-31827230
  misc_feature 1..26: note = hyper
  source 1..26: mol_type = genomic DNA
gtgggaccccacggggtctgggcaga

SEQ ID NO: 21011 - DNA, 329 bp, Homo sapiens; identical to SEQ ID NO: 10798
  misc_feature 1..329: note = chr11:31829116-31829445
  misc_feature 1..329: note = hyper
  source 1..329: mol_type = genomic DNA

SEQ ID NO: 21012 - DNA, 56 bp, Homo sapiens; identical to SEQ ID NO: 10799
  misc_feature 1..56: note = chr11:31830319-31830375
  misc_feature 1..56: note = hyper
  source 1..56: mol_type = genomic DNA

SEQ ID NO: 21013 - DNA, 75 bp, Homo sapiens; identical to SEQ ID NO: 10800
  misc_feature 1..75: note = chr11:31831502-31831577
  misc_feature 1..75: note = hyper
  source 1..75: mol_type = genomic DNA

SEQ ID NO: 21014 - DNA, 50 bp, Homo sapiens; identical to SEQ ID NO: 10801
  misc_feature 1..50: note = chr11:31832795-31832845
  misc_feature 1..50: note = hyper
  source 1..50: mol_type = genomic DNA

SEQ ID NO: 21015 - DNA, 49 bp, Homo sapiens; identical to SEQ ID NO: 10802
  misc_feature 1..49: note = chr11:31833553-31833602
  misc_feature 1..49: note = hyper
  source 1..49: mol_type = genomic DNA

SEQ ID NO: 21016 - DNA, 149 bp, Homo sapiens; identical to SEQ ID NO: 10803
  misc_feature 1..149: note = chr11:31834086-31834235
  misc_feature 1..149: note = hyper
  source 1..149: mol_type = genomic DNA

SEQ ID NO: 21017 - DNA, 30 bp, Homo sapiens; identical to SEQ ID NO: 10804
  misc_feature 1..30: note = chr11:31835312-31835342
  misc_feature 1..30: note = hyper
  source 1..30: mol_type = genomic DNA

SEQ ID NO: 21018 - DNA, 116 bp, Homo sapiens
  misc_feature 1..116: note = chr11:31835591-31835707
  misc_feature 1..116: note = hyper
  source 1..116: mol_type = genomic DNA
tgctgccctccaagacgcgggggggcggcggggattgcgctttaggttctgtctcctttccccgcctccccacaggcccctgttcccccctaccctccgccccctgtggccagagg

SEQ ID NO: 21019 - DNA, 14 bp, Homo sapiens
  misc_feature 1..14: note = chr11:31835797-31835811
  misc_feature 1..14: note = hyper
  source 1..14: mol_type = genomic DNA
gctgggggaccgtg

SEQ ID NO: 21020 - DNA, 14 bp, Homo sapiens
  misc_feature 1..14: note = chr11:31836032-31836046
  misc_feature 1..14: note = hyper
  source 1..14: mol_type = genomic DNA
aactctctctttcc

SEQ ID NO: 21021 - DNA, 256 bp, Homo sapiens
  misc_feature 1..256: note = chr11:31839051-31839307
  misc_feature 1..256: note = hyper
  source 1..256: mol_type = genomic DNA
gacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggag

SEQ ID NO: 21022 - DNA, 93 bp, Homo sapiens
  misc_feature 1..93: note = chr11:31840080-31840173
  misc_feature 1..93: note = hyper
  source 1..93: mol_type = genomic DNA
ggcctaggccaaaggtctctccaggcctgctgggttctcaagagggaagccctaaagggggcctacccgggcttccctcgccctctggctgaa

SEQ ID NO: 21023 - DNA, 46 bp, Homo sapiens
  misc_feature 1..46: note = chr11:31847925-31847971
  misc_feature 1..46: note = hyper
  source 1..46: mol_type = genomic DNA
acagaccccgagcccctctctgcgcaactaccgcctctaaaaaaaa

SEQ ID NO: 21024 - DNA, 117 bp, Homo sapiens
  misc_feature 1..117: note = chr11:31848355-31848472
  misc_feature 1..117: note = hyper
  source 1..117: mol_type = genomic DNA
cctgagtgactggggcgcacatgacccccctcctggggcctttgggctcaacccttacttttaacttgttctaacaggaataatggagtagtactactaatgcatggtcagaagggg

SEQ ID NO: 21025 - DNA, 214 bp, Homo sapiens
  misc_feature 1..214: note = chr11:32458175-32458389
  misc_feature 1..214: note = hyper
  source 1..214: mol_type = genomic DNA
atctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgt

SEQ ID NO: 21026 - DNA, 25 bp, Homo sapiens
  misc_feature 1..25: note = chr11:32460864-32460889
  misc_feature 1..25: note = hyper
  source 1..25: mol_type = genomic DNA
gagccccacgcgcaagacagcccaa

SEQ ID NO: 21027 - DNA, 118 bp, Homo sapiens
  misc_feature 1..118: note = chr11:33890334-33890452
  misc_feature 1..118: note = hyper
  source 1..118: mol_type = genomic DNA
ccctggaggcccagagccagctccgaggtggacggtcggacccctcacccgcccgttatccgcaaggctggcagcggctccacctgcggaccgggaaggcggccgttggggaccccgg

SEQ ID NO: 21028 - DNA, 91 bp, Homo sapiens; identical to SEQ ID NO: 10831
  misc_feature 1..91: note = chr11:35440574-35440665
  misc_feature 1..91: note = hyper
  source 1..91: mol_type = genomic DNA

SEQ ID NO: 21029 - DNA, 146 bp, Homo sapiens; identical to SEQ ID NO: 10832
  misc_feature 1..146: note = chr11:35441295-35441441
  misc_feature 1..146: note = hyper
  source 1..146: mol_type = genomic DNA

SEQ ID NO: 21030 - DNA, 549 bp, Homo sapiens; identical to SEQ ID NO: 10833
  misc_feature 1..549: note = chr11:35641053-35641602
  misc_feature 1..549: note = hyper
  source 1..549: mol_type = genomic DNA

SEQ ID NO: 21031 - DNA, 52 bp, Homo sapiens; identical to SEQ ID NO: 10834
  misc_feature 1..52: note = chr11:36399257-36399309
  misc_feature 1..52: note = hyper
  source 1..52: mol_type = genomic DNA

SEQ ID NO: 21032 - DNA, 44 bp, Homo sapiens; identical to SEQ ID NO: 10835
  misc_feature 1..44: note = chr11:40314716-40314760
  misc_feature 1..44: note = hyper
  source 1..44: mol_type = genomic DNA

SEQ ID NO: 21033 - DNA, 93 bp, Homo sapiens; identical to SEQ ID NO: 10836
  misc_feature 1..93: note = chr11:40315465-40315558
  misc_feature 1..93: note = hyper
  source 1..93: mol_type = genomic DNA

SEQ ID NO: 21034 - DNA, 62 bp, Homo sapiens; identical to SEQ ID NO: 10837
  misc_feature 1..62: note = chr11:43569013-43569075
  misc_feature 1..62: note = hyper
  source 1..62: mol_type = genomic DNA

SEQ ID NO: 21035 - DNA, 110 bp, Homo sapiens; identical to SEQ ID NO: 10838
  misc_feature 1..110: note = chr11:43569128-43569238
  misc_feature 1..110: note = hyper
  source 1..110: mol_type = genomic DNA

SEQ ID NO: 21036 - DNA, 24 bp, Homo sapiens
  misc_feature 1..24: note = chr11:43596489-43596513
  misc_feature 1..24: note = hyper
  source 1..24: mol_type = genomic DNA
ggtgagtttcctcttcgggtggag

SEQ ID NO: 21037 - DNA, 30 bp, Homo sapiens; identical to SEQ ID NO: 10840
  misc_feature 1..30: note = chr11:43599075-43599105
  misc_feature 1..30: note = hyper
  source 1..30: mol_type = genomic DNA

SEQ ID NO: 21038 - DNA, 246 bp, Homo sapiens
  misc_feature 1..246: note = chr11:43600557-43600803
  misc_feature 1..246: note = hyper
  source 1..246: mol_type = genomic DNA
cacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctc

SEQ ID NO: 21039 - DNA, 82 bp, Homo sapiens
  misc_feature 1..82: note = chr11:43601012-43601094
  misc_feature 1..82: note = hyper
  source 1..82: mol_type = genomic DNA
cagctggctgcagtgcggacgggaccggcgcgctcccgtggcccccagaccgaggtaaggagcagggagtcggcgcccgggt

SEQ ID NO: 21040 - DNA, 75 bp, Homo sapiens
  misc_feature 1..75: note = chr11:43602393-43602468
  misc_feature 1..75: note = hyper
  source 1..75: mol_type = genomic DNA
ctgattggtgggtgacgattttagtccgcaccaatgagctggcggcctcgtctgtatttatttagtgctctgggg

SEQ ID NO: 21041 - DNA, 40 bp, Homo sapiens; identical to SEQ ID NO: 3747
  misc_feature 1..40: note = chr11:43603446-43603486
  misc_feature 1..40: note = hyper
  source 1..40: mol_type = genomic DNA

SEQ ID NO: 21042 - DNA, 31 bp, Homo sapiens; identical to SEQ ID NO: 10848
  misc_feature 1..31: note = chr11:43963534-43963565
  misc_feature 1..31: note = hyper
  source 1..31: mol_type = genomic DNA

SEQ ID NO: 21043 - DNA, 30 bp, Homo sapiens; identical to SEQ ID NO: 10849
  misc_feature 1..30: note = chr11:43963625-43963655
  misc_feature 1..30: note = hyper
  source 1..30: mol_type = genomic DNA

SEQ ID NO: 21044 - DNA, 198 bp, Homo sapiens; identical to SEQ ID NO: 10850
  misc_feature 1..198: note = chr11:43964453-43964651
  misc_feature 1..198: note = hyper
  source 1..198: mol_type = genomic DNA

SEQ ID NO: 21045 - DNA, 357 bp, Homo sapiens; identical to SEQ ID NO: 10851
  misc_feature 1..357: note = chr11:43964895-43965252
  misc_feature 1..357: note = hyper
  source 1..357: mol_type = genomic DNA

SEQ ID NO: 21046 - DNA, 162 bp, Homo sapiens; identical to SEQ ID NO: 10852
  misc_feature 1..162: note = chr11:43965899-43966061
  misc_feature 1..162: note = hyper
  source 1..162: mol_type = genomic DNA

SEQ ID NO: 21047 - DNA, 30 bp, Homo sapiens; identical to SEQ ID NO: 10856
  misc_feature 1..30: note = chr11:44332542-44332572
  misc_feature 1..30: note = hyper
  source 1..30: mol_type = genomic DNA

SEQ ID NO: 21048 - DNA, 122 bp, Homo sapiens; identical to SEQ ID NO: 10857
  misc_feature 1..122: note = chr11:44332922-44333044
  misc_feature 1..122: note = hyper
  source 1..122: mol_type = genomic DNA

SEQ ID NO: 21049 - DNA, 194 bp, Homo sapiens; identical to SEQ ID NO: 3752
  misc_feature 1..194: note = chr11:45376858-45377052
  misc_feature 1..194: note = hyper
  source 1..194: mol_type = genomic DNA

SEQ ID NO: 21050 - DNA, 88 bp, Homo sapiens; identical to SEQ ID NO: 10862
  misc_feature 1..88: note = chr11:46259327-46259415
  misc_feature 1..88: note = hyper
  source 1..88: mol_type = genomic DNA

SEQ ID NO: 21051 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 21052 - DNA, 17 bp, Homo sapiens
  misc_feature 1..17: note = chr11:46317680-46317697
  misc_feature 1..17: note = hyper
  source 1..17: mol_type = genomic DNA
gccgaccccttgctctt

SEQ ID NO: 21053 - DNA, 137 bp, Homo sapiens; identical to SEQ ID NO: 10866
  misc_feature 1..137: note = chr11:46414563-46414700
  misc_feature 1..137: note = hyper
  source 1..137: mol_type = genomic DNA

SEQ ID NO: 21054 - DNA, 364 bp, Homo sapiens
  misc_feature 1..364: note = chr11:47208680-47209044
  misc_feature 1..364: note = hyper
  source 1..364: mol_type = genomic DNA
ttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagagga

SEQ ID NO: 21055 - DNA, 68 bp, Homo sapiens
  misc_feature 1..68: note = chr11:47209189-47209257
  misc_feature 1..68: note = hyper
  source 1..68: mol_type = genomic DNA
tagcaaaattatgttgtttctaaatccaggaggaatcactgacgcgttctttacgcagatgaatccgc

SEQ ID NO: 21056 - DNA, 64 bp, Homo sapiens; identical to SEQ ID NO: 10868
  misc_feature 1..64: note = chr11:47615772-47615836
  misc_feature 1..64: note = hyper
  source 1..64: mol_type = genomic DNA

SEQ ID NO: 21057 - DNA, 177 bp, Homo sapiens
  misc_feature 1..177: note = chr11:57194178-57194355
  misc_feature 1..177: note = hyper
  source 1..177: mol_type = genomic DNA
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgca

SEQ ID NO: 21058 - DNA, 30 bp, Homo sapiens; identical to SEQ ID NO: 10870
  misc_feature 1..30: note = chr11:58668429-58668459
  misc_feature 1..30: note = hyper
  source 1..30: mol_type = genomic DNA

SEQ ID NO: 21059 - DNA, 29 bp, Homo sapiens
  misc_feature 1..29: note = chr11:58672717-58672746
  misc_feature 1..29: note = hyper
  source 1..29: mol_type = genomic DNA
aagttggatcatttgcggagcaggccaag

SEQ ID NO: 21060 - DNA, 103 bp, Homo sapiens
  misc_feature 1..103: note = chr11:58673064-58673167
  misc_feature 1..103: note = hyper
  source 1..103: mol_type = genomic DNA
gcttccactgggagacaggggacgccgatgagcaggaagaagcagggcagtgactgcttagtttatcctggtacgcgggaactggctgtggaccgagtggttc

SEQ ID NO: 21061 - DNA, 80 bp, Homo sapiens; identical to SEQ ID NO: 3759
  misc_feature 1..80: note = chr11:58673168-58673248
  misc_feature 1..80: note = hyper
  source 1..80: mol_type = genomic DNA

SEQ ID NO: 21062 - DNA, 34 bp, Homo sapiens
  misc_feature 1..34: note = chr11:59333371-59333405
  misc_feature 1..34: note = hyper
  source 1..34: mol_type = genomic DNA
agcccgtgcgccgaacgctttcgaggacttcttt

SEQ ID NO: 21063 - DNA, 20 bp, Homo sapiens
  misc_feature 1..20: note = chr11:61063138-61063158
  misc_feature 1..20: note = hyper
  source 1..20: mol_type = genomic DNA
ccaaccgctccctggcctgg

SEQ ID NO: 21064 - DNA, 38 bp, Homo sapiens; identical to SEQ ID NO: 10878
  misc_feature 1..38: note = chr11:61276466-61276504
  misc_feature 1..38: note = hyper
  source 1..38: mol_type = genomic DNA

SEQ ID NO: 21065 - DNA, 230 bp, Homo sapiens
  misc_feature 1..230: note = chr11:61276772-61277002
  misc_feature 1..230: note = hyper
  source 1..230: mol_type = genomic DNA
gctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgc

SEQ ID NO: 21066 - DNA, 15 bp, Homo sapiens
  misc_feature 1..15: note = chr11:61277327-61277342
  misc_feature 1..15: note = hyper
  source 1..15: mol_type = genomic DNA
cgctccaggactggg

SEQ ID NO: 21067 - DNA, 51 bp, Homo sapiens; identical to SEQ ID NO: 10881
  misc_feature 1..51: note = chr11:61335193-61335244
  misc_feature 1..51: note = hyper
  source 1..51: mol_type = genomic DNA

SEQ ID NO: 21068 - DNA, 37 bp, Homo sapiens
  misc_feature 1..37: note = chr11:61595049-61595086
  misc_feature 1..37: note = hyper
  source 1..37: mol_type = genomic DNA
cgcgccaaggaagggcgtcacctagccaagccggccc

SEQ ID NO: 21069 - DNA, 61 bp, Homo sapiens
  misc_feature 1..61: note = chr11:61595262-61595323
  misc_feature 1..61: note = hyper
  source 1..61: mol_type = genomic DNA
gatctcctccggcgcccggggccggagagtgggggagggaggaggtcggacacgtagcctg

SEQ ID NO: 21070 - DNA, 300 bp, Homo sapiens
  misc_feature 1..300: note = chr11:61596120-61596420
  misc_feature 1..300: note = hyper
  source 1..300: mol_type = genomic DNA
ggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacgg

SEQ ID NO: 21071 - DNA, 158 bp, Homo sapiens; identical to SEQ ID NO: 10884
  misc_feature 1..158: note = chr11:64059919-64060077
  misc_feature 1..158: note = hyper
  source 1..158: mol_type = genomic DNA

SEQ ID NO: 21072 - DNA, 72 bp, Homo sapiens; identical to SEQ ID NO: 10885
  misc_feature 1..72: note = chr11:64066962-64067034
  misc_feature 1..72: note = hyper
  source 1..72: mol_type = genomic DNA

SEQ ID NO: 21073 - DNA, 123 bp, Homo sapiens; identical to SEQ ID NO: 10886
  misc_feature 1..123: note = chr11:64409956-64410079
  misc_feature 1..123: note = hyper
  source 1..123: mol_type = genomic DNA

SEQ ID NO: 21074 - DNA, 59 bp, Homo sapiens; identical to SEQ ID NO: 10887
  misc_feature 1..59: note = chr11:64410347-64410406
  misc_feature 1..59: note = hyper
  source 1..59: mol_type = genomic DNA

SEQ ID NO: 21075 - DNA, 108 bp, Homo sapiens; identical to SEQ ID NO: 10888
  misc_feature 1..108: note = chr11:64478789-64478897
  misc_feature 1..108: note = hyper
  source 1..108: mol_type = genomic DNA

SEQ ID NO: 21076 - DNA, 58 bp, Homo sapiens; identical to SEQ ID NO: 10889
  misc_feature 1..58: note = chr11:64480273-64480331
  misc_feature 1..58: note = hyper
  source 1..58: mol_type = genomic DNA

SEQ ID NO: 21077 - DNA, 50 bp, Homo sapiens
  misc_feature 1..50: note = chr11:64480379-64480429
  misc_feature 1..50: note = hyper
  source 1..50: mol_type = genomic DNA
cgaagcgccccaggccctcacccccgcgcccaggcaccgggcggccgctc

SEQ ID NO: 21078 - DNA, 231 bp, Homo sapiens
  misc_feature 1..231: note = chr11:64480593-64480824
  misc_feature 1..231: note = hyper
  source 1..231: mol_type = genomic DNA
cccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagc

SEQ ID NO: 21079 - DNA, 158 bp, Homo sapiens
  misc_feature 1..158: note = chr11:64481042-64481200
  misc_feature 1..158: note = hyper
  source 1..158: mol_type = genomic DNA
gcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcc

SEQ ID NO: 21080 - DNA, 328 bp, Homo sapiens; identical to SEQ ID NO: 10891
  misc_feature 1..328: note = chr11:64512954-64513282
  misc_feature 1..328: note = hyper
  source 1..328: mol_type = genomic DNA

SEQ ID NO: 21081 - DNA, 13 bp, Homo sapiens
  misc_feature 1..13: note = chr11:64739455-64739468
  misc_feature 1..13: note = hyper
  source 1..13: mol_type = genomic DNA
gctctctgaaaaa

SEQ ID NO: 21082 - DNA, 32 bp, Homo sapiens; identical to SEQ ID NO: 10893
  misc_feature 1..32: note = chr11:64739698-64739730
  misc_feature 1..32: note = hyper
  source 1..32: mol_type = genomic DNA

SEQ ID NO: 21083 - DNA, 30 bp, Homo sapiens; identical to SEQ ID NO: 10894
  misc_feature 1..30: note = chr11:65185213-65185243
  misc_feature 1..30: note = hyper
  source 1..30: mol_type = genomic DNA

SEQ ID NO: 21084 - DNA, 30 bp, Homo sapiens; identical to SEQ ID NO: 10895
  misc_feature 1..30: note = chr11:65185467-65185497
  misc_feature 1..30: note = hyper
  source 1..30: mol_type = genomic DNA

SEQ ID NO: 21085 - DNA, 17 bp, Homo sapiens
  misc_feature 1..17: note = chr11:65601640-65601657
  misc_feature 1..17: note = hyper
  source 1..17: mol_type = genomic DNA
tgcggtggtgtgtgtgt

SEQ ID NO: 21086 - DNA, 20 bp, Homo sapiens
  misc_feature 1..20: note = chr11:66188095-66188115
  misc_feature 1..20: note = hyper
  source 1..20: mol_type = genomic DNA
aattagtgtcagtgccggcc

SEQ ID NO: 21087 - DNA, 25 bp, Homo sapiens
  misc_feature 1..25: note = chr11:66188145-66188170
  misc_feature 1..25: note = hyper
  source 1..25: mol_type = genomic DNA
ggcttcaggccgccctaaacctggc

SEQ ID NO: 21088 - DNA, 98 bp, Homo sapiens
  misc_feature 1..98: note = chr11:66188375-66188473
  misc_feature 1..98: note = hyper
  source 1..98: mol_type = genomic DNA
cccctccccagtcagcggctcccgctgcagcttgcttagcccagcctcccgctctcccgcccccccggctctaaaacgagccccccacgcctggcagg

SEQ ID NO: 21089 - DNA, 135 bp, Homo sapiens
  misc_feature 1..135: note = chr11:66188974-66189109
  misc_feature 1..135: note = hyper
  source 1..135: mol_type = genomic DNA
ttcctcctgagctccctccagacctcaccttagttctgaatgagagttagagagcctggacggtgtccctaacaccagattatgagaggataagagccaggacagagcggcctcggtgcccgccagtgcagaagc

SEQ ID NO: 21090 - DNA, 66 bp, Homo sapiens; identical to SEQ ID NO: 10903
  misc_feature 1..66: note = chr11:67479192-67479258
  misc_feature 1..66: note = hyper
  source 1..66: mol_type = genomic DNA

SEQ ID NO: 21091 - DNA, 74 bp, Homo sapiens; identical to SEQ ID NO: 10904
  misc_feature 1..74: note = chr11:67895805-67895879
  misc_feature 1..74: note = hyper
  source 1..74: mol_type = genomic DNA

SEQ ID NO: 21092 - DNA, 30 bp, Homo sapiens; identical to SEQ ID NO: 10905
  misc_feature 1..30: note = chr11:69452211-69452241
  misc_feature 1..30: note = hyper
  source 1..30: mol_type = genomic DNA

SEQ ID NO: 21093 - DNA, 240 bp, Homo sapiens
  misc_feature 1..240: note = chr11:69517174-69517414
  misc_feature 1..240: note = hyper
  source 1..240: mol_type = genomic DNA
tccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacagg

SEQ ID NO: 21094 - DNA, 240 bp, Homo sapiens
  misc_feature 1..240: note = chr11:69518290-69518530
  misc_feature 1..240: note = hyper
  source 1..240: mol_type = genomic DNA
aggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgcc

SEQ ID NO: 21095 - DNA, 30 bp, Homo sapiens; identical to SEQ ID NO: 10908
  misc_feature 1..30: note = chr11:69519421-69519451
  misc_feature 1..30: note = hyper
  source 1..30: mol_type = genomic DNA

SEQ ID NO: 21096 - DNA, 26 bp, Homo sapiens
  misc_feature 1..26: note = chr11:69588904-69588930
  misc_feature 1..26: note = hyper
  source 1..26: mol_type = genomic DNA
gggcgcaggtcattgcggggcaggtg

SEQ ID NO: 21097 - DNA, 100 bp, Homo sapiens; identical to SEQ ID NO: 10910
  misc_feature 1..100: note = chr11:69589407-69589507
  misc_feature 1..100: note = hyper
  source 1..100: mol_type = genomic DNA

SEQ ID NO: 21098 - DNA, 259 bp, Homo sapiens
  misc_feature 1..259: note = chr11:69589854-69590113
  misc_feature 1..259: note = hyper
  source 1..259: mol_type = genomic DNA
cggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 21099 - DNA, 35 bp, Homo sapiens
  misc_feature 1..35: note = chr11:69590114-69590149
  misc_feature 1..35: note = hyper
  source 1..35: mol_type = genomic DNA
cccgaggccgagccgctatatatatagcccggcgc

SEQ ID NO: 21100 - DNA, 245 bp, Homo sapiens
  misc_feature 1..245: note = chr11:69590222-69590467
  misc_feature 1..245: note = hyper
  source 1..245: mol_type = genomic DNA
ggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagcc

SEQ ID NO: 21101 - DNA, 53 bp, Homo sapiens
  misc_feature 1..53: note = chr11:71318279-71318332
  misc_feature 1..53: note = hyper
  source 1..53: mol_type = genomic DNA
ggggaaggtgcggggcgaggcggccgcggctccctggcatccctctccttacc

SEQ ID NO: 21102 - DNA, 51 bp, Homo sapiens
  misc_feature 1..51: note = chr11:71318967-71319018
  misc_feature 1..51: note = hyper
  source 1..51: mol_type = genomic DNA
cagctctcggcggcggacccgggccgcgtgtgagcgcgctttgcacctcct

SEQ ID NO: 21103 - DNA, 56 bp, Homo sapiens
  misc_feature 1..56: note = chr11:71951583-71951639
  misc_feature 1..56: note = hyper
  source 1..56: mol_type = genomic DNA
ggagtgttccagggccgtggagagcagtttagggcgccagtaaaccttttgtctag

SEQ ID NO: 21104 - DNA, 19 bp, Homo sapiens
  misc_feature 1..19: note = chr11:71954593-71954612
  misc_feature 1..19: note = hyper
  source 1..19: mol_type = genomic DNA
ttgacctgaagggcacgag

SEQ ID NO: 21105 - DNA, 129 bp, Homo sapiens
  misc_feature 1..129: note = chr11:71955215-71955344
  misc_feature 1..129: note = hyper
  source 1..129: mol_type = genomic DNA
caagtgcagccagcccggcccgcgcgccttttaacgcgcaggaccccgcggaggggggcggggcggggcgagctccgaaggggcggggcctaggaggcccagacaccgcccaaagccgccccgaccccc

SEQ ID NO: 21106 - skipped

SEQ ID NO: 21107 - DNA, 37 bp, Homo sapiens
  misc_feature 1..37: note = chr11:71956340-71956377
  misc_feature 1..37: note = hyper
  source 1..37: mol_type = genomic DNA
agggcccgcctgcctctccccccgttccctcagctcc

SEQ ID NO: 21108 - DNA, 157 bp, Homo sapiens
  misc_feature 1..157: note = chr11:72432916-72433073
  misc_feature 1..157: note = hyper
  source 1..157: mol_type = genomic DNA
ggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggt

SEQ ID NO: 21109 - DNA, 37 bp, Homo sapiens
  misc_feature 1..37: note = chr11:74394454-74394491
  misc_feature 1..37: note = hyper
  source 1..37: mol_type = genomic DNA
ggctgggcacccccacgccgcccgggcactgctcgcg

SEQ ID NO: 21110 - DNA, 30 bp, Homo sapiens; identical to SEQ ID NO: 10922
  misc_feature 1..30: note = chr11:74441845-74441875
  misc_feature 1..30: note = hyper
  source 1..30: mol_type = genomic DNA

SEQ ID NO: 21111 - DNA, 388 bp, Homo sapiens; identical to SEQ ID NO: 10923
  misc_feature 1..388: note = chr11:74442255-74442643
  misc_feature 1..388: note = hyper
  source 1..388: mol_type = genomic DNA

SEQ ID NO: 21112 - DNA, 49 bp, Homo sapiens; identical to SEQ ID NO: 10924
  misc_feature 1..49: note = chr11:74442705-74442754
  misc_feature 1..49: note = hyper
  source 1..49: mol_type = genomic DNA

SEQ ID NO: 21113 - DNA, 33 bp, Homo sapiens; identical to SEQ ID NO: 10925
  misc_feature 1..33: note = chr11:74952180-74952213
  misc_feature 1..33: note = hyper
  source 1..33: mol_type = genomic DNA

SEQ ID NO: 21114 - skipped

SEQ ID NO: 21115 - DNA, 198 bp, Homo sapiens; identical to SEQ ID NO: 10927
  misc_feature 1..198: note = chr11:75141367-75141565
  misc_feature 1..198: note = hyper
  source 1..198: mol_type = genomic DNA

SEQ ID NO: 21116 - DNA, 553 bp, Homo sapiens; identical to SEQ ID NO: 10928
  misc_feature 1..553: note = chr11:75378696-75379249
  misc_feature 1..553: note = hyper
  source 1..553: mol_type = genomic DNA

SEQ ID NO: 21117 - DNA, 178 bp, Homo sapiens
  misc_feature 1..178: note = chr11:75379895-75380073
  misc_feature 1..178: note = hyper
  source 1..178: mol_type = genomic DNA
gctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgc

SEQ ID NO: 21118 - DNA, 138 bp, Homo sapiens; identical to SEQ ID NO: 10930
  misc_feature 1..138: note = chr11:75863325-75863463
  misc_feature 1..138: note = hyper
  source 1..138: mol_type = genomic DNA

SEQ ID NO: 21119 - DNA, 156 bp, Homo sapiens; identical to SEQ ID NO: 10931
  misc_feature 1..156: note = chr11:76032912-76033068
  misc_feature 1..156: note = hyper
  source 1..156: mol_type = genomic DNA

SEQ ID NO: 21120 - DNA, 30 bp, Homo sapiens; identical to SEQ ID NO: 10932
  misc_feature 1..30: note = chr11:76382193-76382223
  misc_feature 1..30: note = hyper
  source 1..30: mol_type = genomic DNA

SEQ ID NO: 21121 - DNA, 26 bp, Homo sapiens
  misc_feature 1..26: note = chr11:78672891-78672917
  misc_feature 1..26: note = hyper
  source 1..26: mol_type = genomic DNA
ctgatgtttccttctcgtgatgtctg

SEQ ID NO: 21122 - DNA, 103 bp, Homo sapiens
  misc_feature 1..103: note = chr11:78672964-78673067
  misc_feature 1..103: note = hyper
  source 1..103: mol_type = genomic DNA
gggttggggacagaagcagccctccaactcttgcacactccagcggcgccgcggggcaagagcggggctgcctgagcccgcggagccacgtcaggcccccagc

SEQ ID NO: 21123 - DNA, 30 bp, Homo sapiens; identical to SEQ ID NO: 10934
  misc_feature 1..30: note = chr11:78673274-78673304
  misc_feature 1..30: note = hyper
  source 1..30: mol_type = genomic DNA

SEQ ID NO: 21124 - DNA, 142 bp, Homo sapiens; identical to SEQ ID NO: 10935
  misc_feature 1..142: note = chr11:79148873-79149015
  misc_feature 1..142: note = hyper
  source 1..142: mol_type = genomic DNA

SEQ ID NO: 21125 - DNA, 30 bp, Homo sapiens; identical to SEQ ID NO: 10936
  misc_feature 1..30: note = chr11:79149278-79149308
  misc_feature 1..30: note = hyper
  source 1..30: mol_type = genomic DNA

SEQ ID NO: 21126 - DNA, 42 bp, Homo sapiens; identical to SEQ ID NO: 10937
  misc_feature 1..42: note = chr11:79149528-79149570
  misc_feature 1..42: note = hyper
  source 1..42: mol_type = genomic DNA

SEQ ID NO: 21127 - DNA, 61 bp, Homo sapiens; identical to SEQ ID NO: 10938
  misc_feature 1..61: note = chr11:79150941-79151002
  misc_feature 1..61: note = hyper
  source 1..61: mol_type = genomic DNA

SEQ ID NO: 21128 - DNA, 137 bp, Homo sapiens; identical to SEQ ID NO: 10939
  misc_feature 1..137: note = chr11:79152080-79152217
  misc_feature 1..137: note = hyper
  source 1..137: mol_type = genomic DNA

SEQ ID NO: 21129 - DNA, 20 bp, Homo sapiens
  misc_feature 1..20: note = chr11:82443549-82443569
  misc_feature 1..20: note = hyper
  source 1..20: mol_type = genomic DNA
aaaggctggaataggcggtg

SEQ ID NO: 21130 - DNA, 69 bp, Homo sapiens; identical to SEQ ID NO: 10941
  misc_feature 1..69: note = chr11:82443651-82443720
  misc_feature 1..69: note = hyper
  source 1..69: mol_type = genomic DNA

SEQ ID NO: 21131 - DNA, 32 bp, Homo sapiens; identical to SEQ ID NO: 10942
  misc_feature 1..32: note = chr11:82444153-82444185
  misc_feature 1..32: note = hyper
  source 1..32: mol_type = genomic DNA

SEQ ID NO: 21132 - DNA, 83 bp, Homo sapiens
  misc_feature 1..83: note = chr11:82445101-82445184
  misc_feature 1..83: note = hyper
  source 1..83: mol_type = genomic DNA
gactcctctaaccgcaaggggtgaggaagagatggctggtctcaaactccagttcaggcccatgaggccgctgcagcgcttga

SEQ ID NO: 21133 - DNA, 79 bp, Homo sapiens; identical to SEQ ID NO: 10944
  misc_feature 1..79: note = chr11:84431621-84431700
  misc_feature 1..79: note = hyper
  source 1..79: mol_type = genomic DNA

SEQ ID NO: 21134 - DNA, 30 bp, Homo sapiens; identical to SEQ ID NO: 10945
  misc_feature 1..30: note = chr11:84432138-84432168
  misc_feature 1..30: note = hyper
  source 1..30: mol_type = genomic DNA

SEQ ID NO: 21135 - DNA, 23 bp, Homo sapiens
  misc_feature 1..23: note = chr11:86085968-86085991
  misc_feature 1..23: note = hyper
  source 1..23: mol_type = genomic DNA
gagctgcccgagagccagagcag

SEQ ID NO: 21136 - DNA, 111 bp, Homo sapiens; identical to SEQ ID NO: 3779
  misc_feature 1..111: note = chr11:88798820-88798931
  misc_feature 1..111: note = hyper
  source 1..111: mol_type = genomic DNA

SEQ ID NO: 21137 - DNA, 117 bp, Homo sapiens
  misc_feature 1..117: note = chr11:88798965-88799082
  misc_feature 1..117: note = hyper
  source 1..117: mol_type = genomic DNA
cgcccccaggcagccgctcctcgagggcttcctgcgctctcgtagcggccttggctgcagctggagcgctagtgtcggcgatggaggcagcggtgacagcaggcagaacggctgcgg

SEQ ID NO: 21138 - DNA, 34 bp, Homo sapiens; identical to SEQ ID NO: 10953
  misc_feature 1..34: note = chr11:89224559-89224593
  misc_feature 1..34: note = hyper
  source 1..34: mol_type = genomic DNA

SEQ ID NO: 21139 - DNA, 185 bp, Homo sapiens
  misc_feature 1..185: note = chr11:91957315-91957500
  misc_feature 1..185: note = hyper
  source 1..185: mol_type = genomic DNA
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatat

SEQ ID NO: 21140 - DNA, 158 bp, Homo sapiens
  misc_feature 1..158: note = chr11:91957674-91957832
  misc_feature 1..158: note = hyper
  source 1..158: mol_type = genomic DNA
agagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccg

SEQ ID NO: 21141 - skipped

SEQ ID NO: 21142 - DNA, 30 bp, Homo sapiens; identical to SEQ ID NO: 10956
  misc_feature 1..30: note = chr11:91959509-91959539
  misc_feature 1..30: note = hyper
  source 1..30: mol_type = genomic DNA

SEQ ID NO: 21143 - DNA, 32 bp, Homo sapiens; identical to SEQ ID NO: 10957
  misc_feature 1..32: note = chr11:91960082-91960114
  misc_feature 1..32: note = hyper
  source 1..32: mol_type = genomic DNA

SEQ ID NO: 21144 - DNA, 80 bp, Homo sapiens; identical to SEQ ID NO: 10958
  misc_feature 1..80: note = chr11:91960369-91960449
  misc_feature 1..80: note = hyper
  source 1..80: mol_type = genomic DNA

SEQ ID NO: 21145 - DNA, 92 bp, Homo sapiens
  misc_feature 1..92: note = chr11:93063645-93063737
  misc_feature 1..92: note = hyper
  source 1..92: mol_type = genomic DNA
gaggcagccgaggagccgcacagggcagcgcctgccgccgccgccgcgcccatcccccactccgacggccacgagttcgggccgcgacgtcc

SEQ ID NO: 21146 - DNA, 19 bp, Homo sapiens
  misc_feature 1..19: note = chr11:94134067-94134086
  misc_feature 1..19: note = hyper
  source 1..19: mol_type = genomic DNA
caactgccaggttgacgat

SEQ ID NO: 21147 - skipped

SEQ ID NO: 21148 - DNA, 30 bp, Homo sapiens; identical to SEQ ID NO: 10966
  misc_feature 1..30: note = chr11:94474489-94474519
  misc_feature 1..30: note = hyper
  source 1..30: mol_type = genomic DNA

SEQ ID NO: 21149 - DNA, 521 bp, Homo sapiens; identical to SEQ ID NO: 10967
  misc_feature 1..521: note = chr11:94501445-94501966
  misc_feature 1..521: note = hyper
  source 1..521: mol_type = genomic DNA

SEQ ID NO: 21150 - DNA, 34 bp, Homo sapiens; identical to SEQ ID NO: 10968
  misc_feature 1..34: note = chr11:98891367-98891401
  misc_feature 1..34: note = hyper
  source 1..34: mol_type = genomic DNA

SEQ ID NO: 21151 - DNA, 295 bp, Homo sapiens
  misc_feature 1..295: note = chr11:100997981-100998276
  misc_feature 1..295: note = hyper
  source 1..295: mol_type = genomic DNA
gaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgg

SEQ ID NO: 21152 - DNA, 76 bp, Homo sapiens
  misc_feature 1..76: note = chr11:100998318-100998394
  misc_feature 1..76: note = hyper
  source 1..76: mol_type = genomic DNA
ggccgtcccgcgggagcaggcagccgctcgcgcccggcgccttgcagggcggcggcgcgaacgggccctgctgggg

SEQ ID NO: 21153 - DNA, 30 bp, Homo sapiens; identical to SEQ ID NO: 10971
  misc_feature 1..30: note = chr11:100999675-100999705
  misc_feature 1..30: note = hyper
  source 1..30: mol_type = genomic DNA

SEQ ID NO: 21154 - DNA, 90 bp, Homo sapiens
  misc_feature 1..90: note = chr11:101453090-101453180
  misc_feature 1..90: note = hyper
  source 1..90: mol_type = genomic DNA
tagagctgagaacctcgggaaaccgcttgcgggtggatgtgacaagtcaggaaacttgactacccaatcacccaaaggggcaatgggaca

SEQ ID NO: 21155 - DNA, 64 bp, Homo sapiens; identical to SEQ ID NO: 10973
  misc_feature 1..64: note = chr11:101454510-101454574
  misc_feature 1..64: note = hyper
  source 1..64: mol_type = genomic DNA

SEQ ID NO: 21156 - DNA, 35 bp, Homo sapiens; identical to SEQ ID NO: 10974
  misc_feature 1..35: note = chr11:101918471-101918506
  misc_feature 1..35: note = hyper
  source 1..35: mol_type = genomic DNA

SEQ ID NO: 21157 - DNA, 112 bp, Homo sapiens
  misc_feature 1..112: note = chr11:104034409-104034521
  misc_feature 1..112: note = hyper
  source 1..112: mol_type = genomic DNA
acaatgcattcagcccgagttcacattcaagattcaaaaagaaaggggaaaaacatagaaagaacaataacaatagcaaacatgatttttttttcagttaaaaaataaaatg

SEQ ID NO: 21158 - DNA, 222 bp, Homo sapiens
  misc_feature 1..222: note = chr11:104034996-104035218
  misc_feature 1..222: note = hyper
  source 1..222: mol_type = genomic DNA
cgttctccagccccggccgcggcccctgagaggcgcgcactcgggctcagagcggcggcgcgagcacctcagctccccagtttcccaggccgggcctaaacctgctctgccactgagcatgcccagtttaatcgccggccgggactcttcccaccgccctgggctttaccctcctggttggacctgtaagggctcaggaaacaaactcgccaggaggaagtg

SEQ ID NO: 21159 - DNA, 211 bp, Homo sapiens
  misc_feature 1..211: note = chr11:105481005-105481216
  misc_feature 1..211: note = hyper
  source 1..211: mol_type = genomic DNA
aaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcg

SEQ ID NO: 21160 - DNA, 25 bp, Homo sapiens
  misc_feature 1..25: note = chr11:106888283-106888308
  misc_feature 1..25: note = hyper
  source 1..25: mol_type = genomic DNA
tgtagtcccctcttccgccctagcc

SEQ ID NO: 21161 - DNA, 57 bp, Homo sapiens
  misc_feature 1..57: note = chr11:106888429-106888486
  misc_feature 1..57: note = hyper
  source 1..57: mol_type = genomic DNA
tccgcgttctctcccccgaaggcggtccccccttccgccccccgctcaccgagggcg

SEQ ID NO: 21162 - DNA, 23 bp, Homo sapiens
  misc_feature 1..23: note = chr11:106888801-106888824
  misc_feature 1..23: note = hyper
  source 1..23: mol_type = genomic DNA
ggccgaggcggtggcggcgagga

SEQ ID NO: 21163 - DNA, 15 bp, Homo sapiens
  misc_feature 1..15: note = chr11:106889400-106889415
  misc_feature 1..15: note = hyper
  source 1..15: mol_type = genomic DNA
cgttgctgtcctctg

SEQ ID NO: 21164 - DNA, 286 bp, Homo sapiens; identical to SEQ ID NO: 10984
  misc_feature 1..286: note = chr11:106889690-106889976
  misc_feature 1..286: note = hyper
  source 1..286: mol_type = genomic DNA

SEQ ID NO: 21165 - DNA, 287 bp, Homo sapiens
  misc_feature 1..287: note = chr11:107462128-107462415
  misc_feature 1..287: note = hyper
  source 1..287: mol_type = genomic DNA
agtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcg

SEQ ID NO: 21166 - DNA, 448 bp, Homo sapiens; identical to SEQ ID NO: 10986
  misc_feature 1..448: note = chr11:107799357-107799805
  misc_feature 1..448: note = hyper
  source 1..448: mol_type = genomic DNA

SEQ ID NO: 21167 - DNA, 15 bp, Homo sapiens
  misc_feature 1..15: note = chr11:109292815-109292830
  misc_feature 1..15: note = hyper
  source 1..15: mol_type = genomic DNA
tctggcaataggctg

SEQ ID NO: 21168 - DNA, 15 bp, Homo sapiens
  misc_feature 1..15: note = chr11:109292891-109292906
  misc_feature 1..15: note = hyper
  source 1..15: mol_type = genomic DNA
cgcggctcggtctct

SEQ ID NO: 21169 - DNA, 123 bp, Homo sapiens
  misc_feature 1..123: note = chr11:109293052-109293175
  misc_feature 1..123: note = hyper
  source 1..123: mol_type = genomic DNA
ggggaggacagctcacgcggcctgagcagccacccctggccatagctccagcccccgcccctgcccccggcccctgccctggcttgcttgcgcgctacctcgctactccgcagtgcaacagtt

SEQ ID NO: 21170 - DNA, 26 bp, Homo sapiens
  misc_feature 1..26: note = chr11:109293873-109293899
  misc_feature 1..26: note = hyper
  source 1..26: mol_type = genomic DNA
cgcggtgccggcgcagaccccatcct

SEQ ID NO: 21171 - DNA, 141 bp, Homo sapiens; identical to SEQ ID NO: 10991
  misc_feature 1..141: note = chr11:110581773-110581914
  misc_feature 1..141: note = hyper
  source 1..141: mol_type = genomic DNA

SEQ ID NO: 21172 - DNA, 95 bp, Homo sapiens
  misc_feature 1..95: note = chr11:110582137-110582232
  misc_feature 1..95: note = hyper
  source 1..95: mol_type = genomic DNA
cgcccccaccctgctcggttctaggcccagccgaacctacatgtccccgtagtgtcgagcgttatcatccacagtcgcccctcaaactgtgaccc

SEQ ID NO: 21173 - DNA, 101 bp, Homo sapiens
  misc_feature 1..101: note = chr11:110582434-110582535
  misc_feature 1..101: note = hyper
  source 1..101: mol_type = genomic DNA
ggctgacaccgccaaagggcagtcagtgctcgcccaggccacttcgggaggcccaggggcacggcgaggggtcggggaaaggcgatcgcccactacagccc

SEQ ID NO: 21174 - skipped

SEQ ID NO: 21175 - DNA, 524 bp, Homo sapiens
  misc_feature 1..524: note = chr11:110583050-110583574
  misc_feature 1..524: note = hyper
  source 1..524: mol_type = genomic DNA
gcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttg

SEQ ID NO: 21176 - DNA, 166 bp, Homo sapiens
  misc_feature 1..166: note = chr11:110583730-110583896
  misc_feature 1..166: note = hyper
  source 1..166: mol_type = genomic DNA
tcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaag

SEQ ID NO: 21177 - DNA, 30 bp, Homo sapiens; identical to SEQ ID NO: 10996
  misc_feature 1..30: note = chr11:110584122-110584152
  misc_feature 1..30: note = hyper
  source 1..30: mol_type = genomic DNA

SEQ ID NO: 21178 - DNA, 51 bp, Homo sapiens
  misc_feature 1..51: note = chr11:111383132-111383183
  misc_feature 1..51: note = hyper
  source 1..51: mol_type = genomic DNA
acccgccccgtctcgcgcccgccccgcccctcggcccgcggggttccaagg

SEQ ID NO: 21179 - DNA, 223 bp, Homo sapiens
  misc_feature 1..223: note = chr11:111383682-111383905
  misc_feature 1..223: note = hyper
  source 1..223: mol_type = genomic DNA
gtcattagctgattgtactgtggtggttacaatcactaactccactgccatcaaaacaaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagata

SEQ ID NO: 21180 - DNA, 151 bp, Homo sapiens
  misc_feature 1..151: note = chr11:111412061-111412212
  misc_feature 1..151: note = hyper
  source 1..151: mol_type = genomic DNA
ccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactcca

SEQ ID NO: 21181 - DNA, 320 bp, Homo sapiens; identical to SEQ ID NO: 11002
  misc_feature 1..320: note = chr11:113345418-113345738
  misc_feature 1..320: note = hyper
  source 1..320: mol_type = genomic DNA

SEQ ID NO: 21182 - DNA, 58 bp, Homo sapiens; identical to SEQ ID NO: 11003
  misc_feature 1..58: note = chr11:113346283-113346341
  misc_feature 1..58: note = hyper
  source 1..58: mol_type = genomic DNA

SEQ ID NO: 21183 - DNA, 120 bp, Homo sapiens; identical to SEQ ID NO: 11004
  misc_feature 1..120: note = chr11:113929618-113929738
  misc_feature 1..120: note = hyper
  source 1..120: mol_type = genomic DNA

SEQ ID NO: 21184 - DNA, 352 bp, Homo sapiens; identical to SEQ ID NO: 11005
  misc_feature 1..352: note = chr11:113930374-113930726
  misc_feature 1..352: note = hyper
  source 1..352: mol_type = genomic DNA

SEQ ID NO: 21185 - DNA, 46 bp, Homo sapiens; identical to SEQ ID NO: 11006
  misc_feature 1..46: note = chr11:113931651-113931697
  misc_feature 1..46: note = hyper
  source 1..46: mol_type = genomic DNA

SEQ ID NO: 21186 - DNA, 510 bp, Homo sapiens; identical to SEQ ID NO: 11007
  misc_feature 1..510: note = chr11:115373899-115374409
  misc_feature 1..510: note = hyper
  source 1..510: mol_type = genomic DNA

SEQ ID NO: 21187 - DNA, 38 bp, Homo sapiens; identical to SEQ ID NO: 993
  misc_feature 1..38: note = chr11:115530058-115530096
  misc_feature 1..38: note = hyper
  source 1..38: mol_type = genomic DNA

SEQ ID NO: 21188 - DNA, 50 bp, Homo sapiens; identical to SEQ ID NO: 3798
  misc_feature 1..50: note = chr11:115630424-115630474
  misc_feature 1..50: note = hyper
  source 1..50: mol_type = genomic DNA

SEQ ID NO: 21189 - DNA, 74 bp, Homo sapiens
  misc_feature 1..74: note = chr11:115630910-115630984
  misc_feature 1..74: note = hyper
  source 1..74: mol_type = genomic DNA
acagtggagccgccccctgctttgggaggagcaaaagagcctctcgcttgcctcccgctcgagctccttctcct

SEQ ID NO: 21190 - DNA, 36 bp, Homo sapiens; identical to SEQ ID NO: 11015
  misc_feature 1..36: note = chr11:116706540-116706576
  misc_feature 1..36: note = hyper
  source 1..36: mol_type = genomic DNA

SEQ ID NO: 21191 - DNA, 30 bp, Homo sapiens; identical to SEQ ID NO: 11016
  misc_feature 1..30: note = chr11:117667351-117667381
  misc_feature 1..30: note = hyper
  source 1..30: mol_type = genomic DNA

SEQ ID NO: 21192 - DNA, 40 bp, Homo sapiens; identical to SEQ ID NO: 11017
  misc_feature 1..40: note = chr11:117667865-117667905
  misc_feature 1..40: note = hyper
  source 1..40: mol_type = genomic DNA

SEQ ID NO: 21193 - DNA, 40 bp, Homo sapiens; identical to SEQ ID NO: 11018
  misc_feature 1..40: note = chr11:118663162-118663202
  misc_feature 1..40: note = hyper
  source 1..40: mol_type = genomic DNA

SEQ ID NO: 21194 - DNA, 177 bp, Homo sapiens; identical to SEQ ID NO: 11019
  misc_feature 1..177: note = chr11:119210471-119210648
  misc_feature 1..177: note = hyper
  source 1..177: mol_type = genomic DNA

SEQ ID NO: 21195 - DNA, 32 bp, Homo sapiens; identical to SEQ ID NO: 11020
  misc_feature 1..32: note = chr11:119211201-119211233
  misc_feature 1..32: note = hyper
  source 1..32: mol_type = genomic DNA

SEQ ID NO: 21196 - DNA, 18 bp, Homo sapiens
  misc_feature 1..18: note = chr11:119293352-119293370
  misc_feature 1..18: note = hyper
  source 1..18: mol_type = genomic DNA
cggcactgcggcttcctt

SEQ ID NO: 21197 - DNA, 218 bp, Homo sapiens; identical to SEQ ID NO: 11023
  misc_feature 1..218: note = chr11:119293708-119293926
  misc_feature 1..218: note = hyper
  source 1..218: mol_type = genomic DNA

SEQ ID NO: 21198 - DNA, 27 bp, Homo sapiens
  misc_feature 1..27: note = chr11:119612200-119612227
  misc_feature 1..27: note = hyper
  source 1..27: mol_type = genomic DNA
gtccctgtccttccccgtgtgggacct

SEQ ID NO: 21199 - DNA, 25 bp, Homo sapiens
  misc_feature 1..25: note = chr11:119613075-119613100
  misc_feature 1..25: note = hyper
  source 1..25: mol_type = genomic DNA
ctgggcgcgccggcctggggggaaa

SEQ ID NO: 21200 - DNA, 30 bp, Homo sapiens; identical to SEQ ID NO: 11027
  misc_feature 1..30: note = chr11:119613389-119613419
  misc_feature 1..30: note = hyper
  source 1..30: mol_type = genomic DNA

SEQ ID NO: 21201 - DNA, 48 bp, Homo sapiens; identical to SEQ ID NO: 11028
  misc_feature 1..48: note = chr11:119884295-119884343
  misc_feature 1..48: note = hyper
  source 1..48: mol_type = genomic DNA

SEQ ID NO: 21202 - DNA, 60 bp, Homo sapiens; identical to SEQ ID NO: 11029
  misc_feature 1..60: note = chr11:120110879-120110939
  misc_feature 1..60: note = hyper
  source 1..60: mol_type = genomic DNA

SEQ ID NO: 21203 - DNA, 35 bp, Homo sapiens; identical to SEQ ID NO: 11030
  misc_feature 1..35: note = chr11:120382869-120382904
  misc_feature 1..35: note = hyper
  source 1..35: mol_type = genomic DNA

SEQ ID NO: 21204 - DNA, 241 bp, Homo sapiens
  misc_feature 1..241: note = chr11:120435559-120435800
  misc_feature 1..241: note = hyper
  source 1..241: mol_type = genomic DNA
cgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggc

SEQ ID NO: 21205 - DNA, 47 bp, Homo sapiens
  misc_feature 1..47: note = chr11:120435830-120435877
  misc_feature 1..47: note = hyper
  source 1..47: mol_type = genomic DNA
tgcggagcccgcgtcatcctgcctgtggggagcgctgtgcctgctct

SEQ ID NO: 21206 - DNA, 92 bp, Homo sapiens; identical to SEQ ID NO: 11032
  misc_feature 1..92: note = chr11:121593544-121593636
  misc_feature 1..92: note = hyper
  source 1..92: mol_type = genomic DNA

SEQ ID NO: 21207 - DNA, 95 bp, Homo sapiens
  misc_feature 1..95: note = chr11:122847170-122847265
  misc_feature 1..95: note = hyper
  source 1..95: mol_type = genomic DNA
gaaactgcctagggccgaggggagggggcgtacgcgtaggagaacgcggtggcaaaccattcctggaaacgcgtgatcattcccagttttgccct

SEQ ID NO: 21208 - DNA, 62 bp, Homo sapiens
  misc_feature 1..62: note = chr11:122847696-122847758
  misc_feature 1..62: note = hyper
  source 1..62: mol_type = genomic DNA
aacagggacgggagaggatggaagcgccgcccagagaaggagggagtcgccttagtatttga

SEQ ID NO: 21209 - DNA, 14 bp, Homo sapiens
  misc_feature 1..14: note = chr11:122848591-122848605
  misc_feature 1..14: note = hyper
  source 1..14: mol_type = genomic DNA
gttttcacctgatt

SEQ ID NO: 21210 - DNA, 217 bp, Homo sapiens
  misc_feature 1..217: note = chr11:122850163-122850380
  misc_feature 1..217: note = hyper
  source 1..217: mol_type = genomic DNA
ccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatcttt

SEQ ID NO: 21211 - DNA, 276 bp, Homo sapiens
  misc_feature 1..276: note = chr11:122850901-122851177
  misc_feature 1..276: note = hyper
  source 1..276: mol_type = genomic DNA
gggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctt

SEQ ID NO: 21212 - DNA, 140 bp, Homo sapiens
  misc_feature 1..140: note = chr11:122852475-122852615
  misc_feature 1..140: note = hyper
  source 1..140: mol_type = genomic DNA
gaggctcgaatctccgctgctctctcccgggcctgggctaccccgggcgctggagaggcaagaagacaagctcctgggtaggttgggtctctgtgttggagaattggcagcttggagaggggggccgggagagccaatga

SEQ ID NO: 21213 - DNA, 93 bp, Homo sapiens
  misc_feature 1..93: note = chr11:122854915-122855008
  misc_feature 1..93: note = hyper
  source 1..93: mol_type = genomic DNA
ggccctgctctcaggcggagaagccaggagcgatgaggggcggggcggctcccggcgccctcttttccagccccgctcccgcgctgccgccgg

SEQ ID NO: 21214 - skipped

SEQ ID NO: 21215 - DNA, 200 bp, Homo sapiens; identical to SEQ ID NO: 11041
  misc_feature 1..200: note = chr11:123065544-123065744
  misc_feature 1..200: note = hyper
  source 1..200: mol_type = genomic DNA

SEQ ID NO: 21216 - DNA, 243 bp, Homo sapiens; identical to SEQ ID NO: 11042
  misc_feature 1..243: note = chr11:123172620-123172863
  misc_feature 1..243: note = hyper
  source 1..243: mol_type = genomic DNA

SEQ ID NO: 21217 - DNA, 24 bp, Homo sapiens
  misc_feature 1..24: note = chr11:123172915-123172939
  misc_feature 1..24: note = hyper
  source 1..24: mol_type = genomic DNA
cgtggttgacgaagccattccctc

SEQ ID NO: 21218 - DNA, 15 bp, Homo sapiens
  misc_feature 1..15: note = chr11:123228701-123228716
  misc_feature 1..15: note = hyper
  source 1..15: mol_type = genomic DNA
ctttccataccttcc

SEQ ID NO: 21219 - DNA, 270 bp, Homo sapiens
  misc_feature 1..270: note = chr11:123228788-123229058
  misc_feature 1..270: note = hyper
  source 1..270: mol_type = genomic DNA
cgttggtttccgcactaaacttgatggtctgattttaaaggttgattttaaagaaactgtctggttgtatgtccccgagttacactgcagtgctaaatgttggagcgaggcaataccgggagaatccaggctgcaggcttcacccagagagggagggtgaggggaggagagagacggagagaggagagagggggaatgaaaggggagagagagggaccaagaccggcgagcgggagacaggagcggaaaccacagaggtagagtcagggc

SEQ ID NO: 21220 - DNA, 41 bp, Homo sapiens; identical to SEQ ID NO: 11049
  misc_feature 1..41: note = chr11:123524936-123524977
  misc_feature 1..41: note = hyper
  source 1..41: mol_type = genomic DNA

SEQ ID NO: 21221 - DNA, 152 bp, Homo sapiens; identical to SEQ ID NO: 11050
  misc_feature 1..152: note = chr11:124631577-124631729
  misc_feature 1..152: note = hyper
  source 1..152: mol_type = genomic DNA

SEQ ID NO: 21222 - DNA, 32 bp, Homo sapiens; identical to SEQ ID NO: 11051
  misc_feature 1..32: note = chr11:124709117-124709149
  misc_feature 1..32: note = hyper
  source 1..32: mol_type = genomic DNA

SEQ ID NO: 21223 - DNA, 126 bp, Homo sapiens; identical to SEQ ID NO: 11052
  misc_feature 1..126: note = chr11:124709539-124709665
  misc_feature 1..126: note = hyper
  source 1..126: mol_type = genomic DNA

SEQ ID NO: 21224 - DNA, 49 bp, Homo sapiens; identical to SEQ ID NO: 11053
  misc_feature 1..49: note = chr11:124735054-124735103
  misc_feature 1..49: note = hyper
  source 1..49: mol_type = genomic DNA

SEQ ID NO: 21225 - DNA, 442 bp, Homo sapiens
  misc_feature 1..442: note = chr11:124735482-124735924
  misc_feature 1..442: note = hyper
  source 1..442: mol_type = genomic DNA
tacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgg

SEQ ID NO: 21226 - DNA, 74 bp, Homo sapiens; identical to SEQ ID NO: 11056
  misc_feature 1..74: note = chr11:124738461-124738535
  misc_feature 1..74: note = hyper
  source 1..74: mol_type = genomic DNA

SEQ ID NO: 21227 - DNA, 22 bp, Homo sapiens
  misc_feature 1..22: note = chr11:124738755-124738777
  misc_feature 1..22: note = hyper
  source 1..22: mol_type = genomic DNA
gctggtctcccgaggcgagccc

SEQ ID NO: 21228 - DNA, 204 bp, Homo sapiens; identical to SEQ ID NO: 11058
  misc_feature 1..204: note = chr11:124933444-124933648
  misc_feature 1..204: note = hyper
  source 1..204: mol_type = genomic DNA

SEQ ID NO: 21229 - DNA, 71 bp, Homo sapiens
  misc_feature 1..71: note = chr11:125035692-125035763
  misc_feature 1..71: note = hyper
  source 1..71: mol_type = genomic DNA
agagggaactgaaagcgatcgagagcggagagctgagggggatggcgcaggatcccgaatctgccgctcaa

SEQ ID NO: 21230 - DNA, 12 bp, Homo sapiens
  misc_feature 1..12: note = chr11:125036208-125036220
  misc_feature 1..12: note = hyper
  source 1..12: mol_type = genomic DNA
tgaaagtagttg

SEQ ID NO: 21231 - DNA, 220 bp, Homo sapiens; identical to SEQ ID NO: 11060
  misc_feature 1..220: note = chr11:125365065-125365285
  misc_feature 1..220: note = hyper
  source 1..220: mol_type = genomic DNA

SEQ ID NO: 21232 - DNA, 197 bp, Homo sapiens; identical to SEQ ID NO: 11061
  misc_feature 1..197: note = chr11:125365752-125365949
  misc_feature 1..197: note = hyper
  source 1..197: mol_type = genomic DNA

SEQ ID NO: 21233 - DNA, 125 bp, Homo sapiens; identical to SEQ ID NO: 11062
  misc_feature 1..125: note = chr11:125366167-125366292
  misc_feature 1..125: note = hyper
  source 1..125: mol_type = genomic DNA

SEQ ID NO: 21234 - DNA, 312 bp, Homo sapiens; identical to SEQ ID NO: 1004
  misc_feature 1..312: note = chr11:125774122-125774434
  misc_feature 1..312: note = hyper
  source 1..312: mol_type = genomic DNA

SEQ ID NO: 21235 - DNA, 94 bp, Homo sapiens
  misc_feature 1..94: note = chr11:126870543-126870637
  misc_feature 1..94: note = hyper
  source 1..94: mol_type = genomic DNA
gtggcttcggtctctttgtgcctctgggtatctgcagccagccgacacaaactgcctgttcttagccgcctcgggaagccgggattgtcagcaa

SEQ ID NO: 21236 - DNA, 204 bp, Homo sapiens
  misc_feature 1..204: note = chr11:126873186-126873390
  misc_feature 1..204: note = hyper
  source 1..204: mol_type = genomic DNA
cctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagagg

SEQ ID NO: 21237 - DNA, 65 bp, Homo sapiens; identical to SEQ ID NO: 11068
  misc_feature 1..65: note = chr11:126873727-126873792
  misc_feature 1..65: note = hyper
  source 1..65: mol_type = genomic DNA

SEQ ID NO: 21238 - DNA, 64 bp, Homo sapiens; identical to SEQ ID NO: 11069
  misc_feature 1..64: note = chr11:128556994-128557058
  misc_feature 1..64: note = hyper
  source 1..64: mol_type = genomic DNA

SEQ ID NO: 21239 - DNA, 36 bp, Homo sapiens
  misc_feature 1..36: note = chr11:128562856-128562892
  misc_feature 1..36: note = hyper
  source 1..36: mol_type = genomic DNA
cagagcgcgggcctccgggtctcaccccgggaaaag

SEQ ID NO: 21240 - DNA, 106 bp, Homo sapiens
  misc_feature 1..106: note = chr11:128563730-128563836
  misc_feature 1..106: note = hyper
  source 1..106: mol_type = genomic DNA
tgtgtgatgcgaaaagcaggaccagcaggggaggaagagggggtgtggggggggagggaagacgagggagagcagaggggagagaagagagaggagagctcgaggc

SEQ ID NO: 21241 - DNA, 44 bp, Homo sapiens
  misc_feature 1..44: note = chr11:128563896-128563940
  misc_feature 1..44: note = hyper
  source 1..44: mol_type = genomic DNA
cctccccgattcgcaaagtgaagtcacttcccaaaattagctga

SEQ ID NO: 21242 - DNA, 67 bp, Homo sapiens
  misc_feature 1..67: note = chr11:128564329-128564396
  misc_feature 1..67: note = hyper
  source 1..67: mol_type = genomic DNA
tcctactcgcgggccagccggccaggcgcccgcattgagggcgaccctcccccgaaatcccagcccc

SEQ ID NO: 21243 - DNA, 55 bp, Homo sapiens
  misc_feature 1..55: note = chr11:128564685-128564740
  misc_feature 1..55: note = hyper
  source 1..55: mol_type = genomic DNA
tgcaagtgagtgtgtcgggggatctatctgagcgggctcctccagatggaagccc

SEQ ID NO: 21244 - DNA, 93 bp, Homo sapiens
  misc_feature 1..93: note = chr11:129242783-129242876
  misc_feature 1..93: note = hyper
  source 1..93: mol_type = genomic DNA
gagagaaaacagaagcgggaaattcgacagaggaggagaggcccaaagggcggggagcaatgcggggaagggagaagtgggagggaagaagag

SEQ ID NO: 21245 - DNA, 67 bp, Homo sapiens
  misc_feature 1..67: note = chr11:129243587-129243654
  misc_feature 1..67: note = hyper
  source 1..67: mol_type = genomic DNA
tcaaagacgcgttgcgggccttgtctaatgctaggctgtgacttggcctcttaacatctattttctc

SEQ ID NO: 21246 - DNA, 41 bp, Homo sapiens
  misc_feature 1..41: note = chr11:129244603-129244644
  misc_feature 1..41: note = hyper
  source 1..41: mol_type = genomic DNA
tttataaacaatgttttaaaaaaaaccgcacacttttttaa

SEQ ID NO: 21247 - DNA, 32 bp, Homo sapiens; identical to SEQ ID NO: 11083
  misc_feature 1..32: note = chr11:132864177-132864209
  misc_feature 1..32: note = hyper
  source 1..32: mol_type = genomic DNA

SEQ ID NO: 21248 - DNA, 41 bp, Homo sapiens; identical to SEQ ID NO: 11084
  misc_feature 1..41: note = chr11:132934044-132934085
  misc_feature 1..41: note = hyper
  source 1..41: mol_type = genomic DNA

SEQ ID NO: 21249 - DNA, 83 bp, Homo sapiens; identical to SEQ ID NO: 11085
  misc_feature 1..83: note = chr11:132934490-132934573
  misc_feature 1..83: note = hyper
  source 1..83: mol_type = genomic DNA

SEQ ID NO: 21250 - DNA, 216 bp, Homo sapiens
  misc_feature 1..216: note = chr11:132952552-132952768
  misc_feature 1..216: note = hyper
  source 1..216: mol_type = genomic DNA
gccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgac

SEQ ID NO: 21251 - DNA, 38 bp, Homo sapiens
  misc_feature 1..38: note = chr11:133402168-133402206
  misc_feature 1..38: note = hyper
  source 1..38: mol_type = genomic DNA
gagcagggcagttgtcgccgagaagacgacccagtagg

SEQ ID NO: 21252 - DNA, 30 bp, Homo sapiens
  misc_feature 1..30: note = chr11:133402260-133402290
  misc_feature 1..30: note = hyper
  source 1..30: mol_type = genomic DNA
ttctgctgctgctaccgctgctgccttcct

SEQ ID NO: 21253 - DNA, 126 bp, Homo sapiens; identical to SEQ ID NO: 11090
  misc_feature 1..126: note = chr11:133826138-133826264
  misc_feature 1..126: note = hyper
  source 1..126: mol_type = genomic DNA

SEQ ID NO: 21254 - DNA, 80 bp, Homo sapiens; identical to SEQ ID NO: 11091
  misc_feature 1..80: note = chr11:133826978-133827058
  misc_feature 1..80: note = hyper
  source 1..80: mol_type = genomic DNA

SEQ ID NO: 21255 - DNA, 32 bp, Homo sapiens
  misc_feature 1..32: note = chr11:133906918-133906950
  misc_feature 1..32: note = hyper
  source 1..32: mol_type = genomic DNA
cctcgctgcagacggttcgccttgtccactct

SEQ ID NO: 21256 - DNA, 16 bp, Homo sapiens
  misc_feature 1..16: note = chr11:133938772-133938788
  misc_feature 1..16: note = hyper
  source 1..16: mol_type = genomic DNA
agagaacccatgtgcc

SEQ ID NO: 21257 - DNA, 213 bp, Homo sapiens
  misc_feature 1..213: note = chr11:133938789-133939002
  misc_feature 1..213: note = hyper
  source 1..213: mol_type = genomic DNA
gtccagagcatcgctgcatccgtaagcagctagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcga

SEQ ID NO: 21258 - DNA, 204 bp, Homo sapiens
  misc_feature 1..204: note = chr11:133939177-133939381
  misc_feature 1..204: note = hyper
  source 1..204: mol_type = genomic DNA
tcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgt

SEQ ID NO: 21259 - DNA, 44 bp, Homo sapiens; identical to SEQ ID NO: 11096
  misc_feature 1..44: note = chr11:133994700-133994744
  misc_feature 1..44: note = hyper
  source 1..44: mol_type = genomic DNA

SEQ ID NO: 21260 - DNA, 50 bp, Homo sapiens
  misc_feature 1..50: note = chr11:134145653-134145703
  misc_feature 1..50: note = hyper
  source 1..50: mol_type = genomic DNA
tcagcctgaaacatgcggcctcccggactcctctctgtgtcaccgacctc

SEQ ID NO: 21261 - DNA, 34 bp, Homo sapiens
  misc_feature 1..34: note = chr11:134146393-134146427
  misc_feature 1..34: note = hyper
  source 1..34: mol_type = genomic DNA
aacacctggagcgccggcggagctcggctgtccc

SEQ ID NO: 21262 - DNA, 232 bp, Homo sapiens; identical to SEQ ID NO: 1015
  misc_feature 1..232: note = chr11:134146444-134146676
  misc_feature 1..232: note = hyper
  source 1..232: mol_type = genomic DNA

SEQ ID NO: 21263 - skipped

SEQ ID NO: 21264 - DNA, 12 bp, Homo sapiens
  misc_feature 1..12: note = chr11:134201829-134201841
  misc_feature 1..12: note = hyper
  source 1..12: mol_type = genomic DNA
tgagcgccggcg

SEQ ID NO: 21265 - DNA, 24 bp, Homo sapiens
  misc_feature 1..24: note = chr11:134202084-134202108
  misc_feature 1..24: note = hyper
  source 1..24: mol_type = genomic DNA
ccagccctccgcacctcgggttct

SEQ ID NO: 21266 - DNA, 22 bp, Homo sapiens
  misc_feature 1..22: note = chr11:134281509-134281531
  misc_feature 1..22: note = hyper
  source 1..22: mol_type = genomic DNA
ccagcccgagctcggttctcgg

SEQ ID NO: 21267 - DNA, 52 bp, Homo sapiens; identical to SEQ ID NO: 11102
  misc_feature 1..52: note = chr11:134281591-134281643
  misc_feature 1..52: note = hyper
  source 1..52: mol_type = genomic DNA

SEQ ID NO: 21268 - DNA, 70 bp, Homo sapiens; identical to SEQ ID NO: 11103
  misc_feature 1..70: note = chr11:134282862-134282932
  misc_feature 1..70: note = hyper
  source 1..70: mol_type = genomic DNA

SEQ ID NO: 21269 - DNA, 32 bp, Homo sapiens; identical to SEQ ID NO: 11104
  misc_feature 1..32: note = chr12:1059315-1059347
  misc_feature 1..32: note = hyper
  source 1..32: mol_type = genomic DNA

SEQ ID NO: 21270 - DNA, 28 bp, Homo sapiens
  misc_feature 1..28: note = chr12:1639107-1639135
  misc_feature 1..28: note = hyper
  source 1..28: mol_type = genomic DNA
cgctcgtgccaggatcgcggggcgcggg

SEQ ID NO: 21271 - DNA, 129 bp, Homo sapiens
  misc_feature 1..129: note = chr12:1639222-1639351
  misc_feature 1..129: note = hyper
  source 1..129: mol_type = genomic DNA
gggggcagcaggcgtgcggcgccgggagaagggggccgggcggcggagactccccgtccgcacccccgcggcgaggcccccgggccgctctgcttaggggccgagggagccgggcgggaggcaggtgcg

SEQ ID NO: 21272 - DNA, 197 bp, Homo sapiens; identical to SEQ ID NO: 11106
  misc_feature 1..197: note = chr12:2161529-2161726
  misc_feature 1..197: note = hyper
  source 1..197: mol_type = genomic DNA

SEQ ID NO: 21273 - DNA, 22 bp, Homo sapiens
  misc_feature 1..22: note = chr12:2162817-2162839
  misc_feature 1..22: note = hyper
  source 1..22: mol_type = genomic DNA
tttccaccgggttcctgcccta

SEQ ID NO: 21274 - DNA, 54 bp, Homo sapiens
  misc_feature 1..54: note = chr12:2163110-2163164
  misc_feature 1..54: note = hyper
  source 1..54: mol_type = genomic DNA
ggctgcctggccagccgcgcggggggcagagggcgccggcgccgcggagcccag

SEQ ID NO: 21275 - DNA, 234 bp, Homo sapiens
  misc_feature 1..234: note = chr12:2163276-2163510
  misc_feature 1..234: note = hyper
  source 1..234: mol_type = genomic DNA
cggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 21276 - DNA, 39 bp, Homo sapiens; identical to SEQ ID NO: 11109
  misc_feature 1..39: note = chr12:2800124-2800163
  misc_feature 1..39: note = hyper
  source 1..39: mol_type = genomic DNA

SEQ ID NO: 21277 - DNA, 37 bp, Homo sapiens
  misc_feature 1..37: note = chr12:2862031-2862068
  misc_feature 1..37: note = hyper
  source 1..37: mol_type = genomic DNA
ggcccccagtggcaacggtgagagcagtggcccagaa

SEQ ID NO: 21278 - DNA, 30 bp, Homo sapiens; identical to SEQ ID NO: 11111
  misc_feature 1..30: note = chr12:2862442-2862472
  misc_feature 1..30: note = hyper
  source 1..30: mol_type = genomic DNA

SEQ ID NO: 21279 - DNA, 53 bp, Homo sapiens; identical to SEQ ID NO: 11112
  misc_feature 1..53: note = chr12:3475605-3475658
  misc_feature 1..53: note = hyper
  source 1..53: mol_type = genomic DNA

SEQ ID NO: 21280 - DNA, 61 bp, Homo sapiens; identical to SEQ ID NO: 3838
  misc_feature 1..61: note = chr12:3600168-3600229
  misc_feature 1..61: note = hyper
  source 1..61: mol_type = genomic DNA

SEQ ID NO: 21281 - DNA, 85 bp, Homo sapiens
  misc_feature 1..85: note = chr12:3600230-3600315
  misc_feature 1..85: note = hyper
  source 1..85: mol_type = genomic DNA
gagactaggggagggggcgggcccgggggcgctgggggccctcggtctgcgcccagccgccgccggctccagcgaacctcctacc

SEQ ID NO: 21282 - DNA, 15 bp, Homo sapiens
  misc_feature 1..15: note = chr12:3600768-3600783
  misc_feature 1..15: note = hyper
  source 1..15: mol_type = genomic DNA
tcaccaaacccttgc

SEQ ID NO: 21283 - DNA, 30 bp, Homo sapiens; identical to SEQ ID NO: 11116
  misc_feature 1..30: note = chr12:3601542-3601572
  misc_feature 1..30: note = hyper
  source 1..30: mol_type = genomic DNA

SEQ ID NO: 21284 - DNA, 108 bp, Homo sapiens
  misc_feature 1..108: note = chr12:3602162-3602270
  misc_feature 1..108: note = hyper
  source 1..108: mol_type = genomic DNA
gagttcttaactctgcgctaaaacccctaccccacggcgtaggcagcaaagctttataaatcccccttctctgagagactagaagcagcatgcatctgacaattgtca

SEQ ID NO: 21285 - DNA, 83 bp, Homo sapiens
  misc_feature 1..83: note = chr12:4274188-4274271
  misc_feature 1..83: note = hyper
  source 1..83: mol_type = genomic DNA
ggggtgccccagctcttccacccaggccgctccccgagcccagctccccgcgcccctctctctatccaggagagacgcattgg

SEQ ID NO: 21286 - DNA, 271 bp, Homo sapiens
  misc_feature 1..271: note = chr12:4377981-4378252
  misc_feature 1..271: note = hyper
  source 1..271: mol_type = genomic DNA
gcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctg

SEQ ID NO: 21287 - DNA, 198 bp, Homo sapiens
  misc_feature 1..198: note = chr12:4378330-4378528
  misc_feature 1..198: note = hyper
  source 1..198: mol_type = genomic DNA
agtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgc

SEQ ID NO: 21288 - DNA, 551 bp, Homo sapiens
  misc_feature 1..551: note = chr12:4378806-4379357
  misc_feature 1..551: note = hyper
  source 1..551: mol_type = genomic DNA
agagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctcc

SEQ ID NO: 21289 - DNA, 244 bp, Homo sapiens
  misc_feature 1..244: note = chr12:4379491-4379735
  misc_feature 1..244: note = hyper
  source 1..244: mol_type = genomic DNA
ttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatca

SEQ ID NO: 21290 - DNA, 203 bp, Homo sapiens
  misc_feature 1..203: note = chr12:4383784-4383987
  misc_feature 1..203: note = hyper
  source 1..203: mol_type = genomic DNA
aaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctc

SEQ ID NO: 21291 - DNA, 83 bp, Homo sapiens
  misc_feature 1..83: note = chr12:5017990-5018073
  misc_feature 1..83: note = hyper
  source 1..83: mol_type = genomic DNA
gtaggcgggaggcaacggtggtgagaagggtggtcccaaggccgcgggaggagccaatcagcggcgactctgggctcttgcag

SEQ ID NO: 21292 - DNA, 106 bp, Homo sapiens
  misc_feature 1..106: note = chr12:5018692-5018798
  misc_feature 1..106: note = hyper
  source 1..106: mol_type = genomic DNA
tgggactgcacaaaagcaaacccgtcggaggagttttgccagaaacaccaccgcctgcattgcgtcggacctgaccatttccaatgtgaaattcccggggaaggtc

SEQ ID NO: 21293 - skipped

SEQ ID NO: 21294 - DNA, 229 bp, Homo sapiens; identical to SEQ ID NO: 1020
  misc_feature 1..229: note = chr12:5018806-5019035
  misc_feature 1..229: note = hyper
  source 1..229: mol_type = genomic DNA

SEQ ID NO: 21295 - DNA, 12 bp, Homo sapiens
  misc_feature 1..12: note = chr12:5541088-5541100
  misc_feature 1..12: note = hyper
  source 1..12: mol_type = genomic DNA
aaatgacccctt

SEQ ID NO: 21296 - DNA, 146 bp, Homo sapiens; identical to SEQ ID NO: 11131
  misc_feature 1..146: note = chr12:5541504-5541650
  misc_feature 1..146: note = hyper
  source 1..146: mol_type = genomic DNA

SEQ ID NO: 21297 - DNA, 235 bp, Homo sapiens
  misc_feature 1..235: note = chr12:5542090-5542325
  misc_feature 1..235: note = hyper
  source 1..235: mol_type = genomic DNA
gcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcg

SEQ ID NO: 21298 - DNA, 320 bp, Homo sapiens
  misc_feature 1..320: note = chr12:5542439-5542759
  misc_feature 1..320: note = hyper
  source 1..320: mol_type = genomic DNA
cggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacg

SEQ ID NO: 21299 - DNA, 138 bp, Homo sapiens
  misc_feature 1..138: note = chr12:6664370-6664508
  misc_feature 1..138: note = hyper
  source 1..138: mol_type = genomic DNA
cgttgtgagtggtatgacacagagagacctgtccccctttcccaatccctacctccgcttgtactcgtcccgctcccgcttcactttggccagcacgttgtagagagcgcggatctcgggcgtgatggtgtcgatctg

SEQ ID NO: 21300 - DNA, 32 bp, Homo sapiens; identical to SEQ ID NO: 11134
  misc_feature 1..32: note = chr12:8123148-8123180
  misc_feature 1..32: note = hyper
  source 1..32: mol_type = genomic DNA

SEQ ID NO: 21301 - DNA, 39 bp, Homo sapiens
  misc_feature 1..39: note = chr12:8171321-8171360
  misc_feature 1..39: note = hyper
  source 1..39: mol_type = genomic DNA
gcccggcagtgacagcgaccgcgccgctgcgctcccgcc

SEQ ID NO: 21302 - DNA, 57 bp, Homo sapiens; identical to SEQ ID NO: 11136
  misc_feature 1..57: note = chr12:10306356-10306413
  misc_feature 1..57: note = hyper
  source 1..57: mol_type = genomic DNA

SEQ ID NO: 21303 - DNA, 48 bp, Homo sapiens; identical to SEQ ID NO: 11137
  misc_feature 1..48: note = chr12:11653509-11653557
  misc_feature 1..48: note = hyper
  source 1..48: mol_type = genomic DNA

SEQ ID NO: 21304 - DNA, 30 bp, Homo sapiens; identical to SEQ ID NO: 11138
  misc_feature 1..30: note = chr12:11653758-11653788
  misc_feature 1..30: note = hyper
  source 1..30: mol_type = genomic DNA

SEQ ID NO: 21305 - DNA, 30 bp, Homo sapiens; identical to SEQ ID NO: 11139
  misc_feature 1..30: note = chr12:12869188-12869218
  misc_feature 1..30: note = hyper
  source 1..30: mol_type = genomic DNA

SEQ ID NO: 21306 - DNA, 49 bp, Homo sapiens; identical to SEQ ID NO: 11140
  misc_feature 1..49: note = chr12:13154617-13154666
  misc_feature 1..49: note = hyper
  source 1..49: mol_type = genomic DNA

SEQ ID NO: 21307 - DNA, 50 bp, Homo sapiens; identical to SEQ ID NO: 11142
  misc_feature 1..50: note = chr12:14134167-14134217
  misc_feature 1..50: note = hyper
  source 1..50: mol_type = genomic DNA

SEQ ID NO: 21308 - DNA, 633 bp, Homo sapiens
  misc_feature 1..633: note = chr12:14134478-14135111
  misc_feature 1..633: note = hyper
  source 1..633: mol_type = genomic DNA
gcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtg

SEQ ID NO: 21309 - DNA, 218 bp, Homo sapiens; identical to SEQ ID NO: 11144
  misc_feature 1..218: note = chr12:15374309-15374527
  misc_feature 1..218: note = hyper
  source 1..218: mol_type = genomic DNA

SEQ ID NO: 21310 - DNA, 30 bp, Homo sapiens; identical to SEQ ID NO: 11145
  misc_feature 1..30: note = chr12:16500494-16500524
  misc_feature 1..30: note = hyper
  source 1..30: mol_type = genomic DNA

SEQ ID NO: 21311 - DNA, 107 bp, Homo sapiens; identical to SEQ ID NO: 11146
  misc_feature 1..107: note = chr12:16757928-16758035
  misc_feature 1..107: note = hyper
  source 1..107: mol_type = genomic DNA

SEQ ID NO: 21312 - DNA, 39 bp, Homo sapiens; identical to SEQ ID NO: 11147
  misc_feature 1..39: note = chr12:20521231-20521270
  misc_feature 1..39: note = hyper
  source 1..39: mol_type = genomic DNA

SEQ ID NO: 21313 - DNA, 94 bp, Homo sapiens
  misc_feature 1..94: note = chr12:20522363-20522457
  misc_feature 1..94: note = hyper
  source 1..94: mol_type = genomic DNA
acctggtgctgcagccgctccggagctctcggaaactttcctccgcgctgtgcgcgggctccctgtcctttctgctggcgctgctggtgaggct

SEQ ID NO: 21314 - DNA, 30 bp, Homo sapiens
  misc_feature 1..30: note = chr12:20522739-20522769
  misc_feature 1..30: note = hyper
  source 1..30: mol_type = genomic DNA
ccagattgggctgggcgtcggggaggatca

SEQ ID NO: 21315 - DNA, 337 bp, Homo sapiens
  misc_feature 1..337: note = chr12:21680683-21681020
  misc_feature 1..337: note = hyper
  source 1..337: mol_type = genomic DNA
cagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 21316 - DNA, 85 bp, Homo sapiens; identical to SEQ ID NO: 11152
  misc_feature 1..85: note = chr12:21927273-21927358
  misc_feature 1..85: note = hyper
  source 1..85: mol_type = genomic DNA

SEQ ID NO: 21317 - DNA, 30 bp, Homo sapiens; identical to SEQ ID NO: 11153
  misc_feature 1..30: note = chr12:21927922-21927952
  misc_feature 1..30: note = hyper
  source 1..30: mol_type = genomic DNA

SEQ ID NO: 21318 - DNA, 238 bp, Homo sapiens
  misc_feature 1..238: note = chr12:22094810-22095048
  misc_feature 1..238: note = hyper
  source 1..238: mol_type = genomic DNA
actgcgtaaacagtcaccctcttctcctgtttccaaccagagacataattaactctcgagataacgtgtttatattaagatcaccccacaaccactcccccgcgaaacacaagccgtgaattttgtccccgacaaccctctttaattaacaccggattttctcaagagccagttttgagtcagcttgagataagcattgttttcaggaactgtcgtattttaataaaggatggtcagc

SEQ ID NO: 21319 - DNA, 575 bp, Homo sapiens; identical to SEQ ID NO: 11159
  misc_feature 1..575: note = chr12:22487691-22488266
  misc_feature 1..575: note = hyper
  source 1..575: mol_type = genomic DNA

SEQ ID NO: 21320 - DNA, 322 bp, Homo sapiens; identical to SEQ ID NO: 11160
  misc_feature 1..322: note = chr12:22488339-22488661
  misc_feature 1..322: note = hyper
  source 1..322: mol_type = genomic DNA

SEQ ID NO: 21321 - DNA, 92 bp, Homo sapiens; identical to SEQ ID NO: 11161
  misc_feature 1..92: note = chr12:24714812-24714904
  misc_feature 1..92: note = hyper
  source 1..92: mol_type = genomic DNA

SEQ ID NO: 21322 - DNA, 30 bp, Homo sapiens; identical to SEQ ID NO: 11162
  misc_feature 1..30: note = chr12:24715353-24715383
  misc_feature 1..30: note = hyper
  source 1..30: mol_type = genomic DNA

SEQ ID NO: 21323 - skipped

SEQ ID NO: 21324 - DNA, 199 bp, Homo sapiens
  misc_feature 1..199: note = chr12:24716218-24716417
  misc_feature 1..199: note = hyper
  source 1..199: mol_type = genomic DNA
cgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggtggttgaactggtttggttttgtgttaagcgaagccaaaaaaaa

SEQ ID NO: 21325 - DNA, 195 bp, Homo sapiens
  misc_feature 1..195: note = chr12:25101397-25101592
  misc_feature 1..195: note = hyper
  source 1..195: mol_type = genomic DNA
cctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgta

SEQ ID NO: 21326 - DNA, 259 bp, Homo sapiens
  misc_feature 1..259: note = chr12:25101660-25101919
  misc_feature 1..259: note = hyper
  source 1..259: mol_type = genomic DNA
ggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagg

SEQ ID NO: 21327 - DNA, 219 bp, Homo sapiens; identical to SEQ ID NO: 11168
  misc_feature 1..219: note = chr12:28122168-28122387
  misc_feature 1..219: note = hyper
  source 1..219: mol_type = genomic DNA

SEQ ID NO: 21328 - DNA, 224 bp, Homo sapiens
  misc_feature 1..224: note = chr12:29937107-29937331
  misc_feature 1..224: note = hyper
  source 1..224: mol_type = genomic DNA
ctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctc

SEQ ID NO: 21329 - DNA, 28 bp, Homo sapiens
  misc_feature 1..28: note = chr12:29937374-29937402
  misc_feature 1..28: note = hyper
  source 1..28: mol_type = genomic DNA
ctgcccgggctttctctcacccgcccgg

SEQ ID NO: 21330 - skipped

SEQ ID NO: 21331 - DNA, 184 bp, Homo sapiens
  misc_feature 1..184: note = chr12:30975388-30975572
  misc_feature 1..184: note = hyper
  source 1..184: mol_type = genomic DNA
cgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccg

SEQ ID NO: 21332 - DNA, 165 bp, Homo sapiens
  misc_feature 1..165: note = chr12:31079499-31079664
  misc_feature 1..165: note = hyper
  source 1..165: mol_type = genomic DNA
agccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccc

SEQ ID NO: 21333 - DNA, 117 bp, Homo sapiens; identical to SEQ ID NO: 3868
  misc_feature 1..117: note = chr12:31079693-31079810
  misc_feature 1..117: note = hyper
  source 1..117: mol_type = genomic DNA

SEQ ID NO: 21334 - DNA, 28 bp, Homo sapiens
  misc_feature 1..28: note = chr12:33592057-33592085
  misc_feature 1..28: note = hyper
  source 1..28: mol_type = genomic DNA
cggcgccgggaggcgggaagcggaccag

SEQ ID NO: 21335 - DNA, 73 bp, Homo sapiens; identical to SEQ ID NO: 11184
  misc_feature 1..73: note = chr12:33592961-33593034
  misc_feature 1..73: note = hyper
  source 1..73: mol_type = genomic DNA

SEQ ID NO: 21336 - DNA, 40 bp, Homo sapiens; identical to SEQ ID NO: 11185
  misc_feature 1..40: note = chr12:33593092-33593132
  misc_feature 1..40: note = hyper
  source 1..40: mol_type = genomic DNA

SEQ ID NO: 21337 - DNA, 30 bp, Homo sapiens; identical to SEQ ID NO: 11186
  misc_feature 1..30: note = chr12:39298600-39298630
  misc_feature 1..30: note = hyper
  source 1..30: mol_type = genomic DNA

SEQ ID NO: 21338 - DNA, 82 bp, Homo sapiens
  misc_feature 1..82: note = chr12:39299560-39299642
  misc_feature 1..82: note = hyper
  source 1..82: mol_type = genomic DNA
ggcgcgcggggatcccggtttcccagcccccttccggcaggcagcagcccgggcgggggacacactccgtgatcccctcctg

SEQ ID NO: 21339 - DNA, 30 bp, Homo sapiens; identical to SEQ ID NO: 11188
  misc_feature 1..30: note = chr12:39300375-39300405
  misc_feature 1..30: note = hyper
  source 1..30: mol_type = genomic DNA

SEQ ID NO: 21340 - DNA, 41 bp, Homo sapiens; identical to SEQ ID NO: 11189
  misc_feature 1..41: note = chr12:40618628-40618669
  misc_feature 1..41: note = hyper
  source 1..41: mol_type = genomic DNA

SEQ ID NO: 21341 - skipped

SEQ ID NO: 21342 - DNA, 40 bp, Homo sapiens
  misc_feature 1..40: note = chr12:41582473-41582513
  misc_feature 1..40: note = hyper
  source 1..40: mol_type = genomic DNA
ctcatccagaagctgcgagtccagtgcgactaccgcgccc

SEQ ID NO: 21343 - DNA, 241 bp, Homo sapiens; identical to SEQ ID NO: 11193
  misc_feature 1..241: note = chr12:41583049-41583290
  misc_feature 1..241: note = hyper
  source 1..241: mol_type = genomic DNA

SEQ ID NO: 21344 - DNA, 443 bp, Homo sapiens; identical to SEQ ID NO: 11194
  misc_feature 1..443: note = chr12:42983315-42983758
  misc_feature 1..443: note = hyper
  source 1..443: mol_type = genomic DNA

SEQ ID NO: 21345 - DNA, 117 bp, Homo sapiens; identical to SEQ ID NO: 11196
  misc_feature 1..117: note = chr12:43945664-43945781
  misc_feature 1..117: note = hyper
  source 1..117: mol_type = genomic DNA

SEQ ID NO: 21346 - DNA, 121 bp, Homo sapiens
  misc_feature 1..121: note = chr12:43946298-43946419
  misc_feature 1..121: note = hyper
  source 1..121: mol_type = genomic DNA
gggttttgagctcttagatgaaatgacaagcatcagatagaacgtttctgttttttatgttttacggtacttttaggcttctcaaacaaaataaaataagctacaacggaagttcttgtag

SEQ ID NO: 21347 - DNA, 101 bp, Homo sapiens; identical to SEQ ID NO: 11198
  misc_feature 1..101: note = chr12:45269011-45269112
  misc_feature 1..101: note = hyper
  source 1..101: mol_type = genomic DNA

SEQ ID NO: 21348 - DNA, 10 bp, Homo sapiens
  misc_feature 1..10: note = chr12:45269494-45269504
  misc_feature 1..10: note = hyper
  source 1..10: mol_type = genomic DNA
gacctacttt

SEQ ID NO: 21349 - DNA, 32 bp, Homo sapiens
  misc_feature 1..32: note = chr12:45269624-45269656
  misc_feature 1..32: note = hyper
  source 1..32: mol_type = genomic DNA
atgttctcagtaagacccgagactccatggtg

SEQ ID NO: 21350 - DNA, 35 bp, Homo sapiens; identical to SEQ ID NO: 11200
  misc_feature 1..35: note = chr12:45270707-45270742
  misc_feature 1..35: note = hyper
  source 1..35: mol_type = genomic DNA

SEQ ID NO: 21351 - DNA, 141 bp, Homo sapiens
  misc_feature 1..141: note = chr12:45445258-45445399
  misc_feature 1..141: note = hyper
  source 1..141: mol_type = genomic DNA
agtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtca

SEQ ID NO: 21352 - DNA, 36 bp, Homo sapiens
  misc_feature 1..36: note = chr12:47225579-47225615
  misc_feature 1..36: note = hyper
  source 1..36: mol_type = genomic DNA
cagcaggatcccgggcggtcgcggagccagctcccg

SEQ ID NO: 21353 - DNA, 51 bp, Homo sapiens; identical to SEQ ID NO: 11207
  misc_feature 1..51: note = chr12:48396843-48396894
  misc_feature 1..51: note = hyper
  source 1..51: mol_type = genomic DNA

SEQ ID NO: 21354 - DNA, 72 bp, Homo sapiens
  misc_feature 1..72: note = chr12:48397123-48397195
  misc_feature 1..72: note = hyper
  source 1..72: mol_type = genomic DNA
acaccacgcagcctggctcggtgagttccagaatttagaaaagtaactcattgtagtacctcggggcggcgg

SEQ ID NO: 21355 - DNA, 280 bp, Homo sapiens
  misc_feature 1..280: note = chr12:48398070-48398350
  misc_feature 1..280: note = hyper
  source 1..280: mol_type = genomic DNA
gcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgcccccc

SEQ ID NO: 21356 - DNA, 374 bp, Homo sapiens; identical to SEQ ID NO: 11209
  misc_feature 1..374: note = chr12:48577898-48578272
  misc_feature 1..374: note = hyper
  source 1..374: mol_type = genomic DNA

SEQ ID NO: 21357 - skipped

SEQ ID NO: 21358 - DNA, 275 bp, Homo sapiens; identical to SEQ ID NO: 11212
  misc_feature 1..275: note = chr12:49374100-49374375
  misc_feature 1..275: note = hyper
  source 1..275: mol_type = genomic DNA

SEQ ID NO: 21359 - DNA, 53 bp, Homo sapiens
  misc_feature 1..53: note = chr12:49375119-49375172
  misc_feature 1..53: note = hyper
  source 1..53: mol_type = genomic DNA
gctgctgcgcctggagccggaagacccggcccacaaaccgccctccccccacg

SEQ ID NO: 21360 - DNA, 23 bp, Homo sapiens
  misc_feature 1..23: note = chr12:49390850-49390873
  misc_feature 1..23: note = hyper
  source 1..23: mol_type = genomic DNA
gtccgcgcccagccccggccggc

SEQ ID NO: 21361 - DNA, 57 bp, Homo sapiens
  misc_feature 1..57: note = chr12:49391877-49391934
  misc_feature 1..57: note = hyper
  source 1..57: mol_type = genomic DNA
gagtcgcagctggggctgatgaagtgggcacctgagagttcccggggcctctcttag

SEQ ID NO: 21362 - DNA, 239 bp, Homo sapiens; identical to SEQ ID NO: 11218
  misc_feature 1..239: note = chr12:49483977-49484216
  misc_feature 1..239: note = hyper
  source 1..239: mol_type = genomic DNA

SEQ ID NO: 21363 - DNA, 272 bp, Homo sapiens
  misc_feature 1..272: note = chr12:49730090-49730362
  misc_feature 1..272: note = hyper
  source 1..272: mol_type = genomic DNA
ttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccgg

SEQ ID NO: 21364 - DNA, 36 bp, Homo sapiens
  misc_feature 1..36: note = chr12:50297461-50297497
  misc_feature 1..36: note = hyper
  source 1..36: mol_type = genomic DNA
aggggaggatgctttcgtggtccagagggcttgctg

SEQ ID NO: 21365 - DNA, 33 bp, Homo sapiens
  misc_feature 1..33: note = chr12:50298055-50298088
  misc_feature 1..33: note = hyper
  source 1..33: mol_type = genomic DNA
ctcctccctctttggatgcggccctgatttctg

SEQ ID NO: 21366 - DNA, 186 bp, Homo sapiens; identical to SEQ ID NO: 11223
  misc_feature 1..186: note = chr12:50355598-50355784
  misc_feature 1..186: note = hyper
  source 1..186: mol_type = genomic DNA

SEQ ID NO: 21367 - DNA, 41 bp, Homo sapiens
  misc_feature 1..41: note = chr12:50426799-50426840
  misc_feature 1..41: note = hyper
  source 1..41: mol_type = genomic DNA
catcgacgatccctggacgcgggcgtcgggggcagggaggc

SEQ ID NO: 21368 - DNA, 51 bp, Homo sapiens; identical to SEQ ID NO: 11225
  misc_feature 1..51: note = chr12:50444372-50444423
  misc_feature 1..51: note = hyper
  source 1..51: mol_type = genomic DNA

SEQ ID NO: 21369 - DNA, 41 bp, Homo sapiens; identical to SEQ ID NO: 11226
  misc_feature 1..41: note = chr12:52208682-52208723
  misc_feature 1..41: note = hyper
  source 1..41: mol_type = genomic DNA

SEQ ID NO: 21370 - DNA, 23 bp, Homo sapiens
  misc_feature 1..23: note = chr12:52262960-52262983
  misc_feature 1..23: note = hyper
  source 1..23: mol_type = genomic DNA
ctctcggttcacccccgcactcg

SEQ ID NO: 21371 - DNA, 88 bp, Homo sapiens
  misc_feature 1..88: note = chr12:52301192-52301280
  misc_feature 1..88: note = hyper
  source 1..88: mol_type = genomic DNA
tgggcaataaggaaacggtttattaggagggagtggtggagctgggccaggcaggaagacgctggaataagaaacatttttgctccag

SEQ ID NO: 21372 - DNA, 122 bp, Homo sapiens
  misc_feature 1..122: note = chr12:52400709-52400831
  misc_feature 1..122: note = hyper
  source 1..122: mol_type = genomic DNA
gacccgcggcccgcccggctggcatcccccagccgccgccagccccgccgaggggagccagcgccgtctctgaggggcgtccggcgccggagccatgaccctccgccgactcaggaagctgc

SEQ ID NO: 21373 - DNA, 12 bp, Homo sapiens
  misc_feature 1..12: note = chr12:52652141-52652153
  misc_feature 1..12: note = hyper
  source 1..12: mol_type = genomic DNA
gtccgcaggagc

SEQ ID NO: 21374 - DNA, 211 bp, Homo sapiens; identical to SEQ ID NO: 11234
  misc_feature 1..211: note = chr12:52702362-52702573
  misc_feature 1..211: note = hyper
  source 1..211: mol_type = genomic DNA

SEQ ID NO: 21375 - skipped

SEQ ID NO: 21376 - DNA, 248 bp, Homo sapiens
  misc_feature 1..248: note = chr12:53108218-53108466
  misc_feature 1..248: note = hyper
  source 1..248: mol_type = genomic DNA
gccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggca

SEQ ID NO: 21377 - DNA, 15 bp, Homo sapiens
  misc_feature 1..15: note = chr12:53359301-53359316
  misc_feature 1..15: note = hyper
  source 1..15: mol_type = genomic DNA
tagggagctgctccc

SEQ ID NO: 21378 - DNA, 48 bp, Homo sapiens; identical to SEQ ID NO: 11239
  misc_feature 1..48: note = chr12:54145906-54145954
  misc_feature 1..48: note = hyper
  source 1..48: mol_type = genomic DNA

SEQ ID NO: 21379 - DNA, 30 bp, Homo sapiens; identical to SEQ ID NO: 11241
  misc_feature 1..30: note = chr12:54322140-54322170
  misc_feature 1..30: note = hyper
  source 1..30: mol_type = genomic DNA

SEQ ID NO: 21380 - DNA, 236 bp, Homo sapiens; identical to SEQ ID NO: 11242
  misc_feature 1..236: note = chr12:54324560-54324796
  misc_feature 1..236: note = hyper
  source 1..236: mol_type = genomic DNA

SEQ ID NO: 21381 - DNA, 68 bp, Homo sapiens
  misc_feature 1..68: note = chr12:54333337-54333405
  misc_feature 1..68: note = hyper
  source 1..68: mol_type = genomic DNA
ctgggctctctccaatggctgggacagtcaggtgtactgctccaaggagcagtcgcagtccgcccacc

SEQ ID NO: 21382 - DNA, 147 bp, Homo sapiens
  misc_feature 1..147: note = chr12:54343665-54343812
  misc_feature 1..147: note = hyper
  source 1..147: mol_type = genomic DNA
acacagaggaggtgtcgtctccagtctagacaagggcgctaataacgcccataaaaggcggcctctccagagatgctctggcaactccgctcccgcgcgcctgccgctggccgctttctccacctccccccgccccgcccttctctg

SEQ ID NO: 21383 - DNA, 73 bp, Homo sapiens
  misc_feature 1..73: note = chr12:54354621-54354694
  misc_feature 1..73: note = hyper
  source 1..73: mol_type = genomic DNA
agagcagagcagggaccgctggccccggtccgcgaacaaagcaaactccggggacttggggttccggccaggc

SEQ ID NO: 21384 - DNA, 38 bp, Homo sapiens; identical to SEQ ID NO: 1043
  misc_feature 1..38: note = chr12:54354814-54354852
  misc_feature 1..38: note = hyper
  source 1..38: mol_type = genomic DNA

SEQ ID NO: 21385 - DNA, 19 bp, Homo sapiens
  misc_feature 1..19: note = chr12:54359664-54359683
  misc_feature 1..19: note = hyper
  source 1..19: mol_type = genomic DNA
ttgctctccctcgcccggg

SEQ ID NO: 21386 - DNA, 30 bp, Homo sapiens; identical to SEQ ID NO: 11257
  misc_feature 1..30: note = chr12:54366936-54366966
  misc_feature 1..30: note = hyper
  source 1..30: mol_type = genomic DNA

SEQ ID NO: 21387 - DNA, 95 bp, Homo sapiens; identical to SEQ ID NO: 11258
  misc_feature 1..95: note = chr12:54367200-54367295
  misc_feature 1..95: note = hyper
  source 1..95: mol_type = genomic DNA

SEQ ID NO: 21388 - DNA, 39 bp, Homo sapiens; identical to SEQ ID NO: 11259
  misc_feature 1..39: note = chr12:54367525-54367564
  misc_feature 1..39: note = hyper
  source 1..39: mol_type = genomic DNA

SEQ ID NO: 21389 - DNA, 64 bp, Homo sapiens
  misc_feature 1..64: note = chr12:54378115-54378179
  misc_feature 1..64: note = hyper
  source 1..64: mol_type = genomic DNA
tctggcttcctctttcccctaccccgcgtccattcggaacctccttttccgagcagccatgaag

SEQ ID NO: 21390 - DNA, 256 bp, Homo sapiens
  misc_feature 1..256: note = chr12:54387959-54388215
  misc_feature 1..256: note = hyper
  source 1..256: mol_type = genomic DNA
tcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggc

SEQ ID NO: 21391 - DNA, 64 bp, Homo sapiens
  misc_feature 1..64: note = chr12:54388245-54388309
  misc_feature 1..64: note = hyper
  source 1..64: mol_type = genomic DNA
tagaaaggaccttgaggtctgctgggtgtttgggctgccctgggggcggcggcccagagtgtgg

SEQ ID NO: 21392 - DNA, 30 bp, Homo sapiens; identical to SEQ ID NO: 11265
  misc_feature 1..30: note = chr12:54388653-54388683
  misc_feature 1..30: note = hyper
  source 1..30: mol_type = genomic DNA

SEQ ID NO: 21393 - DNA, 11 bp, Homo sapiens
  misc_feature 1..11: note = chr12:54391403-54391414
  misc_feature 1..11: note = hyper
  source 1..11: mol_type = genomic DNA
tccctctctgc

SEQ ID NO: 21394 - DNA, 40 bp, Homo sapiens
  misc_feature 1..40: note = chr12:54393684-54393724
  misc_feature 1..40: note = hyper
  source 1..40: mol_type = genomic DNA
accggtgccttgggtccagagttccggacccccaggaaat

SEQ ID NO: 21395 - DNA, 152 bp, Homo sapiens
  misc_feature 1..152: note = chr12:54393798-54393950
  misc_feature 1..152: note = hyper
  source 1..152: mol_type = genomic DNA
cgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatctt

SEQ ID NO: 21396 - DNA, 248 bp, Homo sapiens
  misc_feature 1..248: note = chr12:54394162-54394410
  misc_feature 1..248: note = hyper
  source 1..248: mol_type = genomic DNA
cgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgccc

SEQ ID NO: 21397 - DNA, 195 bp, Homo sapiens; identical to SEQ ID NO: 11269
  misc_feature 1..195: note = chr12:54394466-54394661
  misc_feature 1..195: note = hyper
  source 1..195: mol_type = genomic DNA

SEQ ID NO: 21398 - DNA, 137 bp, Homo sapiens
  misc_feature 1..137: note = chr12:54398959-54399096
  misc_feature 1..137: note = hyper
  source 1..137: mol_type = genomic DNA
tcccagcccagcctgcaggtcaggattggaatcattttttattcgctatcatttacgaattaacaacacaacacgcatctggggaaagaaatgaaagctgggggtagagaggggctagcaaacgccctcttccccta

SEQ ID NO: 21399 - DNA, 76 bp, Homo sapiens
  misc_feature 1..76: note = chr12:54399540-54399616
  misc_feature 1..76: note = hyper
  source 1..76: mol_type = genomic DNA
gaggactttagggtgcgcgccgcgggcaagccgtcgtgggagcctcggagcgtgcatccgcgttcgcggagatgtt

SEQ ID NO: 21400 - DNA, 14 bp, Homo sapiens
  misc_feature 1..14: note = chr12:54402676-54402690
  misc_feature 1..14: note = hyper
  source 1..14: mol_type = genomic DNA
tcatgtcgtggatt

SEQ ID NO: 21401 - DNA, 211 bp, Homo sapiens
  misc_feature 1..211: note = chr12:54402856-54403067
  misc_feature 1..211: note = hyper
  source 1..211: mol_type = genomic DNA
ccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccag

SEQ ID NO: 21402 - DNA, 68 bp, Homo sapiens
  misc_feature 1..68: note = chr12:54408343-54408411
  misc_feature 1..68: note = hyper
  source 1..68: mol_type = genomic DNA
agcattaaatggctccgaagggcctcgccgccttttccccacaccaaatgtgccatttatcccttgtc

SEQ ID NO: 21403 - DNA, 22 bp, Homo sapiens
  misc_feature 1..22: note = chr12:54425119-54425141
  misc_feature 1..22: note = hyper
  source 1..22: mol_type = genomic DNA
gaccgcgggactggagccctgt

SEQ ID NO: 21404 - DNA, 30 bp, Homo sapiens; identical to SEQ ID NO: 11276
  misc_feature 1..30: note = chr12:54440926-54440956
  misc_feature 1..30: note = hyper
  source 1..30: mol_type = genomic DNA

SEQ ID NO: 21405 - DNA, 129 bp, Homo sapiens; identical to SEQ ID NO: 11278
  misc_feature 1..129: note = chr12:54520065-54520194
  misc_feature 1..129: note = hyper
  source 1..129: mol_type = genomic DNA

SEQ ID NO: 21406 - DNA, 129 bp, Homo sapiens; identical to SEQ ID NO: 11279
  misc_feature 1..129: note = chr12:54520221-54520350
  misc_feature 1..129: note = hyper
  source 1..129: mol_type = genomic DNA

SEQ ID NO: 21407 - DNA, 35 bp, Homo sapiens
  misc_feature 1..35: note = chr12:54520710-54520745
  misc_feature 1..35: note = hyper
  source 1..35: mol_type = genomic DNA
aacttgggggaacttcggaaaagttttttgagggg

SEQ ID NO: 21408 - DNA, 92 bp, Homo sapiens
  misc_feature 1..92: note = chr12:54520868-54520960
  misc_feature 1..92: note = hyper
  source 1..92: mol_type = genomic DNA
aaaaacccagccgcgtcccaaacccgctcaccccagcaggcccttagagacgcttggagatccccagacacgccccgcggaaagggaaggaa

SEQ ID NO: 21409 - DNA, 169 bp, Homo sapiens
  misc_feature 1..169: note = chr12:54812069-54812238
  misc_feature 1..169: note = hyper
  source 1..169: mol_type = genomic DNA
cagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggc

SEQ ID NO: 21410 - DNA, 263 bp, Homo sapiens
  misc_feature 1..263: note = chr12:54812359-54812622
  misc_feature 1..263: note = hyper
  source 1..263: mol_type = genomic DNA
cccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 21411 - DNA, 37 bp, Homo sapiens; identical to SEQ ID NO: 11282
  misc_feature 1..37: note = chr12:54943371-54943408
  misc_feature 1..37: note = hyper
  source 1..37: mol_type = genomic DNA

SEQ ID NO: 21412 - DNA, 14 bp, Homo sapiens
  misc_feature 1..14: note = chr12:57619110-57619124
  misc_feature 1..14: note = hyper
  source 1..14: mol_type = genomic DNA
gggcctgtccccca

SEQ ID NO: 21413 - DNA, 37 bp, Homo sapiens; identical to SEQ ID NO: 11284
  misc_feature 1..37: note = chr12:57870111-57870148
  misc_feature 1..37: note = hyper
  source 1..37: mol_type = genomic DNA

SEQ ID NO: 21414 - DNA, 236 bp, Homo sapiens
  misc_feature 1..236: note = chr12:57943845-57944081
  misc_feature 1..236: note = hyper
  source 1..236: mol_type = genomic DNA
gacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagc

SEQ ID NO: 21415 - DNA, 68 bp, Homo sapiens
  misc_feature 1..68: note = chr12:57944117-57944185
  misc_feature 1..68: note = hyper
  source 1..68: mol_type = genomic DNA
gctgagattctgcggggagacaagttcatccccattttccaaggggacgacagcgtcgttattggggt

SEQ ID NO: 21416 - DNA, 94 bp, Homo sapiens; identical to SEQ ID NO: 11286
  misc_feature 1..94: note = chr12:58004814-58004908
  misc_feature 1..94: note = hyper
  source 1..94: mol_type = genomic DNA

SEQ ID NO: 21417 - DNA, 158 bp, Homo sapiens; identical to SEQ ID NO: 11287
  misc_feature 1..158: note = chr12:58015011-58015169
  misc_feature 1..158: note = hyper
  source 1..158: mol_type = genomic DNA

SEQ ID NO: 21418 - DNA, 27 bp, Homo sapiens
  misc_feature 1..27: note = chr12:58021293-58021320
  misc_feature 1..27: note = hyper
  source 1..27: mol_type = genomic DNA
ccgctggcggctgggcgcgggtgcagc

SEQ ID NO: 21419 - DNA, 156 bp, Homo sapiens; identical to SEQ ID NO: 11290
  misc_feature 1..156: note = chr12:58026100-58026256
  misc_feature 1..156: note = hyper
  source 1..156: mol_type = genomic DNA

SEQ ID NO: 21420 - DNA, 15 bp, Homo sapiens
  misc_feature 1..15: note = chr12:62584823-62584838
  misc_feature 1..15: note = hyper
  source 1..15: mol_type = genomic DNA
cgcccctaccctgac

SEQ ID NO: 21421 - DNA, 30 bp, Homo sapiens; identical to SEQ ID NO: 11293
  misc_feature 1..30: note = chr12:62829269-62829299
  misc_feature 1..30: note = hyper
  source 1..30: mol_type = genomic DNA

SEQ ID NO: 21422 - DNA, 146 bp, Homo sapiens; identical to SEQ ID NO: 1050
  misc_feature 1..146: note = chr12:63544728-63544874
  misc_feature 1..146: note = hyper
  source 1..146: mol_type = genomic DNA

SEQ ID NO: 21423 - DNA, 36 bp, Homo sapiens
  misc_feature 1..36: note = chr12:64061785-64061821
  misc_feature 1..36: note = hyper
  source 1..36: mol_type = genomic DNA
aagaaaagcgccatgcggctccctcctagggctctc

SEQ ID NO: 21424 - DNA, 164 bp, Homo sapiens
  misc_feature 1..164: note = chr12:64062205-64062369
  misc_feature 1..164: note = hyper
  source 1..164: mol_type = genomic DNA
caggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccc

SEQ ID NO: 21425 - DNA, 343 bp, Homo sapiens
  misc_feature 1..343: note = chr12:64062578-64062921
  misc_feature 1..343: note = hyper
  source 1..343: mol_type = genomic DNA
ccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacacgttaattaacgaggtattaaagggaaagatctcagctgaaagaaatgactgtaggaagtgtgtcag

SEQ ID NO: 21426 - DNA, 55 bp, Homo sapiens
  misc_feature 1..55: note = chr12:64063096-64063151
  misc_feature 1..55: note = hyper
  source 1..55: mol_type = genomic DNA
cagagcctcaggttgacgccacttccttggcacgggacagcgtttactgaatctt

SEQ ID NO: 21427 - DNA, 144 bp, Homo sapiens
  misc_feature 1..144: note = chr12:64784390-64784534
  misc_feature 1..144: note = hyper
  source 1..144: mol_type = genomic DNA
agctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccag

SEQ ID NO: 21428 - DNA, 25 bp, Homo sapiens
  misc_feature 1..25: note = chr12:65219156-65219181
  misc_feature 1..25: note = hyper
  source 1..25: mol_type = genomic DNA
gttccaggctcgcaggaagccagac

SEQ ID NO: 21429 - DNA, 93 bp, Homo sapiens
  misc_feature 1..93: note = chr12:65220112-65220205
  misc_feature 1..93: note = hyper
  source 1..93: mol_type = genomic DNA
ctatgagaaggcaatcggcatgatgcccagcaggtgccccggaaaagtcagaagagcatattggtcagacatacagggaatccttgtagtgtg

SEQ ID NO: 21430 - DNA, 89 bp, Homo sapiens
  misc_feature 1..89: note = chr12:65220350-65220439
  misc_feature 1..89: note = hyper
  source 1..89: mol_type = genomic DNA
aaacactcccgtggccgttgttatcaccgttctatgtttgggcaggacttcgtttaaaccacctcagagagaggcggatccatgtggta

SEQ ID NO: 21431 - DNA, 28 bp, Homo sapiens
  misc_feature 1..28: note = chr12:65514835-65514863
  misc_feature 1..28: note = hyper
  source 1..28: mol_type = genomic DNA
ttgcctggtgagcatcgatccataggta

SEQ ID NO: 21432 - DNA, 151 bp, Homo sapiens; identical to SEQ ID NO: 11310
  misc_feature 1..151: note = chr12:66122419-66122570
  misc_feature 1..151: note = hyper
  source 1..151: mol_type = genomic DNA

SEQ ID NO: 21433 - DNA, 48 bp, Homo sapiens; identical to SEQ ID NO: 11313
  misc_feature 1..48: note = chr12:66135151-66135199
  misc_feature 1..48: note = hyper
  source 1..48: mol_type = genomic DNA

SEQ ID NO: 21434 - DNA, 117 bp, Homo sapiens; identical to SEQ ID NO: 11314
  misc_feature 1..117: note = chr12:66135452-66135569
  misc_feature 1..117: note = hyper
  source 1..117: mol_type = genomic DNA

SEQ ID NO: 21435 - DNA, 82 bp, Homo sapiens
  misc_feature 1..82: note = chr12:66136014-66136096
  misc_feature 1..82: note = hyper
  source 1..82: mol_type = genomic DNA
ggtcgcgccggcgcacgctcgtccccttctgccccggagcccgcccgcgccgcacggtggccccttgcgctggcctgatcgt

SEQ ID NO: 21436 - DNA, 72 bp, Homo sapiens; identical to SEQ ID NO: 11316
  misc_feature 1..72: note = chr12:66217530-66217602
  misc_feature 1..72: note = hyper
  source 1..72: mol_type = genomic DNA

SEQ ID NO: 21437 - DNA, 30 bp, Homo sapiens; identical to SEQ ID NO: 11317
  misc_feature 1..30: note = chr12:66219066-66219096
  misc_feature 1..30: note = hyper
  source 1..30: mol_type = genomic DNA

SEQ ID NO: 21438 - DNA, 119 bp, Homo sapiens
  misc_feature 1..119: note = chr12:66583137-66583256
  misc_feature 1..119: note = hyper
  source 1..119: mol_type = genomic DNA
tgccgcccgcgctgctcggagagctctgcgctgttctggacagctgcgacggcgcgctgggctggcgcggcctgggtgagtcggcggggaccggccgggggcggcgggggagcccagcg

SEQ ID NO: 21439 - DNA, 30 bp, Homo sapiens; identical to SEQ ID NO: 11320
  misc_feature 1..30: note = chr12:68759101-68759131
  misc_feature 1..30: note = hyper
  source 1..30: mol_type = genomic DNA

SEQ ID NO: 21440 - DNA, 61 bp, Homo sapiens; identical to SEQ ID NO: 11321
  misc_feature 1..61: note = chr12:69326653-69326714
  misc_feature 1..61: note = hyper
  source 1..61: mol_type = genomic DNA

SEQ ID NO: 21441 - DNA, 177 bp, Homo sapiens
  misc_feature 1..177: note = chr12:69327082-69327259
  misc_feature 1..177: note = hyper
  source 1..177: mol_type = genomic DNA
cgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcc

SEQ ID NO: 21442 - DNA, 176 bp, Homo sapiens; identical to SEQ ID NO: 11323
  misc_feature 1..176: note = chr12:71314436-71314612
  misc_feature 1..176: note = hyper
  source 1..176: mol_type = genomic DNA

SEQ ID NO: 21443 - DNA, 63 bp, Homo sapiens; identical to SEQ ID NO: 11324
  misc_feature 1..63: note = chr12:71314613-71314676
  misc_feature 1..63: note = hyper
  source 1..63: mol_type = genomic DNA

SEQ ID NO: 21444 - DNA, 27 bp, Homo sapiens
  misc_feature 1..27: note = chr12:72666686-72666713
  misc_feature 1..27: note = hyper
  source 1..27: mol_type = genomic DNA
cttcgctgtgtccctcgtggcattgct

SEQ ID NO: 21445 - DNA, 30 bp, Homo sapiens; identical to SEQ ID NO: 11330
  misc_feature 1..30: note = chr12:75601190-75601220
  misc_feature 1..30: note = hyper
  source 1..30: mol_type = genomic DNA

SEQ ID NO: 21446 - DNA, 32 bp, Homo sapiens
  misc_feature 1..32: note = chr12:75601910-75601942
  misc_feature 1..32: note = hyper
  source 1..32: mol_type = genomic DNA
ccccgggaggggatcagcgtccagcgctgtcc

SEQ ID NO: 21447 - DNA, 118 bp, Homo sapiens
  misc_feature 1..118: note = chr12:75603231-75603349
  misc_feature 1..118: note = hyper
  source 1..118: mol_type = genomic DNA
ccaacctccgcgcccagagtcaccatcgcgcagggttgggcaaaccatggagctcggggcgggtccagccggcactgcccgacccctccgggagcgggcagatcggctggccgtgaat

SEQ ID NO: 21448 - DNA, 64 bp, Homo sapiens; identical to SEQ ID NO: 11335
  misc_feature 1..64: note = chr12:77719516-77719580
  misc_feature 1..64: note = hyper
  source 1..64: mol_type = genomic DNA

SEQ ID NO: 21449 - DNA, 271 bp, Homo sapiens; identical to SEQ ID NO: 11336
  misc_feature 1..271: note = chr12:79257826-79258097
  misc_feature 1..271: note = hyper
  source 1..271: mol_type = genomic DNA

SEQ ID NO: 21450 - DNA, 122 bp, Homo sapiens; identical to SEQ ID NO: 11337
  misc_feature 1..122: note = chr12:79258316-79258438
  misc_feature 1..122: note = hyper
  source 1..122: mol_type = genomic DNA

SEQ ID NO: 21451 - DNA, 411 bp, Homo sapiens; identical to SEQ ID NO: 11338
  misc_feature 1..411: note = chr12:79258439-79258850
  misc_feature 1..411: note = hyper
  source 1..411: mol_type = genomic DNA

SEQ ID NO: 21452 - DNA, 30 bp, Homo sapiens; identical to SEQ ID NO: 11340
  misc_feature 1..30: note = chr12:81330816-81330846
  misc_feature 1..30: note = hyper
  source 1..30: mol_type = genomic DNA

SEQ ID NO: 21453 - DNA, 48 bp, Homo sapiens; identical to SEQ ID NO: 11341
  misc_feature 1..48: note = chr12:81331829-81331877
  misc_feature 1..48: note = hyper
  source 1..48: mol_type = genomic DNA

SEQ ID NO: 21454 - DNA, 30 bp, Homo sapiens; identical to SEQ ID NO: 11343
  misc_feature 1..30: note = chr12:82153211-82153241
  misc_feature 1..30: note = hyper
  source 1..30: mol_type = genomic DNA

SEQ ID NO: 21455 - DNA, 191 bp, Homo sapiens; identical to SEQ ID NO: 11344
  misc_feature 1..191: note = chr12:85305054-85305245
  misc_feature 1..191: note = hyper
  source 1..191: mol_type = genomic DNA

SEQ ID NO: 21456 - DNA, 37 bp, Homo sapiens; identical to SEQ ID NO: 11345
  misc_feature 1..37: note = chr12:85305657-85305694
  misc_feature 1..37: note = hyper
  source 1..37: mol_type = genomic DNA

SEQ ID NO: 21457 - skipped

SEQ ID NO: 21458 - DNA, 28 bp, Homo sapiens
  misc_feature 1..28: note = chr12:85306798-85306826
  misc_feature 1..28: note = hyper
  source 1..28: mol_type = genomic DNA
tcttcccagagcccggggctgtgcccgc

SEQ ID NO: 21459 - DNA, 79 bp, Homo sapiens
  misc_feature 1..79: note = chr12:85673127-85673206
  misc_feature 1..79: note = hyper
  source 1..79: mol_type = genomic DNA
caaagggaagggtggcgaagagggtgtagggaattggttggcattagtataatggcttcattgcctcttgctcggcttc

SEQ ID NO: 21460 - DNA, 50 bp, Homo sapiens
  misc_feature 1..50: note = chr12:93966603-93966653
  misc_feature 1..50: note = hyper
  source 1..50: mol_type = genomic DNA
gaaggacgcgaacccttctctgaccccagctcgggcggccacctgtcttt

SEQ ID NO: 21461 - DNA, 231 bp, Homo sapiens
  misc_feature 1..231: note = chr12:94543178-94543409
  misc_feature 1..231: note = hyper
  source 1..231: mol_type = genomic DNA
caactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggg

SEQ ID NO: 21462 - DNA, 277 bp, Homo sapiens
  misc_feature 1..277: note = chr12:94543445-94543722
  misc_feature 1..277: note = hyper
  source 1..277: mol_type = genomic DNA
cttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccacc

SEQ ID NO: 21463 - DNA, 272 bp, Homo sapiens; identical to SEQ ID NO: 11357
  misc_feature 1..272: note = chr12:95266922-95267194
  misc_feature 1..272: note = hyper
  source 1..272: mol_type = genomic DNA

SEQ ID NO: 21464 - skipped

SEQ ID NO: 21465 - DNA, 15 bp, Homo sapiens
  misc_feature 1..15: note = chr12:95267666-95267681
  misc_feature 1..15: note = hyper
  source 1..15: mol_type = genomic DNA
ccggggcctttctgc

SEQ ID NO: 21466 - skipped

SEQ ID NO: 21467 - DNA, 269 bp, Homo sapiens; identical to SEQ ID NO: 11362
  misc_feature 1..269: note = chr12:96883445-96883714
  misc_feature 1..269: note = hyper
  source 1..269: mol_type = genomic DNA

SEQ ID NO: 21468 - DNA, 30 bp, Homo sapiens; identical to SEQ ID NO: 11363
  misc_feature 1..30: note = chr12:99287423-99287453
  misc_feature 1..30: note = hyper
  source 1..30: mol_type = genomic DNA

SEQ ID NO: 21469 - DNA, 11 bp, Homo sapiens
  misc_feature 1..11: note = chr12:99288301-99288312
  misc_feature 1..11: note = hyper
  source 1..11: mol_type = genomic DNA
cgactcggctt

SEQ ID NO: 21470 - DNA, 71 bp, Homo sapiens
  misc_feature 1..71: note = chr12:101111302-101111373
  misc_feature 1..71: note = hyper
  source 1..71: mol_type = genomic DNA
gatggcctccctcaccgcatacggtaactggggccgtcgcgggttcctggggcggcggggcggaagggagg

SEQ ID NO: 21471 - DNA, 30 bp, Homo sapiens; identical to SEQ ID NO: 11369
  misc_feature 1..30: note = chr12:103311260-103311290
  misc_feature 1..30: note = hyper
  source 1..30: mol_type = genomic DNA

SEQ ID NO: 21472 - DNA, 60 bp, Homo sapiens; identical to SEQ ID NO: 11370
  misc_feature 1..60: note = chr12:103350244-103350304
  misc_feature 1..60: note = hyper
  source 1..60: mol_type = genomic DNA

SEQ ID NO: 21473 - DNA, 139 bp, Homo sapiens; identical to SEQ ID NO: 11371
  misc_feature 1..139: note = chr12:103350383-103350522
  misc_feature 1..139: note = hyper
  source 1..139: mol_type = genomic DNA

SEQ ID NO: 21474 - DNA, 63 bp, Homo sapiens
  misc_feature 1..63: note = chr12:103351501-103351564
  misc_feature 1..63: note = hyper
  source 1..63: mol_type = genomic DNA
tccggccagggagggcgagtgaaagaaggaaatcagaaaggaagggagttaacaaaataataa

SEQ ID NO: 21475 - DNA, 180 bp, Homo sapiens
  misc_feature 1..180: note = chr12:103358685-103358865
  misc_feature 1..180: note = hyper
  source 1..180: mol_type = genomic DNA
atggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttga

SEQ ID NO: 21476 - DNA, 161 bp, Homo sapiens
  misc_feature 1..161: note = chr12:103359395-103359556
  misc_feature 1..161: note = hyper
  source 1..161: mol_type = genomic DNA
actttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttg

SEQ ID NO: 21477 - DNA, 56 bp, Homo sapiens
  misc_feature 1..56: note = chr12:103359586-103359642
  misc_feature 1..56: note = hyper
  source 1..56: mol_type = genomic DNA
cgcctccggactcgaccccaccatagccccgccgtccgaatcgtctctgaaccaaa

SEQ ID NO: 21478 - DNA, 263 bp, Homo sapiens; identical to SEQ ID NO: 1062
  misc_feature 1..263: note = chr12:103889253-103889516
  misc_feature 1..263: note = hyper
  source 1..263: mol_type = genomic DNA

SEQ ID NO: 21479 - DNA, 197 bp, Homo sapiens; identical to SEQ ID NO: 1063
  misc_feature 1..197: note = chr12:103889517-103889714
  misc_feature 1..197: note = hyper
  source 1..197: mol_type = genomic DNA

SEQ ID NO: 21480 - DNA, 57 bp, Homo sapiens
  misc_feature 1..57: note = chr12:104851020-104851077
  misc_feature 1..57: note = hyper
  source 1..57: mol_type = genomic DNA
ccgggctgggggctccgagagcggccgcgaagcgactccgatcctccctctgagcct

SEQ ID NO: 21481 - DNA, 28 bp, Homo sapiens
  misc_feature 1..28: note = chr12:104851186-104851214
  misc_feature 1..28: note = hyper
  source 1..28: mol_type = genomic DNA
gccatgaagccagcgctgctggaagtga

SEQ ID NO: 21482 - DNA, 60 bp, Homo sapiens; identical to SEQ ID NO: 11390
  misc_feature 1..60: note = chr12:104852725-104852785
  misc_feature 1..60: note = hyper
  source 1..60: mol_type = genomic DNA

SEQ ID NO: 21483 - DNA, 41 bp, Homo sapiens; identical to SEQ ID NO: 11392
  misc_feature 1..41: note = chr12:106974919-106974960
  misc_feature 1..41: note = hyper
  source 1..41: mol_type = genomic DNA

SEQ ID NO: 21484 - DNA, 38 bp, Homo sapiens; identical to SEQ ID NO: 11393
  misc_feature 1..38: note = chr12:106975290-106975328
  misc_feature 1..38: note = hyper
  source 1..38: mol_type = genomic DNA

SEQ ID NO: 21485 - DNA, 39 bp, Homo sapiens; identical to SEQ ID NO: 11394
  misc_feature 1..39: note = chr12:106975543-106975582
  misc_feature 1..39: note = hyper
  source 1..39: mol_type = genomic DNA

SEQ ID NO: 21486 - DNA, 50 bp, Homo sapiens; identical to SEQ ID NO: 11395
  misc_feature 1..50: note = chr12:106976472-106976522
  misc_feature 1..50: note = hyper
  source 1..50: mol_type = genomic DNA

SEQ ID NO: 21487 - DNA, 11 bp, Homo sapiens
  misc_feature 1..11: note = chr12:106976842-106976853
  misc_feature 1..11: note = hyper
  source 1..11: mol_type = genomic DNA
cgctttttctc

SEQ ID NO: 21488 - DNA, 258 bp, Homo sapiens
  misc_feature 1..258: note = chr12:106977497-106977755
  misc_feature 1..258: note = hyper
  source 1..258: mol_type = genomic DNA
ccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttt

SEQ ID NO: 21489 - DNA, 124 bp, Homo sapiens
  misc_feature 1..124: note = chr12:106980333-106980457
  misc_feature 1..124: note = hyper
  source 1..124: mol_type = genomic DNA
ctgccaagctggagctggaaacttctgcctccatccactttccgctcccatctccagaacccagagctgaggcggccaaagtacttcctggagccggatttgagttccccgggccgcatcggtg

SEQ ID NO: 21490 - DNA, 133 bp, Homo sapiens
  misc_feature 1..133: note = chr12:106981406-106981539
  misc_feature 1..133: note = hyper
  source 1..133: mol_type = genomic DNA
cctcccccctcacccgtccggaggttaggcgccagctgggcagtgcgcccgcctccccaggagccacaggctcaccaacgtgaaaggttctggcttttcttccccacgacccgtgggtcgcccagggtgagtt

SEQ ID NO: 21491 - DNA, 11 bp, Homo sapiens
  misc_feature 1..11: note = chr12:107715153-107715164
  misc_feature 1..11: note = hyper
  source 1..11: mol_type = genomic DNA
tccagccgaag

SEQ ID NO: 21492 - DNA, 49 bp, Homo sapiens
  misc_feature 1..49: note = chr12:108168922-108168971
  misc_feature 1..49: note = hyper
  source 1..49: mol_type = genomic DNA
tctaagattctgtttcgtcttcttctattgagagattgacctcttgagt

SEQ ID NO: 21493 - DNA, 10 bp, Homo sapiens
  misc_feature 1..10: note = chr12:108169573-108169583
  misc_feature 1..10: note = hyper
  source 1..10: mol_type = genomic DNA
aacctaaggt

SEQ ID NO: 21494 - DNA, 290 bp, Homo sapiens
  misc_feature 1..290: note = chr12:108297466-108297756
  misc_feature 1..290: note = hyper
  source 1..290: mol_type = genomic DNA
ggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccggcgccgacttggcgatggccagctacacaggtccggcgggggcggcagccatgtggggcgcgggctggcgtggggagcagccc

SEQ ID NO: 21495 - DNA, 43 bp, Homo sapiens; identical to SEQ ID NO: 11407
  misc_feature 1..43: note = chr12:110271088-110271131
  misc_feature 1..43: note = hyper
  source 1..43: mol_type = genomic DNA

SEQ ID NO: 21496 - DNA, 372 bp, Homo sapiens; identical to SEQ ID NO: 11409
  misc_feature 1..372: note = chr12:111284662-111285034
  misc_feature 1..372: note = hyper
  source 1..372: mol_type = genomic DNA

SEQ ID NO: 21497 - DNA, 389 bp, Homo sapiens
  misc_feature 1..389: note = chr12:111471559-111471948
  misc_feature 1..389: note = hyper
  source 1..389: mol_type = genomic DNA
gggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaa

SEQ ID NO: 21498 - DNA, 166 bp, Homo sapiens; identical to SEQ ID NO: 3946
  misc_feature 1..166: note = chr12:111472851-111473017
  misc_feature 1..166: note = hyper
  source 1..166: mol_type = genomic DNA

SEQ ID NO: 21499 - DNA, 122 bp, Homo sapiens
  misc_feature 1..122: note = chr12:113013157-113013279
  misc_feature 1..122: note = hyper
  source 1..122: mol_type = genomic DNA
tgccctcccaagctgcagcacgcgctggctggggggtcgtgggggctcccgtgggggcgcggccggacgcgggacgctgcctccgggaatggggctgctggagcgggaggatgcgctagaac

SEQ ID NO: 21500 - DNA, 502 bp, Homo sapiens; identical to SEQ ID NO: 11416
  misc_feature 1..502: note = chr12:113494535-113495037
  misc_feature 1..502: note = hyper
  source 1..502: mol_type = genomic DNA

SEQ ID NO: 21501 - DNA, 13 bp, Homo sapiens
  misc_feature 1..13: note = chr12:113495038-113495051
  misc_feature 1..13: note = hyper
  source 1..13: mol_type = genomic DNA
ccccccaggcgga

SEQ ID NO: 21502 - DNA, 79 bp, Homo sapiens; identical to SEQ ID NO: 1071
  misc_feature 1..79: note = chr12:113541522-113541601
  misc_feature 1..79: note = hyper
  source 1..79: mol_type = genomic DNA

SEQ ID NO: 21503 - skipped

SEQ ID NO: 21504 - DNA, 111 bp, Homo sapiens
  misc_feature 1..111: note = chr12:113592127-113592238
  misc_feature 1..111: note = hyper
  source 1..111: mol_type = genomic DNA
tccaataataaggaacgctggcggccaggtgggatggagagggtaaggcactgcaggcccatgtgagtcccttccccgcccccgactctagttccaagaggttccggagct

SEQ ID NO: 21505 - DNA, 39 bp, Homo sapiens
  misc_feature 1..39: note = chr12:113592359-113592398
  misc_feature 1..39: note = hyper
  source 1..39: mol_type = genomic DNA
gacgaggtgctcgcacagggccagcggcgggcacagctg

SEQ ID NO: 21506 - DNA, 309 bp, Homo sapiens
  misc_feature 1..309: note = chr12:113900765-113901074
  misc_feature 1..309: note = hyper
  source 1..309: mol_type = genomic DNA
agtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattggga

SEQ ID NO: 21507 - DNA, 447 bp, Homo sapiens
  misc_feature 1..447: note = chr12:113903021-113903468
  misc_feature 1..447: note = hyper
  source 1..447: mol_type = genomic DNA
taatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgg

SEQ ID NO: 21508 - DNA, 45 bp, Homo sapiens
  misc_feature 1..45: note = chr12:113903498-113903543
  misc_feature 1..45: note = hyper
  source 1..45: mol_type = genomic DNA
taattatccaggcggggaaaaattccgggccggtaccgcccccac

SEQ ID NO: 21509 - DNA, 13 bp, Homo sapiens
  misc_feature 1..13: note = chr12:113905016-113905029
  misc_feature 1..13: note = hyper
  source 1..13: mol_type = genomic DNA
gaataggacaggt

SEQ ID NO: 21510 - DNA, 66 bp, Homo sapiens; identical to SEQ ID NO: 11426
  misc_feature 1..66: note = chr12:113905673-113905739
  misc_feature 1..66: note = hyper
  source 1..66: mol_type = genomic DNA

SEQ ID NO: 21511 - DNA, 122 bp, Homo sapiens; identical to SEQ ID NO: 11427
  misc_feature 1..122: note = chr12:113906312-113906434
  misc_feature 1..122: note = hyper
  source 1..122: mol_type = genomic DNA

SEQ ID NO: 21512 - DNA, 190 bp, Homo sapiens; identical to SEQ ID NO: 11428
  misc_feature 1..190: note = chr12:113909902-113910092
  misc_feature 1..190: note = hyper
  source 1..190: mol_type = genomic DNA

SEQ ID NO: 21513 - DNA, 157 bp, Homo sapiens; identical to SEQ ID NO: 11429
  misc_feature 1..157: note = chr12:113910529-113910686
  misc_feature 1..157: note = hyper
  source 1..157: mol_type = genomic DNA

SEQ ID NO: 21514 - DNA, 30 bp, Homo sapiens; identical to SEQ ID NO: 11430
  misc_feature 1..30: note = chr12:113913002-113913032
  misc_feature 1..30: note = hyper
  source 1..30: mol_type = genomic DNA

SEQ ID NO: 21515 - DNA, 174 bp, Homo sapiens
  misc_feature 1..174: note = chr12:113914050-113914224
  misc_feature 1..174: note = hyper
  source 1..174: mol_type = genomic DNA
tattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccgg

SEQ ID NO: 21516 - DNA, 35 bp, Homo sapiens; identical to SEQ ID NO: 11433
  misc_feature 1..35: note = chr12:113914300-113914335
  misc_feature 1..35: note = hyper
  source 1..35: mol_type = genomic DNA

SEQ ID NO: 21517 - DNA, 273 bp, Homo sapiens
  misc_feature 1..273: note = chr12:113916316-113916589
  misc_feature 1..273: note = hyper
  source 1..273: mol_type = genomic DNA
gtgtgtgtgtgtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccc

SEQ ID NO: 21518 - DNA, 84 bp, Homo sapiens; identical to SEQ ID NO: 11435
  misc_feature 1..84: note = chr12:113917379-113917463
  misc_feature 1..84: note = hyper
  source 1..84: mol_type = genomic DNA

SEQ ID NO: 21519 - DNA, 24 bp, Homo sapiens
  misc_feature 1..24: note = chr12:113917751-113917775
  misc_feature 1..24: note = hyper
  source 1..24: mol_type = genomic DNA
gcagtgacagtgaaacgaattcca

SEQ ID NO: 21520 - DNA, 170 bp, Homo sapiens; identical to SEQ ID NO: 11437
  misc_feature 1..170: note = chr12:113952952-113953122
  misc_feature 1..170: note = hyper
  source 1..170: mol_type = genomic DNA

SEQ ID NO: 21521 - DNA, 295 bp, Homo sapiens; identical to SEQ ID NO: 11438
  misc_feature 1..295: note = chr12:113957660-113957955
  misc_feature 1..295: note = hyper
  source 1..295: mol_type = genomic DNA

SEQ ID NO: 21522 - DNA, 66 bp, Homo sapiens; identical to SEQ ID NO: 11439
  misc_feature 1..66: note = chr12:114029765-114029831
  misc_feature 1..66: note = hyper
  source 1..66: mol_type = genomic DNA

SEQ ID NO: 21523 - DNA, 41 bp, Homo sapiens; identical to SEQ ID NO: 11440
  misc_feature 1..41: note = chr12:114075780-114075821
  misc_feature 1..41: note = hyper
  source 1..41: mol_type = genomic DNA

SEQ ID NO: 21524 - DNA, 12 bp, Homo sapiens
  misc_feature 1..12: note = chr12:114838726-114838738
  misc_feature 1..12: note = hyper
  source 1..12: mol_type = genomic DNA
ctccaccctccc

SEQ ID NO: 21525 - DNA, 48 bp, Homo sapiens
  misc_feature 1..48: note = chr12:114841084-114841132
  misc_feature 1..48: note = hyper
  source 1..48: mol_type = genomic DNA
gaggcaggaggaggcgggaggaggcgaaggctacggaagatcagaaga

SEQ ID NO: 21526 - DNA, 72 bp, Homo sapiens; identical to SEQ ID NO: 11445
  misc_feature 1..72: note = chr12:114843007-114843079
  misc_feature 1..72: note = hyper
  source 1..72: mol_type = genomic DNA

SEQ ID NO: 21527 - DNA, 260 bp, Homo sapiens
  misc_feature 1..260: note = chr12:114843285-114843545
  misc_feature 1..260: note = hyper
  source 1..260: mol_type = genomic DNA
cggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttact

SEQ ID NO: 21528 - DNA, 17 bp, Homo sapiens
  misc_feature 1..17: note = chr12:114844184-114844201
  misc_feature 1..17: note = hyper
  source 1..17: mol_type = genomic DNA
acaaatcatttcaaacg

SEQ ID NO: 21529 - DNA, 30 bp, Homo sapiens; identical to SEQ ID NO: 11448
  misc_feature 1..30: note = chr12:114846013-114846043
  misc_feature 1..30: note = hyper
  source 1..30: mol_type = genomic DNA

SEQ ID NO: 21530 - DNA, 244 bp, Homo sapiens
  misc_feature 1..244: note = chr12:114846471-114846715
  misc_feature 1..244: note = hyper
  source 1..244: mol_type = genomic DNA
cgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttg

SEQ ID NO: 21531 - DNA, 179 bp, Homo sapiens
  misc_feature 1..179: note = chr12:114846768-114846947
  misc_feature 1..179: note = hyper
  source 1..179: mol_type = genomic DNA
gcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 21532 - DNA, 30 bp, Homo sapiens; identical to SEQ ID NO: 11453
  misc_feature 1..30: note = chr12:114877303-114877333
  misc_feature 1..30: note = hyper
  source 1..30: mol_type = genomic DNA

SEQ ID NO: 21533 - DNA, 10 bp, Homo sapiens
  misc_feature 1..10: note = chr12:114878584-114878594
  misc_feature 1..10: note = hyper
  source 1..10: mol_type = genomic DNA
ggctaaatcc

SEQ ID NO: 21534 - skipped

SEQ ID NO: 21535 - DNA, 282 bp, Homo sapiens
  misc_feature 1..282: note = chr12:114881764-114882046
  misc_feature 1..282: note = hyper
  source 1..282: mol_type = genomic DNA
tccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgac

SEQ ID NO: 21536 - skipped

SEQ ID NO: 21537 - DNA, 38 bp, Homo sapiens; identical to SEQ ID NO: 11459
  misc_feature 1..38: note = chr12:115106464-115106502
  misc_feature 1..38: note = hyper
  source 1..38: mol_type = genomic DNA

SEQ ID NO: 21538 - DNA, 36 bp, Homo sapiens; identical to SEQ ID NO: 11460
  misc_feature 1..36: note = chr12:115121885-115121921
  misc_feature 1..36: note = hyper
  source 1..36: mol_type = genomic DNA

SEQ ID NO: 21539 - DNA, 261 bp, Homo sapiens; identical to SEQ ID NO: 11462
  misc_feature 1..261: note = chr12:117319805-117320066
  misc_feature 1..261: note = hyper
  source 1..261: mol_type = genomic DNA

SEQ ID NO: 21540 - DNA, 271 bp, Homo sapiens
  misc_feature 1..271: note = chr12:117798095-117798366
  misc_feature 1..271: note = hyper
  source 1..271: mol_type = genomic DNA
ggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagag

SEQ ID NO: 21541 - DNA, 83 bp, Homo sapiens
  misc_feature 1..83: note = chr12:117799330-117799413
  misc_feature 1..83: note = hyper
  source 1..83: mol_type = genomic DNA
cgctgctcgctgcccggccgcccctcggaggagccgcggcgctaagtagctcctcacccagcggctggaaacgcggcataaat

SEQ ID NO: 21542 - DNA, 58 bp, Homo sapiens; identical to SEQ ID NO: 3960
  misc_feature 1..58: note = chr12:119212142-119212200
  misc_feature 1..58: note = hyper
  source 1..58: mol_type = genomic DNA

SEQ ID NO: 21543 - DNA, 18 bp, Homo sapiens
  misc_feature 1..18: note = chr12:119418576-119418594
  misc_feature 1..18: note = hyper
  source 1..18: mol_type = genomic DNA
actctttcctctggacgg

SEQ ID NO: 21544 - DNA, 92 bp, Homo sapiens
  misc_feature 1..92: note = chr12:119418847-119418939
  misc_feature 1..92: note = hyper
  source 1..92: mol_type = genomic DNA
tgagggtctgggggaggccggctggggtggatagattaagttttttacgagcccccccaaccccccccccccccccacgcagaagatcagct

SEQ ID NO: 21545 - DNA, 254 bp, Homo sapiens
  misc_feature 1..254: note = chr12:119419466-119419720
  misc_feature 1..254: note = hyper
  source 1..254: mol_type = genomic DNA
acccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctt

SEQ ID NO: 21546 - DNA, 25 bp, Homo sapiens
  misc_feature 1..25: note = chr12:120032837-120032862
  misc_feature 1..25: note = hyper
  source 1..25: mol_type = genomic DNA
ctctctaggagtggccgctggggcc

SEQ ID NO: 21547 - DNA, 32 bp, Homo sapiens
  misc_feature 1..32: note = chr12:120033169-120033201
  misc_feature 1..32: note = hyper
  source 1..32: mol_type = genomic DNA
ccgcccacacttgcccacgggtggtggcacca

SEQ ID NO: 21548 - DNA, 30 bp, Homo sapiens; identical to SEQ ID NO: 11470
  misc_feature 1..30: note = chr12:120807882-120807912
  misc_feature 1..30: note = hyper
  source 1..30: mol_type = genomic DNA

SEQ ID NO: 21549 - DNA, 30 bp, Homo sapiens; identical to SEQ ID NO: 11471
  misc_feature 1..30: note = chr12:121566850-121566880
  misc_feature 1..30: note = hyper
  source 1..30: mol_type = genomic DNA

SEQ ID NO: 21550 - DNA, 372 bp, Homo sapiens; identical to SEQ ID NO: 11472
  misc_feature 1..372: note = chr12:122688669-122689041
  misc_feature 1..372: note = hyper
  source 1..372: mol_type = genomic DNA

SEQ ID NO: 21551 - DNA, 58 bp, Homo sapiens; identical to SEQ ID NO: 11473
  misc_feature 1..58: note = chr12:123920539-123920597
  misc_feature 1..58: note = hyper
  source 1..58: mol_type = genomic DNA

SEQ ID NO: 21552 - DNA, 72 bp, Homo sapiens; identical to SEQ ID NO: 11476
  misc_feature 1..72: note = chr12:125670334-125670406
  misc_feature 1..72: note = hyper
  source 1..72: mol_type = genomic DNA

SEQ ID NO: 21553 - DNA, 84 bp, Homo sapiens; identical to SEQ ID NO: 11477
  misc_feature 1..84: note = chr12:125671581-125671665
  misc_feature 1..84: note = hyper
  source 1..84: mol_type = genomic DNA

SEQ ID NO: 21554 - DNA, 128 bp, Homo sapiens; identical to SEQ ID NO: 11478
  misc_feature 1..128: note = chr12:125672764-125672892
  misc_feature 1..128: note = hyper
  source 1..128: mol_type = genomic DNA

SEQ ID NO: 21555 - DNA, 49 bp, Homo sapiens
  misc_feature 1..49: note = chr12:126168505-126168554
  misc_feature 1..49: note = hyper
  source 1..49: mol_type = genomic DNA
tggaggctgggccagcgttgcgagtcttgccagggacgcgcgctctagc

SEQ ID NO: 21556 - skipped

SEQ ID NO: 21557 - DNA, 30 bp, Homo sapiens; identical to SEQ ID NO: 11480
  misc_feature 1..30: note = chr12:126675806-126675836
  misc_feature 1..30: note = hyper
  source 1..30: mol_type = genomic DNA

SEQ ID NO: 21558 - DNA, 30 bp, Homo sapiens; identical to SEQ ID NO: 11481
  misc_feature 1..30: note = chr12:127212512-127212542
  misc_feature 1..30: note = hyper
  source 1..30: mol_type = genomic DNA

SEQ ID NO: 21559 - DNA, 17 bp, Homo sapiens
  misc_feature 1..17: note = chr12:127765432-127765449
  misc_feature 1..17: note = hyper
  source 1..17: mol_type = genomic DNA
cacgaggggccgacagg

SEQ ID NO: 21560 - DNA, 127 bp, Homo sapiens; identical to SEQ ID NO: 11483
  misc_feature 1..127: note = chr12:127865735-127865862
  misc_feature 1..127: note = hyper
  source 1..127: mol_type = genomic DNA

SEQ ID NO: 21561 - DNA, 44 bp, Homo sapiens
  misc_feature 1..44: note = chr12:128751340-128751384
  misc_feature 1..44: note = hyper
  source 1..44: mol_type = genomic DNA
cagctccgccttgagcgtcgggtccctgggcaggaccctccggg

SEQ ID NO: 21562 - DNA, 27 bp, Homo sapiens
  misc_feature 1..27: note = chr12:128752240-128752267
  misc_feature 1..27: note = hyper
  source 1..27: mol_type = genomic DNA
ggtcccgagtcccgaatctcccacccc

SEQ ID NO: 21563 - DNA, 266 bp, Homo sapiens
  misc_feature 1..266: note = chr12:128752944-128753210
  misc_feature 1..266: note = hyper
  source 1..266: mol_type = genomic DNA
ggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgag

SEQ ID NO: 21564 - DNA, 53 bp, Homo sapiens; identical to SEQ ID NO: 1075
  misc_feature 1..53: note = chr12:129337857-129337910
  misc_feature 1..53: note = hyper
  source 1..53: mol_type = genomic DNA

SEQ ID NO: 21565 - DNA, 10 bp, Homo sapiens
  misc_feature 1..10: note = chr12:129338816-129338826
  misc_feature 1..10: note = hyper
  source 1..10: mol_type = genomic DNA
gcgttaatcc

SEQ ID NO: 21566 - DNA, 55 bp, Homo sapiens; identical to SEQ ID NO: 1077
  misc_feature 1..55: note = chr12:129338851-129338906
  misc_feature 1..55: note = hyper
  source 1..55: mol_type = genomic DNA

SEQ ID NO: 21567 - DNA, 103 bp, Homo sapiens
  misc_feature 1..103: note = chr12:130387811-130387914
  misc_feature 1..103: note = hyper
  source 1..103: mol_type = genomic DNA
aaaacagggcggccaggctgatgagtaccggcgaccagtggtgccacagcgtccccatctcagacgggcacatcctggagacccggagcgcagatcctccgct

SEQ ID NO: 21568 - DNA, 131 bp, Homo sapiens
  misc_feature 1..131: note = chr12:130388279-130388410
  misc_feature 1..131: note = hyper
  source 1..131: mol_type = genomic DNA
gctagcgggcgctggcgcaggcggcgccggggtggcggggctgcggagcccgggacgcgggcagaggcggctcggagccccccgggcgggtggccgggctcgctgggcggcccggggctccctggcccgca

SEQ ID NO: 21569 - DNA, 42 bp, Homo sapiens; identical to SEQ ID NO: 11494
  misc_feature 1..42: note = chr12:130526846-130526888
  misc_feature 1..42: note = hyper
  source 1..42: mol_type = genomic DNA

SEQ ID NO: 21570 - DNA, 121 bp, Homo sapiens; identical to SEQ ID NO: 11495
  misc_feature 1..121: note = chr12:130526931-130527052
  misc_feature 1..121: note = hyper
  source 1..121: mol_type = genomic DNA

SEQ ID NO: 21571 - DNA, 43 bp, Homo sapiens
  misc_feature 1..43: note = chr12:130589266-130589309
  misc_feature 1..43: note = hyper
  source 1..43: mol_type = genomic DNA
ttcagccctaagctcaaagccggagctccgaccagcactctca

SEQ ID NO: 21572 - DNA, 30 bp, Homo sapiens; identical to SEQ ID NO: 11498
  misc_feature 1..30: note = chr12:130646183-130646213
  misc_feature 1..30: note = hyper
  source 1..30: mol_type = genomic DNA

SEQ ID NO: 21573 - DNA, 21 bp, Homo sapiens
  misc_feature 1..21: note = chr12:130646633-130646654
  misc_feature 1..21: note = hyper
  source 1..21: mol_type = genomic DNA
cgccgggaaagggggcgccgg

SEQ ID NO: 21574 - DNA, 77 bp, Homo sapiens; identical to SEQ ID NO: 11503
  misc_feature 1..77: note = chr12:132312753-132312830
  misc_feature 1..77: note = hyper
  source 1..77: mol_type = genomic DNA

SEQ ID NO: 21575 - DNA, 33 bp, Homo sapiens; identical to SEQ ID NO: 11504
  misc_feature 1..33: note = chr12:132312856-132312889
  misc_feature 1..33: note = hyper
  source 1..33: mol_type = genomic DNA

SEQ ID NO: 21576 - DNA, 298 bp, Homo sapiens; identical to SEQ ID NO: 11505
  misc_feature 1..298: note = chr12:132313288-132313586
  misc_feature 1..298: note = hyper
  source 1..298: mol_type = genomic DNA

SEQ ID NO: 21577 - DNA, 78 bp, Homo sapiens; identical to SEQ ID NO: 11506
  misc_feature 1..78: note = chr12:133194973-133195051
  misc_feature 1..78: note = hyper
  source 1..78: mol_type = genomic DNA

SEQ ID NO: 21578 - DNA, 30 bp, Homo sapiens; identical to SEQ ID NO: 11507
  misc_feature 1..30: note = chr12:133195488-133195518
  misc_feature 1..30: note = hyper
  source 1..30: mol_type = genomic DNA

SEQ ID NO: 21579 - DNA, 33 bp, Homo sapiens; identical to SEQ ID NO: 11508
  misc_feature 1..33: note = chr12:133463690-133463723
  misc_feature 1..33: note = hyper
  source 1..33: mol_type = genomic DNA

SEQ ID NO: 21580 - DNA, 61 bp, Homo sapiens; identical to SEQ ID NO: 11509
  misc_feature 1..61: note = chr12:133464480-133464541
  misc_feature 1..61: note = hyper
  source 1..61: mol_type = genomic DNA

SEQ ID NO: 21581 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 21582 - DNA, 118 bp, Homo sapiens
  misc_feature 1..118: note = chr12:133485439-133485557
  misc_feature 1..118: note = hyper
  source 1..118: mol_type = genomic DNA
cgcctcgggccgtccccgcccagacgcttgtccccgcgagaagctgagcgcactgaagtgagcccggcggctgccgccggaggaggagcccggctctggacacggccgtcaggaagct

SEQ ID NO: 21583 - DNA, 67 bp, Homo sapiens; identical to SEQ ID NO: 11515
  misc_feature 1..67: note = chr13:20735465-20735532
  misc_feature 1..67: note = hyper
  source 1..67: mol_type = genomic DNA

SEQ ID NO: 21584 - DNA, 271 bp, Homo sapiens
  misc_feature 1..271: note = chr13:20735533-20735804
  misc_feature 1..271: note = hyper
  source 1..271: mol_type = genomic DNA
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgg

SEQ ID NO: 21585 - DNA, 30 bp, Homo sapiens; identical to SEQ ID NO: 11517
  misc_feature 1..30: note = chr13:20805970-20806000
  misc_feature 1..30: note = hyper
  source 1..30: mol_type = genomic DNA

SEQ ID NO: 21586 - DNA, 43 bp, Homo sapiens; identical to SEQ ID NO: 11518
  misc_feature 1..43: note = chr13:21520313-21520356
  misc_feature 1..43: note = hyper
  source 1..43: mol_type = genomic DNA

SEQ ID NO: 21587 - DNA, 30 bp, Homo sapiens; identical to SEQ ID NO: 11519
  misc_feature 1..30: note = chr13:21634799-21634829
  misc_feature 1..30: note = hyper
  source 1..30: mol_type = genomic DNA

SEQ ID NO: 21588 - DNA, 13 bp, Homo sapiens
  misc_feature 1..13: note = chr13:21649623-21649636
  misc_feature 1..13: note = hyper
  source 1..13: mol_type = genomic DNA
aaataatcacaga

SEQ ID NO: 21589 - DNA, 267 bp, Homo sapiens
  misc_feature 1..267: note = chr13:21649775-21650042
  misc_feature 1..267: note = hyper
  source 1..267: mol_type = genomic DNA
gggcgcggagcctgcgccagcttcacaaaagcggtgtggacgcctgagccagtccgctcttgctggacggctccccatagtttagcccaaaaatccccctctgggtggctctggcaggagtgatttagggccacaattaggttggacgaggagtggggacttgccccgagctgcctttgcagacccggcggcggcgttctccccaaggctgcccgcttggctgcgcggctgaggcgagttgaggacccagcccgtccccaactctcc

SEQ ID NO: 21590 - DNA, 123 bp, Homo sapiens
  misc_feature 1..123: note = chr13:23489728-23489851
  misc_feature 1..123: note = hyper
  source 1..123: mol_type = genomic DNA
aaagccgtagcgccacgggagtgggcgggagggagagggggtacccgagggccacaagagtatgacggggctgtaagagctggtgtggcgggtgctgcccccctgctctgtctgcaccgcaag

SEQ ID NO: 21591 - DNA, 57 bp, Homo sapiens
  misc_feature 1..57: note = chr13:23489914-23489971
  misc_feature 1..57: note = hyper
  source 1..57: mol_type = genomic DNA
gccgcctctgccgcggtcctagcgccgctcggcttcacgctccgcaagtcccaggcg

SEQ ID NO: 21592 - DNA, 90 bp, Homo sapiens
  misc_feature 1..90: note = chr13:23734020-23734110
  misc_feature 1..90: note = hyper
  source 1..90: mol_type = genomic DNA
gaggggctcggagtgggagtgcaggggtgcggggagggagtgcagggacgcggggagggagtggaggggtggggacgtgctggaggggcg

SEQ ID NO: 21593 - DNA, 59 bp, Homo sapiens; identical to SEQ ID NO: 11524
  misc_feature 1..59: note = chr13:24153660-24153719
  misc_feature 1..59: note = hyper
  source 1..59: mol_type = genomic DNA

SEQ ID NO: 21594 - DNA, 30 bp, Homo sapiens
  misc_feature 1..30: note = chr13:24477613-24477643
  misc_feature 1..30: note = hyper
  source 1..30: mol_type = genomic DNA
aggatccaattagtccgtgtaaaatgagag

SEQ ID NO: 21595 - DNA, 138 bp, Homo sapiens; identical to SEQ ID NO: 11526
  misc_feature 1..138: note = chr13:25255004-25255142
  misc_feature 1..138: note = hyper
  source 1..138: mol_type = genomic DNA

SEQ ID NO: 21596 - DNA, 26 bp, Homo sapiens
  misc_feature 1..26: note = chr13:25319830-25319856
  misc_feature 1..26: note = hyper
  source 1..26: mol_type = genomic DNA
ccagaacaacgagggcgacgaagaca

SEQ ID NO: 21597 - DNA, 349 bp, Homo sapiens
  misc_feature 1..349: note = chr13:25321350-25321699
  misc_feature 1..349: note = hyper
  source 1..349: mol_type = genomic DNA
ggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaag

SEQ ID NO: 21598 - DNA, 242 bp, Homo sapiens
  misc_feature 1..242: note = chr13:25321942-25322184
  misc_feature 1..242: note = hyper
  source 1..242: mol_type = genomic DNA
cagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgac

SEQ ID NO: 21599 - DNA, 32 bp, Homo sapiens; identical to SEQ ID NO: 11531
  misc_feature 1..32: note = chr13:25620922-25620954
  misc_feature 1..32: note = hyper
  source 1..32: mol_type = genomic DNA

SEQ ID NO: 21600 - DNA, 13 bp, Homo sapiens
  misc_feature 1..13: note = chr13:25620955-25620968
  misc_feature 1..13: note = hyper
  source 1..13: mol_type = genomic DNA
aggagccctggag

SEQ ID NO: 21601 - skipped

SEQ ID NO: 21602 - DNA, 39 bp, Homo sapiens; identical to SEQ ID NO: 11537
  misc_feature 1..39: note = chr13:25945978-25946017
  misc_feature 1..39: note = hyper
  source 1..39: mol_type = genomic DNA

SEQ ID NO: 21603 - DNA, 18 bp, Homo sapiens
  misc_feature 1..18: note = chr13:25946801-25946819
  misc_feature 1..18: note = hyper
  source 1..18: mol_type = genomic DNA
cggcgcagagaagatgca

SEQ ID NO: 21604 - DNA, 30 bp, Homo sapiens; identical to SEQ ID NO: 11543
  misc_feature 1..30: note = chr13:26624792-26624822
  misc_feature 1..30: note = hyper
  source 1..30: mol_type = genomic DNA

SEQ ID NO: 21605 - DNA, 30 bp, Homo sapiens; identical to SEQ ID NO: 11545
  misc_feature 1..30: note = chr13:27050496-27050526
  misc_feature 1..30: note = hyper
  source 1..30: mol_type = genomic DNA

SEQ ID NO: 21606 - DNA, 168 bp, Homo sapiens; identical to SEQ ID NO: 11546
  misc_feature 1..168: note = chr13:27131553-27131721
  misc_feature 1..168: note = hyper
  source 1..168: mol_type = genomic DNA

SEQ ID NO: 21607 - DNA, 308 bp, Homo sapiens; identical to SEQ ID NO: 11547
  misc_feature 1..308: note = chr13:27132002-27132310
  misc_feature 1..308: note = hyper
  source 1..308: mol_type = genomic DNA

SEQ ID NO: 21608 - DNA, 107 bp, Homo sapiens; identical to SEQ ID NO: 11548
  misc_feature 1..107: note = chr13:27132629-27132736
  misc_feature 1..107: note = hyper
  source 1..107: mol_type = genomic DNA

SEQ ID NO: 21609 - DNA, 160 bp, Homo sapiens
  misc_feature 1..160: note = chr13:27334563-27334723
  misc_feature 1..160: note = hyper
  source 1..160: mol_type = genomic DNA
tgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctc

SEQ ID NO: 21610 - DNA, 48 bp, Homo sapiens
  misc_feature 1..48: note = chr13:27334724-27334772
  misc_feature 1..48: note = hyper
  source 1..48: mol_type = genomic DNA
cccaggccgagggggctcctccggtgcttccgaagcgcgtgggctact

SEQ ID NO: 21611 - DNA, 68 bp, Homo sapiens
  misc_feature 1..68: note = chr13:27334894-27334962
  misc_feature 1..68: note = hyper
  source 1..68: mol_type = genomic DNA
agcagcctcggctcgcgcgcccagctttccccgccgcgcccgcccggcccacacgctccccgcgcgcg

SEQ ID NO: 21612 - DNA, 30 bp, Homo sapiens; identical to SEQ ID NO: 11551
  misc_feature 1..30: note = chr13:28363673-28363703
  misc_feature 1..30: note = hyper
  source 1..30: mol_type = genomic DNA

SEQ ID NO: 21613 - DNA, 46 bp, Homo sapiens
  misc_feature 1..46: note = chr13:28365659-28365705
  misc_feature 1..46: note = hyper
  source 1..46: mol_type = genomic DNA
gcagcggtttcccagcgcactgctggaagtgtgctccagtagacag

SEQ ID NO: 21614 - DNA, 19 bp, Homo sapiens
  misc_feature 1..19: note = chr13:28367005-28367024
  misc_feature 1..19: note = hyper
  source 1..19: mol_type = genomic DNA
tctgcgtcaccgcctcgca

SEQ ID NO: 21615 - DNA, 69 bp, Homo sapiens
  misc_feature 1..69: note = chr13:28368168-28368237
  misc_feature 1..69: note = hyper
  source 1..69: mol_type = genomic DNA
acccgcagccaaaccactgcctggcatggatttggcactgctttgcagaggtcccgggcctgggcaggg

SEQ ID NO: 21616 - DNA, 21 bp, Homo sapiens
  misc_feature 1..21: note = chr13:28369990-28370011
  misc_feature 1..21: note = hyper
  source 1..21: mol_type = genomic DNA
gaaagacggtccacctgaggt

SEQ ID NO: 21617 - DNA, 301 bp, Homo sapiens
  misc_feature 1..301: note = chr13:28371061-28371362
  misc_feature 1..301: note = hyper
  source 1..301: mol_type = genomic DNA
acctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagtttt

SEQ ID NO: 21618 - DNA, 23 bp, Homo sapiens
  misc_feature 1..23: note = chr13:28394743-28394766
  misc_feature 1..23: note = hyper
  source 1..23: mol_type = genomic DNA
ccaggcagagagggccggaaagg

SEQ ID NO: 21619 - DNA, 246 bp, Homo sapiens
  misc_feature 1..246: note = chr13:28395255-28395501
  misc_feature 1..246: note = hyper
  source 1..246: mol_type = genomic DNA
gttttcagtcaaatgcgcaaagccaggtggctcctttaacacccccagagattgtccccatgatctcctctgcgccatggggcgctgggtgctgggggcgccgtctgtatcctctgcctggtaactgcccccatcgcgccccactgcgccccagcccaggctggaaaactgggccaacagggaggcttggatggggggaaacccagcctgaggctggaaacggctagaagtgaacgggacgagtgg

SEQ ID NO: 21620 - DNA, 104 bp, Homo sapiens
  misc_feature 1..104: note = chr13:28395553-28395657
  misc_feature 1..104: note = hyper
  source 1..104: mol_type = genomic DNA
gaactttacgcaagataggcgagaggggtggccgcactaaaagaaaaagaaaaattaaaaaaaaagacattccaactactttatccttgcgcagggaccccttc

SEQ ID NO: 21621 - DNA, 140 bp, Homo sapiens; identical to SEQ ID NO: 11563
  misc_feature 1..140: note = chr13:28396578-28396718
  misc_feature 1..140: note = hyper
  source 1..140: mol_type = genomic DNA

SEQ ID NO: 21622 - DNA, 30 bp, Homo sapiens; identical to SEQ ID NO: 11564
  misc_feature 1..30: note = chr13:28397439-28397469
  misc_feature 1..30: note = hyper
  source 1..30: mol_type = genomic DNA

SEQ ID NO: 21623 - DNA, 43 bp, Homo sapiens
  misc_feature 1..43: note = chr13:28491946-28491989
  misc_feature 1..43: note = hyper
  source 1..43: mol_type = genomic DNA
ctgagagcctcttttctttctgcagggccgagcaaaaatatta

SEQ ID NO: 21624 - DNA, 36 bp, Homo sapiens; identical to SEQ ID NO: 11568
  misc_feature 1..36: note = chr13:28527866-28527902
  misc_feature 1..36: note = hyper
  source 1..36: mol_type = genomic DNA

SEQ ID NO: 21625 - DNA, 309 bp, Homo sapiens
  misc_feature 1..309: note = chr13:28528225-28528534
  misc_feature 1..309: note = hyper
  source 1..309: mol_type = genomic DNA
cggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttc

SEQ ID NO: 21626 - DNA, 117 bp, Homo sapiens; identical to SEQ ID NO: 11570
  misc_feature 1..117: note = chr13:28535406-28535523
  misc_feature 1..117: note = hyper
  source 1..117: mol_type = genomic DNA

SEQ ID NO: 21627 - DNA, 37 bp, Homo sapiens; identical to SEQ ID NO: 11571
  misc_feature 1..37: note = chr13:28541213-28541250
  misc_feature 1..37: note = hyper
  source 1..37: mol_type = genomic DNA

SEQ ID NO: 21628 - DNA, 50 bp, Homo sapiens; identical to SEQ ID NO: 11572
  misc_feature 1..50: note = chr13:28542677-28542727
  misc_feature 1..50: note = hyper
  source 1..50: mol_type = genomic DNA

SEQ ID NO: 21629 - DNA, 33 bp, Homo sapiens; identical to SEQ ID NO: 11573
  misc_feature 1..33: note = chr13:28542728-28542761
  misc_feature 1..33: note = hyper
  source 1..33: mol_type = genomic DNA

SEQ ID NO: 21630 - DNA, 137 bp, Homo sapiens; identical to SEQ ID NO: 11574
  misc_feature 1..137: note = chr13:28542969-28543106
  misc_feature 1..137: note = hyper
  source 1..137: mol_type = genomic DNA

SEQ ID NO: 21631 - DNA, 58 bp, Homo sapiens; identical to SEQ ID NO: 11575
  misc_feature 1..58: note = chr13:28543378-28543436
  misc_feature 1..58: note = hyper
  source 1..58: mol_type = genomic DNA

SEQ ID NO: 21632 - skipped

SEQ ID NO: 21633 - DNA, 132 bp, Homo sapiens
  misc_feature 1..132: note = chr13:28551285-28551417
  misc_feature 1..132: note = hyper
  source 1..132: mol_type = genomic DNA
tgtggtgggctcctccgcaggatgctaatgtactttcccccagtggacagtctggctgctggtacaggaagctgcccagcctaataggggtctgaaactccagggctgacaagcaaagatttctatgggcac

SEQ ID NO: 21634 - DNA, 88 bp, Homo sapiens
  misc_feature 1..88: note = chr13:28551461-28551549
  misc_feature 1..88: note = hyper
  source 1..88: mol_type = genomic DNA
tccaaatacccagcgctgctcaatgttactattttaataactgatgggtttcccggggcagtcgagccacccccccaaagccgacctc

SEQ ID NO: 21635 - DNA, 37 bp, Homo sapiens; identical to SEQ ID NO: 4004
  misc_feature 1..37: note = chr13:28551658-28551695
  misc_feature 1..37: note = hyper
  source 1..37: mol_type = genomic DNA

SEQ ID NO: 21636 - DNA, 37 bp, Homo sapiens
  misc_feature 1..37: note = chr13:28552167-28552204
  misc_feature 1..37: note = hyper
  source 1..37: mol_type = genomic DNA
cccaggacgcacagctccgggccgtggcccccgcgcg

SEQ ID NO: 21637 - DNA, 30 bp, Homo sapiens; identical to SEQ ID NO: 11583
  misc_feature 1..30: note = chr13:28553143-28553173
  misc_feature 1..30: note = hyper
  source 1..30: mol_type = genomic DNA

SEQ ID NO: 21638 - DNA, 422 bp, Homo sapiens
  misc_feature 1..422: note = chr13:28674734-28675156
  misc_feature 1..422: note = hyper
  source 1..422: mol_type = genomic DNA
tcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccg

SEQ ID NO: 21639 - DNA, 510 bp, Homo sapiens
  misc_feature 1..510: note = chr13:29068416-29068926
  misc_feature 1..510: note = hyper
  source 1..510: mol_type = genomic DNA
cggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaag

SEQ ID NO: 21640 - DNA, 110 bp, Homo sapiens
  misc_feature 1..110: note = chr13:29069065-29069175
  misc_feature 1..110: note = hyper
  source 1..110: mol_type = genomic DNA
cgccgccggccccgcgccctgagcgcccgtctcgcggctccagccaggagacaaccacttccccgggtaatcctcgccgccaggcgcccgctggccgctgcacccgagcc

SEQ ID NO: 21641 - DNA, 32 bp, Homo sapiens; identical to SEQ ID NO: 11588
  misc_feature 1..32: note = chr13:29069551-29069583
  misc_feature 1..32: note = hyper
  source 1..32: mol_type = genomic DNA

SEQ ID NO: 21642 - DNA, 44 bp, Homo sapiens; identical to SEQ ID NO: 11592
  misc_feature 1..44: note = chr13:29393656-29393700
  misc_feature 1..44: note = hyper
  source 1..44: mol_type = genomic DNA

SEQ ID NO: 21643 - DNA, 62 bp, Homo sapiens; identical to SEQ ID NO: 11593
  misc_feature 1..62: note = chr13:29394849-29394911
  misc_feature 1..62: note = hyper
  source 1..62: mol_type = genomic DNA

SEQ ID NO: 21644 - DNA, 81 bp, Homo sapiens
  misc_feature 1..81: note = chr13:33591219-33591300
  misc_feature 1..81: note = hyper
  source 1..81: mol_type = genomic DNA
ccacttcagggattacgcggagctctgcttccgccacttcggcggtcaggtcaagtactggatcaccatcgacaaccccta

SEQ ID NO: 21645 - DNA, 12 bp, Homo sapiens
  misc_feature 1..12: note = chr13:33591419-33591431
  misc_feature 1..12: note = hyper
  source 1..12: mol_type = genomic DNA
agggccacgcag

SEQ ID NO: 21646 - skipped

SEQ ID NO: 21647 - DNA, 30 bp, Homo sapiens; identical to SEQ ID NO: 11596
  misc_feature 1..30: note = chr13:36729247-36729277
  misc_feature 1..30: note = hyper
  source 1..30: mol_type = genomic DNA

SEQ ID NO: 21648 - DNA, 68 bp, Homo sapiens; identical to SEQ ID NO: 11597
  misc_feature 1..68: note = chr13:36919889-36919957
  misc_feature 1..68: note = hyper
  source 1..68: mol_type = genomic DNA

SEQ ID NO: 21649 - DNA, 30 bp, Homo sapiens
  misc_feature 1..30: note = chr13:36920598-36920628
  misc_feature 1..30: note = hyper
  source 1..30: mol_type = genomic DNA
tcccgccacagagcccgcagcacgccgccg

SEQ ID NO: 21650 - DNA, 108 bp, Homo sapiens; identical to SEQ ID NO: 4013
  misc_feature 1..108: note = chr13:37005473-37005581
  misc_feature 1..108: note = hyper
  source 1..108: mol_type = genomic DNA

SEQ ID NO: 21651 - DNA, 30 bp, Homo sapiens; identical to SEQ ID NO: 11602
  misc_feature 1..30: note = chr13:37248608-37248638
  misc_feature 1..30: note = hyper
  source 1..30: mol_type = genomic DNA

SEQ ID NO: 21652 - DNA, 124 bp, Homo sapiens; identical to SEQ ID NO: 11604
  misc_feature 1..124: note = chr13:39261149-39261273
  misc_feature 1..124: note = hyper
  source 1..124: mol_type = genomic DNA

SEQ ID NO: 21653 - DNA, 112 bp, Homo sapiens; identical to SEQ ID NO: 11605
  misc_feature 1..112: note = chr13:39262129-39262241
  misc_feature 1..112: note = hyper
  source 1..112: mol_type = genomic DNA

SEQ ID NO: 21654 - DNA, 188 bp, Homo sapiens
  misc_feature 1..188: note = chr13:43566059-43566247
  misc_feature 1..188: note = hyper
  source 1..188: mol_type = genomic DNA
agtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcg

SEQ ID NO: 21655 - DNA, 62 bp, Homo sapiens; identical to SEQ ID NO: 11607
  misc_feature 1..62: note = chr13:44360732-44360794
  misc_feature 1..62: note = hyper
  source 1..62: mol_type = genomic DNA

SEQ ID NO: 21656 - skipped

SEQ ID NO: 21657 - DNA, 279 bp, Homo sapiens
  misc_feature 1..279: note = chr13:44948197-44948476
  misc_feature 1..279: note = hyper
  source 1..279: mol_type = genomic DNA
aagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctggg

SEQ ID NO: 21658 - DNA, 67 bp, Homo sapiens; identical to SEQ ID NO: 11609
  misc_feature 1..67: note = chr13:46189867-46189934
  misc_feature 1..67: note = hyper
  source 1..67: mol_type = genomic DNA

SEQ ID NO: 21659 - skipped

SEQ ID NO: 21660 - DNA, 60 bp, Homo sapiens
  misc_feature 1..60: note = chr13:46961533-46961593
  misc_feature 1..60: note = hyper
  source 1..60: mol_type = genomic DNA
atggaagaaactctggagatgcgcgctcctacaccggtgccgcggcgcccgggcccagca

SEQ ID NO: 21661 - DNA, 106 bp, Homo sapiens; identical to SEQ ID NO: 11612
  misc_feature 1..106: note = chr13:50070552-50070658
  misc_feature 1..106: note = hyper
  source 1..106: mol_type = genomic DNA

SEQ ID NO: 21662 - DNA, 30 bp, Homo sapiens; identical to SEQ ID NO: 11613
  misc_feature 1..30: note = chr13:52979780-52979810
  misc_feature 1..30: note = hyper
  source 1..30: mol_type = genomic DNA

SEQ ID NO: 21663 - DNA, 43 bp, Homo sapiens; identical to SEQ ID NO: 11614
  misc_feature 1..43: note = chr13:52980066-52980109
  misc_feature 1..43: note = hyper
  source 1..43: mol_type = genomic DNA

SEQ ID NO: 21664 - DNA, 13 bp, Homo sapiens
  misc_feature 1..13: note = chr13:53312978-53312991
  misc_feature 1..13: note = hyper
  source 1..13: mol_type = genomic DNA
cttgcttttctac

SEQ ID NO: 21665 - DNA, 32 bp, Homo sapiens; identical to SEQ ID NO: 11620
  misc_feature 1..32: note = chr13:53422842-53422874
  misc_feature 1..32: note = hyper
  source 1..32: mol_type = genomic DNA

SEQ ID NO: 21666 - DNA, 30 bp, Homo sapiens; identical to SEQ ID NO: 11621
  misc_feature 1..30: note = chr13:53423168-53423198
  misc_feature 1..30: note = hyper
  source 1..30: mol_type = genomic DNA

SEQ ID NO: 21667 - DNA, 68 bp, Homo sapiens
  misc_feature 1..68: note = chr13:53423978-53424046
  misc_feature 1..68: note = hyper
  source 1..68: mol_type = genomic DNA
accatctgcttaggaaagtgtggagcttcggcactgccaaaatctgggctgggcggatcctggggctg

SEQ ID NO: 21668 - DNA, 207 bp, Homo sapiens
  misc_feature 1..207: note = chr13:58203644-58203851
  misc_feature 1..207: note = hyper
  source 1..207: mol_type = genomic DNA
acacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttat

SEQ ID NO: 21669 - DNA, 111 bp, Homo sapiens
  misc_feature 1..111: note = chr13:58204239-58204350
  misc_feature 1..111: note = hyper
  source 1..111: mol_type = genomic DNA
tcagtcagcaagagacgctggggagagagcagggatcgcgagcccggcggatgcggcagcggcggaaggcggctggggagacgctactccaactgttgaattgaattttca

SEQ ID NO: 21670 - DNA, 153 bp, Homo sapiens
  misc_feature 1..153: note = chr13:58205889-58206042
  misc_feature 1..153: note = hyper
  source 1..153: mol_type = genomic DNA
ctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcag

SEQ ID NO: 21671 - DNA, 161 bp, Homo sapiens
  misc_feature 1..161: note = chr13:58208334-58208495
  misc_feature 1..161: note = hyper
  source 1..161: mol_type = genomic DNA
tgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctat

SEQ ID NO: 21672 - DNA, 69 bp, Homo sapiens; identical to SEQ ID NO: 11630
  misc_feature 1..69: note = chr13:67804675-67804744
  misc_feature 1..69: note = hyper
  source 1..69: mol_type = genomic DNA

SEQ ID NO: 21673 - DNA, 23 bp, Homo sapiens
  misc_feature 1..23: note = chr13:67804745-67804768
  misc_feature 1..23: note = hyper
  source 1..23: mol_type = genomic DNA
cgctggcgctccccaggcccggg

SEQ ID NO: 21674 - DNA, 236 bp, Homo sapiens; identical to SEQ ID NO: 11632
  misc_feature 1..236: note = chr13:67804863-67805099
  misc_feature 1..236: note = hyper
  source 1..236: mol_type = genomic DNA

SEQ ID NO: 21675 - DNA, 30 bp, Homo sapiens; identical to SEQ ID NO: 11635
  misc_feature 1..30: note = chr13:74707261-74707291
  misc_feature 1..30: note = hyper
  source 1..30: mol_type = genomic DNA

SEQ ID NO: 21676 - DNA, 130 bp, Homo sapiens; identical to SEQ ID NO: 11636
  misc_feature 1..130: note = chr13:75149921-75150051
  misc_feature 1..130: note = hyper
  source 1..130: mol_type = genomic DNA

SEQ ID NO: 21677 - DNA, 56 bp, Homo sapiens
  misc_feature 1..56: note = chr13:78493110-78493166
  misc_feature 1..56: note = hyper
  source 1..56: mol_type = genomic DNA
agcgtgcgtgggaaccgcggaattaaggcacctagaggccaagggcttgtgtcaag

SEQ ID NO: 21678 - DNA, 125 bp, Homo sapiens
  misc_feature 1..125: note = chr13:78493809-78493934
  misc_feature 1..125: note = hyper
  source 1..125: mol_type = genomic DNA
ctttccccttgggcgatgcctggacagcatcagtagtagttgcccgagggaggggggcagtcctcgtccggggacaggtcccaaaaggctgtttatttgttagagttctacgctcttcaaatgaa

SEQ ID NO: 21679 - DNA, 35 bp, Homo sapiens; identical to SEQ ID NO: 11639
  misc_feature 1..35: note = chr13:79161007-79161042
  misc_feature 1..35: note = hyper
  source 1..35: mol_type = genomic DNA

SEQ ID NO: 21680 - DNA, 68 bp, Homo sapiens
  misc_feature 1..68: note = chr13:79175702-79175770
  misc_feature 1..68: note = hyper
  source 1..68: mol_type = genomic DNA
ggagcgcttctcgggcgcggcgatggaagtccgcttgcgcttcttctcgccgccgttgaagagctcag

SEQ ID NO: 21681 - DNA, 49 bp, Homo sapiens
  misc_feature 1..49: note = chr13:79176783-79176832
  misc_feature 1..49: note = hyper
  source 1..49: mol_type = genomic DNA
gcgaagggcaaacacaaagcaaccaaaataacaacgggtttgggggcag

SEQ ID NO: 21682 - DNA, 62 bp, Homo sapiens
  misc_feature 1..62: note = chr13:79177998-79178060
  misc_feature 1..62: note = hyper
  source 1..62: mol_type = genomic DNA
tcagaaggtccagctattgtctaagggtgggcaccttttagaataaaaaagacgagatgcgc

SEQ ID NO: 21683 - DNA, 60 bp, Homo sapiens; identical to SEQ ID NO: 11649
  misc_feature 1..60: note = chr13:79182844-79182904
  misc_feature 1..60: note = hyper
  source 1..60: mol_type = genomic DNA

SEQ ID NO: 21684 - skipped

SEQ ID NO: 21685 - DNA, 236 bp, Homo sapiens; identical to SEQ ID NO: 11652
  misc_feature 1..236: note = chr13:84456111-84456347
  misc_feature 1..236: note = hyper
  source 1..236: mol_type = genomic DNA

SEQ ID NO: 21686 - DNA, 111 bp, Homo sapiens
  misc_feature 1..111: note = chr13:88323468-88323579
  misc_feature 1..111: note = hyper
  source 1..111: mol_type = genomic DNA
ctccctttcccaatccgagaattgcacagtcccacgctcgaattacacacatggtccaagacttctctctcttcctacgaatgtgacatccaagggggccccggttgcgcc

SEQ ID NO: 21687 - DNA, 174 bp, Homo sapiens
  misc_feature 1..174: note = chr13:88324342-88324516
  misc_feature 1..174: note = hyper
  source 1..174: mol_type = genomic DNA
gggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgc

SEQ ID NO: 21688 - DNA, 30 bp, Homo sapiens; identical to SEQ ID NO: 11655
  misc_feature 1..30: note = chr13:88325619-88325649
  misc_feature 1..30: note = hyper
  source 1..30: mol_type = genomic DNA

SEQ ID NO: 21689 - DNA, 31 bp, Homo sapiens
  misc_feature 1..31: note = chr13:92051108-92051139
  misc_feature 1..31: note = hyper
  source 1..31: mol_type = genomic DNA
gcttagggcctcctccgggaagagctaactg

SEQ ID NO: 21690 - DNA, 206 bp, Homo sapiens
  misc_feature 1..206: note = chr13:92051168-92051374
  misc_feature 1..206: note = hyper
  source 1..206: mol_type = genomic DNA
gtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcga

SEQ ID NO: 21691 - skipped

SEQ ID NO: 21692 - DNA, 86 bp, Homo sapiens
  misc_feature 1..86: note = chr13:93879375-93879461
  misc_feature 1..86: note = hyper
  source 1..86: mol_type = genomic DNA
attgcagctctgaacccccatggtggttttttaaacacttcttttccttctcttcctcgttttgattgcaccgtttccatctgggg

SEQ ID NO: 21693 - DNA, 30 bp, Homo sapiens; identical to SEQ ID NO: 11663
  misc_feature 1..30: note = chr13:95354328-95354358
  misc_feature 1..30: note = hyper
  source 1..30: mol_type = genomic DNA

SEQ ID NO: 21694 - DNA, 28 bp, Homo sapiens
  misc_feature 1..28: note = chr13:95359719-95359747
  misc_feature 1..28: note = hyper
  source 1..28: mol_type = genomic DNA
cttgcctggaggacacggcggcccaggc

SEQ ID NO: 21695 - DNA, 21 bp, Homo sapiens
  misc_feature 1..21: note = chr13:95359803-95359824
  misc_feature 1..21: note = hyper
  source 1..21: mol_type = genomic DNA
ctgctccggggagagtggaat

SEQ ID NO: 21696 - DNA, 91 bp, Homo sapiens
  misc_feature 1..91: note = chr13:95360231-95360322
  misc_feature 1..91: note = hyper
  source 1..91: mol_type = genomic DNA
aaacagggagagagacggagatagataaagagatggagatagagatcgcgagccagcagcagctctctgcccaatcacagcgctgcatttg

SEQ ID NO: 21697 - DNA, 33 bp, Homo sapiens
  misc_feature 1..33: note = chr13:95360371-95360404
  misc_feature 1..33: note = hyper
  source 1..33: mol_type = genomic DNA
gccctcttgccccggagccgctccccccgctcc

SEQ ID NO: 21698 - DNA, 201 bp, Homo sapiens
  misc_feature 1..201: note = chr13:95363009-95363210
  misc_feature 1..201: note = hyper
  source 1..201: mol_type = genomic DNA
gcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcac

SEQ ID NO: 21699 - DNA, 204 bp, Homo sapiens
  misc_feature 1..204: note = chr13:95363592-95363796
  misc_feature 1..204: note = hyper
  source 1..204: mol_type = genomic DNA
cgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagta

SEQ ID NO: 21700 - DNA, 142 bp, Homo sapiens
  misc_feature 1..142: note = chr13:95364800-95364942
  misc_feature 1..142: note = hyper
  source 1..142: mol_type = genomic DNA
ggttctcctcggtgactttctcatttgacagaagcagatgggggtggggaaggcggggaggtggccctggaggaggaagaggagggggaggcggaggagtgtccaggcgtgccacgagaacgcagagcgcagcaatggatat

SEQ ID NO: 21701 - DNA, 129 bp, Homo sapiens; identical to SEQ ID NO: 11672
  misc_feature 1..129: note = chr13:95365239-95365368
  misc_feature 1..129: note = hyper
  source 1..129: mol_type = genomic DNA

SEQ ID NO: 21702 - DNA, 218 bp, Homo sapiens
  misc_feature 1..218: note = chr13:95619803-95620021
  misc_feature 1..218: note = hyper
  source 1..218: mol_type = genomic DNA
agagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcggg

SEQ ID NO: 21703 - DNA, 228 bp, Homo sapiens
  misc_feature 1..228: note = chr13:95620078-95620306
  misc_feature 1..228: note = hyper
  source 1..228: mol_type = genomic DNA
ctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacac

SEQ ID NO: 21704 - DNA, 340 bp, Homo sapiens
  misc_feature 1..340: note = chr13:95620307-95620647
  misc_feature 1..340: note = hyper
  source 1..340: mol_type = genomic DNA
ctcggctacctgcaggggttcgccactgcaagccgggccagtagaagtttgggggcgaaggcagagagcatttccttctcggcttttggcgcctccacgctgcacagaggcaggggcgactctgcaggccccgtttcccccatcctcccctccaccccagttccccgcaggacgtaggcgccgtccctagctcccccttctgtcctcgccctaacaccgcagggcctctcctggggatgtggggtcctgcgtgcttttgggggctacaaaaagtgggggccgtcgcagagcagagggaagctaggagcgggcaacgaattgaatcctggagacccgggag

SEQ ID NO: 21705 - DNA, 93 bp, Homo sapiens; identical to SEQ ID NO: 11676
  misc_feature 1..93: note = chr13:95655093-95655186
  misc_feature 1..93: note = hyper
  source 1..93: mol_type = genomic DNA

SEQ ID NO: 21706 - DNA, 83 bp, Homo sapiens
  misc_feature 1..83: note = chr13:96296473-96296556
  misc_feature 1..83: note = hyper
  source 1..83: mol_type = genomic DNA
ggcaaacaggcagtgggggcagcggcggctactccagctggatctgcagaggctcggctcgcagcctggagaggcaggagggc

SEQ ID NO: 21707 - DNA, 83 bp, Homo sapiens
  misc_feature 1..83: note = chr13:96297137-96297220
  misc_feature 1..83: note = hyper
  source 1..83: mol_type = genomic DNA
ccctcagcaagctaatttcccagaggagcttcaggtgaattatcttccaaaaagagatgcgttttaatcgcagaagtctgcag

SEQ ID NO: 21708 - DNA, 150 bp, Homo sapiens; identical to SEQ ID NO: 11681
  misc_feature 1..150: note = chr13:96743424-96743574
  misc_feature 1..150: note = hyper
  source 1..150: mol_type = genomic DNA

SEQ ID NO: 21709 - DNA, 30 bp, Homo sapiens; identical to SEQ ID NO: 11686
  misc_feature 1..30: note = chr13:100611911-100611941
  misc_feature 1..30: note = hyper
  source 1..30: mol_type = genomic DNA

SEQ ID NO: 21710 - DNA, 33 bp, Homo sapiens; identical to SEQ ID NO: 11688
  misc_feature 1..33: note = chr13:100622452-100622485
  misc_feature 1..33: note = hyper
  source 1..33: mol_type = genomic DNA

SEQ ID NO: 21711 - DNA, 34 bp, Homo sapiens; identical to SEQ ID NO: 11689
  misc_feature 1..34: note = chr13:100622959-100622993
  misc_feature 1..34: note = hyper
  source 1..34: mol_type = genomic DNA

SEQ ID NO: 21712 - DNA, 28 bp, Homo sapiens
  misc_feature 1..28: note = chr13:100624559-100624587
  misc_feature 1..28: note = hyper
  source 1..28: mol_type = genomic DNA
acccaacctgcctagcgctcacctaggg

SEQ ID NO: 21713 - DNA, 90 bp, Homo sapiens; identical to SEQ ID NO: 11692
  misc_feature 1..90: note = chr13:100635085-100635175
  misc_feature 1..90: note = hyper
  source 1..90: mol_type = genomic DNA

SEQ ID NO: 21714 - DNA, 34 bp, Homo sapiens; identical to SEQ ID NO: 11694
  misc_feature 1..34: note = chr13:100637006-100637040
  misc_feature 1..34: note = hyper
  source 1..34: mol_type = genomic DNA

SEQ ID NO: 21715 - DNA, 39 bp, Homo sapiens
  misc_feature 1..39: note = chr13:100637485-100637524
  misc_feature 1..39: note = hyper
  source 1..39: mol_type = genomic DNA
tgggggtgctctcccccaggggcccggccccacagcagc

SEQ ID NO: 21716 - DNA, 156 bp, Homo sapiens; identical to SEQ ID NO: 11696
  misc_feature 1..156: note = chr13:100637800-100637956
  misc_feature 1..156: note = hyper
  source 1..156: mol_type = genomic DNA

SEQ ID NO: 21717 - DNA, 187 bp, Homo sapiens; identical to SEQ ID NO: 11697
  misc_feature 1..187: note = chr13:100640972-100641159
  misc_feature 1..187: note = hyper
  source 1..187: mol_type = genomic DNA

SEQ ID NO: 21718 - DNA, 30 bp, Homo sapiens
  misc_feature 1..30: note = chr13:100644025-100644055
  misc_feature 1..30: note = hyper
  source 1..30: mol_type = genomic DNA
cagtggttaggtggccgagtgtggtttccc

SEQ ID NO: 21719 - DNA, 32 bp, Homo sapiens; identical to SEQ ID NO: 11700
  misc_feature 1..32: note = chr13:100647898-100647930
  misc_feature 1..32: note = hyper
  source 1..32: mol_type = genomic DNA

SEQ ID NO: 21720 - DNA, 26 bp, Homo sapiens
  misc_feature 1..26: note = chr13:102069045-102069071
  misc_feature 1..26: note = hyper
  source 1..26: mol_type = genomic DNA
gcagttccttcttgccggctgccacc

SEQ ID NO: 21721 - DNA, 32 bp, Homo sapiens
  misc_feature 1..32: note = chr13:102568422-102568454
  misc_feature 1..32: note = hyper
  source 1..32: mol_type = genomic DNA
ctgcgagcggtggctcgaccccgggtgtggca

SEQ ID NO: 21722 - DNA, 60 bp, Homo sapiens; identical to SEQ ID NO: 11706
  misc_feature 1..60: note = chr13:102569830-102569890
  misc_feature 1..60: note = hyper
  source 1..60: mol_type = genomic DNA

SEQ ID NO: 21723 - DNA, 56 bp, Homo sapiens
  misc_feature 1..56: note = chr13:103046665-103046721
  misc_feature 1..56: note = hyper
  source 1..56: mol_type = genomic DNA
cacatggggtgcccccgcgtcaacgccggaggagtgaccttgcaaacccgcgcccc

SEQ ID NO: 21724 - DNA, 58 bp, Homo sapiens
  misc_feature 1..58: note = chr13:103046995-103047053
  misc_feature 1..58: note = hyper
  source 1..58: mol_type = genomic DNA
ggcgagccgaggctgggagcgcggtgatggccggtccccgtgagcagagggcagcggc

SEQ ID NO: 21725 - DNA, 247 bp, Homo sapiens; identical to SEQ ID NO: 11708
  misc_feature 1..247: note = chr13:103047054-103047301
  misc_feature 1..247: note = hyper
  source 1..247: mol_type = genomic DNA

SEQ ID NO: 21726 - DNA, 30 bp, Homo sapiens; identical to SEQ ID NO: 11709
  misc_feature 1..30: note = chr13:103052128-103052158
  misc_feature 1..30: note = hyper
  source 1..30: mol_type = genomic DNA

SEQ ID NO: 21727 - DNA, 254 bp, Homo sapiens
  misc_feature 1..254: note = chr13:103052574-103052828
  misc_feature 1..254: note = hyper
  source 1..254: mol_type = genomic DNA
cccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgcc

SEQ ID NO: 21728 - DNA, 63 bp, Homo sapiens
  misc_feature 1..63: note = chr13:103052829-103052892
  misc_feature 1..63: note = hyper
  source 1..63: mol_type = genomic DNA
ccgccaccaccatgcagccctccagcctgcctcccctgggttgctcgcccacagctccgcggc

SEQ ID NO: 21729 - DNA, 269 bp, Homo sapiens
  misc_feature 1..269: note = chr13:103052940-103053209
  misc_feature 1..269: note = hyper
  source 1..269: mol_type = genomic DNA
tccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctca

SEQ ID NO: 21730 - DNA, 30 bp, Homo sapiens; identical to SEQ ID NO: 11712
  misc_feature 1..30: note = chr13:103054590-103054620
  misc_feature 1..30: note = hyper
  source 1..30: mol_type = genomic DNA

SEQ ID NO: 21731 - DNA, 208 bp, Homo sapiens
  misc_feature 1..208: note = chr13:108518605-108518813
  misc_feature 1..208: note = hyper
  source 1..208: mol_type = genomic DNA
ggactcccccatgctcgccaggagcgcgggccaggagggctcctgctgccgccgctgctgctgctgctgctgccgctgcctctgctgctgctgctgctgctgctgctgccgctgctgctgctggtgctccttgtcccgggcccgggtcagcttggcctcggcgcagaaccacaagtgatcagagagcaggactgtgaaaaacaagaga

SEQ ID NO: 21732 - DNA, 63 bp, Homo sapiens
  misc_feature 1..63: note = chr13:108519674-108519737
  misc_feature 1..63: note = hyper
  source 1..63: mol_type = genomic DNA
ccgctgccgcagggccgcccgcgggcgccgccgccggggctccgactgctgacgccgcctccc

SEQ ID NO: 21733 - DNA, 80 bp, Homo sapiens; identical to SEQ ID NO: 11717
  misc_feature 1..80: note = chr13:109148480-109148560
  misc_feature 1..80: note = hyper
  source 1..80: mol_type = genomic DNA

SEQ ID NO: 21734 - DNA, 89 bp, Homo sapiens
  misc_feature 1..89: note = chr13:110958727-110958816
  misc_feature 1..89: note = hyper
  source 1..89: mol_type = genomic DNA
gccttaggcagcagtcgtgggaaagctcagatacagctgtttccaggcaaagggcccagagcttttcagcctcagccaccagggtctcc

SEQ ID NO: 21735 - DNA, 132 bp, Homo sapiens; identical to SEQ ID NO: 4051
  misc_feature 1..132: note = chr13:110959517-110959649
  misc_feature 1..132: note = hyper
  source 1..132: mol_type = genomic DNA

SEQ ID NO: 21736 - DNA, 57 bp, Homo sapiens
  misc_feature 1..57: note = chr13:110959970-110960027
  misc_feature 1..57: note = hyper
  source 1..57: mol_type = genomic DNA
gagtagaaagggggagggtgggagagcgaagaccgagctcctcggccaaggagcacc

SEQ ID NO: 21737 - DNA, 96 bp, Homo sapiens
  misc_feature 1..96: note = chr13:110960445-110960541
  misc_feature 1..96: note = hyper
  source 1..96: mol_type = genomic DNA
gttcctcgcccagagcgtcttggcggtaagtcctggctcccgcgcttggacttgcgcgcccgagagtggttgggacgtttgagtggccttggagaa

SEQ ID NO: 21738 - DNA, 83 bp, Homo sapiens; identical to SEQ ID NO: 11724
  misc_feature 1..83: note = chr13:110960909-110960992
  misc_feature 1..83: note = hyper
  source 1..83: mol_type = genomic DNA

SEQ ID NO: 21739 - DNA, 33 bp, Homo sapiens; identical to SEQ ID NO: 11725
  misc_feature 1..33: note = chr13:111767955-111767988
  misc_feature 1..33: note = hyper
  source 1..33: mol_type = genomic DNA

SEQ ID NO: 21740 - DNA, 50 bp, Homo sapiens
  misc_feature 1..50: note = chr13:112707869-112707919
  misc_feature 1..50: note = hyper
  source 1..50: mol_type = genomic DNA
gccgcagggggttggggtcatttttttgatgccgccgcccttaagagttc

SEQ ID NO: 21741 - DNA, 14 bp, Homo sapiens
  misc_feature 1..14: note = chr13:112710745-112710759
  misc_feature 1..14: note = hyper
  source 1..14: mol_type = genomic DNA
gaggggactgggga

SEQ ID NO: 21742 - DNA, 16 bp, Homo sapiens
  misc_feature 1..16: note = chr13:112715354-112715370
  misc_feature 1..16: note = hyper
  source 1..16: mol_type = genomic DNA
gggaacgctcccagcc

SEQ ID NO: 21743 - DNA, 49 bp, Homo sapiens
  misc_feature 1..49: note = chr13:112715936-112715985
  misc_feature 1..49: note = hyper
  source 1..49: mol_type = genomic DNA
tctttaagagccacccgacagaactgcgcgctacatctgcgccagctgg

SEQ ID NO: 21744 - DNA, 40 bp, Homo sapiens
  misc_feature 1..40: note = chr13:112716313-112716353
  misc_feature 1..40: note = hyper
  source 1..40: mol_type = genomic DNA
gacgtctctcccccaactgctctgccgttaacccaattac

SEQ ID NO: 21745 - DNA, 34 bp, Homo sapiens; identical to SEQ ID NO: 11736
  misc_feature 1..34: note = chr13:112716636-112716670
  misc_feature 1..34: note = hyper
  source 1..34: mol_type = genomic DNA

SEQ ID NO: 21746 - DNA, 299 bp, Homo sapiens
  misc_feature 1..299: note = chr13:112717536-112717835
  misc_feature 1..299: note = hyper
  source 1..299: mol_type = genomic DNA
atttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctgg

SEQ ID NO: 21747 - DNA, 205 bp, Homo sapiens
  misc_feature 1..205: note = chr13:112720518-112720723
  misc_feature 1..205: note = hyper
  source 1..205: mol_type = genomic DNA
tactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcact

SEQ ID NO: 21748 - DNA, 245 bp, Homo sapiens
  misc_feature 1..245: note = chr13:112720767-112721012
  misc_feature 1..245: note = hyper
  source 1..245: mol_type = genomic DNA
ccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtg

SEQ ID NO: 21749 - DNA, 65 bp, Homo sapiens; identical to SEQ ID NO: 11743
  misc_feature 1..65: note = chr13:112724425-112724490
  misc_feature 1..65: note = hyper
  source 1..65: mol_type = genomic DNA

SEQ ID NO: 21750 - DNA, 60 bp, Homo sapiens
  misc_feature 1..60: note = chr13:112726560-112726620
  misc_feature 1..60: note = hyper
  source 1..60: mol_type = genomic DNA
cggactccagcgccccctcgaccccgtcgggctccggccgactcccgccccctccccacc

SEQ ID NO: 21751 - DNA, 157 bp, Homo sapiens; identical to SEQ ID NO: 11745
  misc_feature 1..157: note = chr13:112726982-112727139
  misc_feature 1..157: note = hyper
  source 1..157: mol_type = genomic DNA

SEQ ID NO: 21752 - DNA, 95 bp, Homo sapiens
  misc_feature 1..95: note = chr13:112758012-112758107
  misc_feature 1..95: note = hyper
  source 1..95: mol_type = genomic DNA
tgcaggcggggggaccgcgcgcttggctcgaagaccccgccctgggcaggggacagaaaatatgaaatcagatggggagttatgaataactgtcc

SEQ ID NO: 21753 - DNA, 17 bp, Homo sapiens
  misc_feature 1..17: note = chr13:112758257-112758274
  misc_feature 1..17: note = hyper
  source 1..17: mol_type = genomic DNA
acttttctcagtgtggg

SEQ ID NO: 21754 - DNA, 78 bp, Homo sapiens
  misc_feature 1..78: note = chr13:112758613-112758691
  misc_feature 1..78: note = hyper
  source 1..78: mol_type = genomic DNA
gccctattcagcggggcccggggaccctgggggccgagcgaggccagcccgggcgggagcaccgccgccagcgcgcgc

SEQ ID NO: 21755 - DNA, 159 bp, Homo sapiens
  misc_feature 1..159: note = chr13:112759248-112759407
  misc_feature 1..159: note = hyper
  source 1..159: mol_type = genomic DNA
tgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcggg

SEQ ID NO: 21756 - DNA, 40 bp, Homo sapiens
  misc_feature 1..40: note = chr13:112759642-112759682
  misc_feature 1..40: note = hyper
  source 1..40: mol_type = genomic DNA
tcacaatcacttatctggaaacctgcggttggattaatcg

SEQ ID NO: 21757 - DNA, 30 bp, Homo sapiens; identical to SEQ ID NO: 11752
  misc_feature 1..30: note = chr13:113547121-113547151
  misc_feature 1..30: note = hyper
  source 1..30: mol_type = genomic DNA

SEQ ID NO: 21758 - DNA, 51 bp, Homo sapiens; identical to SEQ ID NO: 11753
  misc_feature 1..51: note = chr13:114462901-114462952
  misc_feature 1..51: note = hyper
  source 1..51: mol_type = genomic DNA

SEQ ID NO: 21759 - DNA, 82 bp, Homo sapiens
  misc_feature 1..82: note = chr14:21093631-21093713
  misc_feature 1..82: note = hyper
  source 1..82: mol_type = genomic DNA
aggatcctgaagtactaacactttctaactagtaaaataattaaatcttcctttcccaggattctcccggattacacagcat

SEQ ID NO: 21760 - DNA, 165 bp, Homo sapiens; identical to SEQ ID NO: 11756
  misc_feature 1..165: note = chr14:21100842-21101007
  misc_feature 1..165: note = hyper
  source 1..165: mol_type = genomic DNA

SEQ ID NO: 21761 - skipped

SEQ ID NO: 21762 - DNA, 19 bp, Homo sapiens
  misc_feature 1..19: note = chr14:21101037-21101056
  misc_feature 1..19: note = hyper
  source 1..19: mol_type = genomic DNA
cgcacgttgactttcctgg

SEQ ID NO: 21763 - DNA, 30 bp, Homo sapiens; identical to SEQ ID NO: 11759
  misc_feature 1..30: note = chr14:21121400-21121430
  misc_feature 1..30: note = hyper
  source 1..30: mol_type = genomic DNA

SEQ ID NO: 21764 - DNA, 15 bp, Homo sapiens
  misc_feature 1..15: note = chr14:21121902-21121917
  misc_feature 1..15: note = hyper
  source 1..15: mol_type = genomic DNA
ctcatcccccacccc

SEQ ID NO: 21765 - DNA, 44 bp, Homo sapiens; identical to SEQ ID NO: 11761
  misc_feature 1..44: note = chr14:21769210-21769254
  misc_feature 1..44: note = hyper
  source 1..44: mol_type = genomic DNA

SEQ ID NO: 21766 - DNA, 30 bp, Homo sapiens; identical to SEQ ID NO: 11762
  misc_feature 1..30: note = chr14:23291877-23291907
  misc_feature 1..30: note = hyper
  source 1..30: mol_type = genomic DNA

SEQ ID NO: 21767 - DNA, 112 bp, Homo sapiens; identical to SEQ ID NO: 11763
  misc_feature 1..112: note = chr14:23821464-23821576
  misc_feature 1..112: note = hyper
  source 1..112: mol_type = genomic DNA

SEQ ID NO: 21768 - DNA, 21 bp, Homo sapiens
  misc_feature 1..21: note = chr14:23821601-23821622
  misc_feature 1..21: note = hyper
  source 1..21: mol_type = genomic DNA
cgctcccgctcaccctgcagc

SEQ ID NO: 21769 - DNA, 23 bp, Homo sapiens
  misc_feature 1..23: note = chr14:24804424-24804447
  misc_feature 1..23: note = hyper
  source 1..23: mol_type = genomic DNA
cgcctccccgcttcagccccttc

SEQ ID NO: 21770 - DNA, 190 bp, Homo sapiens; identical to SEQ ID NO: 11768
  misc_feature 1..190: note = chr14:25518450-25518640
  misc_feature 1..190: note = hyper
  source 1..190: mol_type = genomic DNA

SEQ ID NO: 21771 - DNA, 193 bp, Homo sapiens
  misc_feature 1..193: note = chr14:26674384-26674577
  misc_feature 1..193: note = hyper
  source 1..193: mol_type = genomic DNA
ggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatg

SEQ ID NO: 21772 - DNA, 30 bp, Homo sapiens; identical to SEQ ID NO: 11770
  misc_feature 1..30: note = chr14:27066218-27066248
  misc_feature 1..30: note = hyper
  source 1..30: mol_type = genomic DNA

SEQ ID NO: 21773 - DNA, 60 bp, Homo sapiens; identical to SEQ ID NO: 11772
  misc_feature 1..60: note = chr14:27067097-27067157
  misc_feature 1..60: note = hyper
  source 1..60: mol_type = genomic DNA

SEQ ID NO: 21774 - DNA, 44 bp, Homo sapiens; identical to SEQ ID NO: 11773
  misc_feature 1..44: note = chr14:27067635-27067679
  misc_feature 1..44: note = hyper
  source 1..44: mol_type = genomic DNA

SEQ ID NO: 21775 - DNA, 30 bp, Homo sapiens; identical to SEQ ID NO: 11774
  misc_feature 1..30: note = chr14:29225698-29225728
  misc_feature 1..30: note = hyper
  source 1..30: mol_type = genomic DNA

SEQ ID NO: 21776 - DNA, 38 bp, Homo sapiens
  misc_feature 1..38: note = chr14:29226033-29226071
  misc_feature 1..38: note = hyper
  source 1..38: mol_type = genomic DNA
gagatctcagatcttcgcgtttggggtggggagtgggg

SEQ ID NO: 21777 - DNA, 43 bp, Homo sapiens; identical to SEQ ID NO: 11776
  misc_feature 1..43: note = chr14:29226360-29226403
  misc_feature 1..43: note = hyper
  source 1..43: mol_type = genomic DNA

SEQ ID NO: 21778 - DNA, 30 bp, Homo sapiens; identical to SEQ ID NO: 11777
  misc_feature 1..30: note = chr14:29227895-29227925
  misc_feature 1..30: note = hyper
  source 1..30: mol_type = genomic DNA

SEQ ID NO: 21779 - DNA, 151 bp, Homo sapiens; identical to SEQ ID NO: 11778
  misc_feature 1..151: note = chr14:29228268-29228419
  misc_feature 1..151: note = hyper
  source 1..151: mol_type = genomic DNA

SEQ ID NO: 21780 - DNA, 26 bp, Homo sapiens
  misc_feature 1..26: note = chr14:29228628-29228654
  misc_feature 1..26: note = hyper
  source 1..26: mol_type = genomic DNA
agaaaacctcttcaccgcggtgattc

SEQ ID NO: 21781 - DNA, 206 bp, Homo sapiens
  misc_feature 1..206: note = chr14:29228778-29228984
  misc_feature 1..206: note = hyper
  source 1..206: mol_type = genomic DNA
gattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgtta

SEQ ID NO: 21782 - DNA, 30 bp, Homo sapiens; identical to SEQ ID NO: 11782
  misc_feature 1..30: note = chr14:29230911-29230941
  misc_feature 1..30: note = hyper
  source 1..30: mol_type = genomic DNA

SEQ ID NO: 21783 - DNA, 38 bp, Homo sapiens; identical to SEQ ID NO: 11783
  misc_feature 1..38: note = chr14:29231293-29231331
  misc_feature 1..38: note = hyper
  source 1..38: mol_type = genomic DNA

SEQ ID NO: 21784 - DNA, 150 bp, Homo sapiens
  misc_feature 1..150: note = chr14:29234853-29235003
  misc_feature 1..150: note = hyper
  source 1..150: mol_type = genomic DNA
tgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaagga

SEQ ID NO: 21785 - DNA, 61 bp, Homo sapiens; identical to SEQ ID NO: 11785
  misc_feature 1..61: note = chr14:29236023-29236084
  misc_feature 1..61: note = hyper
  source 1..61: mol_type = genomic DNA

SEQ ID NO: 21786 - DNA, 89 bp, Homo sapiens; identical to SEQ ID NO: 11786
  misc_feature 1..89: note = chr14:29236672-29236761
  misc_feature 1..89: note = hyper
  source 1..89: mol_type = genomic DNA

SEQ ID NO: 21787 - DNA, 63 bp, Homo sapiens; identical to SEQ ID NO: 11788
  misc_feature 1..63: note = chr14:29243208-29243271
  misc_feature 1..63: note = hyper
  source 1..63: mol_type = genomic DNA

SEQ ID NO: 21788 - DNA, 199 bp, Homo sapiens
  misc_feature 1..199: note = chr14:29243888-29244087
  misc_feature 1..199: note = hyper
  source 1..199: mol_type = genomic DNA
tccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccat

SEQ ID NO: 21789 - DNA, 163 bp, Homo sapiens; identical to SEQ ID NO: 11791
  misc_feature 1..163: note = chr14:29247187-29247350
  misc_feature 1..163: note = hyper
  source 1..163: mol_type = genomic DNA

SEQ ID NO: 21790 - DNA, 15 bp, Homo sapiens
  misc_feature 1..15: note = chr14:29254425-29254440
  misc_feature 1..15: note = hyper
  source 1..15: mol_type = genomic DNA
ggcgcccgcagaagc

SEQ ID NO: 21791 - DNA, 137 bp, Homo sapiens; identical to SEQ ID NO: 11794
  misc_feature 1..137: note = chr14:31343407-31343544
  misc_feature 1..137: note = hyper
  source 1..137: mol_type = genomic DNA

SEQ ID NO: 21792 - DNA, 31 bp, Homo sapiens
  misc_feature 1..31: note = chr14:31344315-31344346
  misc_feature 1..31: note = hyper
  source 1..31: mol_type = genomic DNA
gggggagctggggtgcgtccaggcggtcgca

SEQ ID NO: 21793 - DNA, 90 bp, Homo sapiens; identical to SEQ ID NO: 11796
  misc_feature 1..90: note = chr14:33402367-33402457
  misc_feature 1..90: note = hyper
  source 1..90: mol_type = genomic DNA

SEQ ID NO: 21794 - DNA, 81 bp, Homo sapiens
  misc_feature 1..81: note = chr14:33402762-33402843
  misc_feature 1..81: note = hyper
  source 1..81: mol_type = genomic DNA
ggctcgccagccggaagaaagaggaggaagtgggacaacgggggtcctgggcaggggtaggggaaacgatcaactcccact

SEQ ID NO: 21795 - DNA, 16 bp, Homo sapiens
  misc_feature 1..16: note = chr14:33403316-33403332
  misc_feature 1..16: note = hyper
  source 1..16: mol_type = genomic DNA
gcgctgcctgatgtgc

SEQ ID NO: 21796 - DNA, 30 bp, Homo sapiens; identical to SEQ ID NO: 11799
  misc_feature 1..30: note = chr14:33403549-33403579
  misc_feature 1..30: note = hyper
  source 1..30: mol_type = genomic DNA

SEQ ID NO: 21797 - DNA, 20 bp, Homo sapiens
  misc_feature 1..20: note = chr14:33403846-33403866
  misc_feature 1..20: note = hyper
  source 1..20: mol_type = genomic DNA
ccccagcccgctgcgcgcac

SEQ ID NO: 21798 - DNA, 218 bp, Homo sapiens
  misc_feature 1..218: note = chr14:36004493-36004711
  misc_feature 1..218: note = hyper
  source 1..218: mol_type = genomic DNA
attgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccag

SEQ ID NO: 21799 - DNA, 83 bp, Homo sapiens; identical to SEQ ID NO: 11804
  misc_feature 1..83: note = chr14:36972706-36972789
  misc_feature 1..83: note = hyper
  source 1..83: mol_type = genomic DNA

SEQ ID NO: 21800 - DNA, 46 bp, Homo sapiens; identical to SEQ ID NO: 11807
  misc_feature 1..46: note = chr14:36975034-36975080
  misc_feature 1..46: note = hyper
  source 1..46: mol_type = genomic DNA

SEQ ID NO: 21801 - DNA, 58 bp, Homo sapiens
  misc_feature 1..58: note = chr14:36975399-36975457
  misc_feature 1..58: note = hyper
  source 1..58: mol_type = genomic DNA
tgcgctcgcggagaataaagggggcgctgtccaacctcaggttcggggaaaaccaagg

SEQ ID NO: 21802 - DNA, 142 bp, Homo sapiens
  misc_feature 1..142: note = chr14:36977503-36977645
  misc_feature 1..142: note = hyper
  source 1..142: mol_type = genomic DNA
ggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggc

SEQ ID NO: 21803 - DNA, 30 bp, Homo sapiens; identical to SEQ ID NO: 11810
  misc_feature 1..30: note = chr14:36983330-36983360
  misc_feature 1..30: note = hyper
  source 1..30: mol_type = genomic DNA

SEQ ID NO: 21804 - DNA, 437 bp, Homo sapiens; identical to SEQ ID NO: 11816
  misc_feature 1..437: note = chr14:36989763-36990200
  misc_feature 1..437: note = hyper
  source 1..437: mol_type = genomic DNA

SEQ ID NO: 21805 - DNA, 41 bp, Homo sapiens; identical to SEQ ID NO: 11817
  misc_feature 1..41: note = chr14:36990493-36990534
  misc_feature 1..41: note = hyper
  source 1..41: mol_type = genomic DNA

SEQ ID NO: 21806 - DNA, 30 bp, Homo sapiens; identical to SEQ ID NO: 11818
  misc_feature 1..30: note = chr14:36990535-36990565
  misc_feature 1..30: note = hyper
  source 1..30: mol_type = genomic DNA

SEQ ID NO: 21807 - skipped

SEQ ID NO: 21808 - DNA, 165 bp, Homo sapiens
  misc_feature 1..165: note = chr14:36991613-36991778
  misc_feature 1..165: note = hyper
  source 1..165: mol_type = genomic DNA
cccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctgggg

SEQ ID NO: 21809 - DNA, 35 bp, Homo sapiens
  misc_feature 1..35: note = chr14:36993438-36993473
  misc_feature 1..35: note = hyper
  source 1..35: mol_type = genomic DNA
cccctcagttgctcccgcagtctcccacagctagg

SEQ ID NO: 21810 - DNA, 10 bp, Homo sapiens
  misc_feature 1..10: note = chr14:36994999-36995009
  misc_feature 1..10: note = hyper
  source 1..10: mol_type = genomic DNA
catcatccac

SEQ ID NO: 21811 - DNA, 40 bp, Homo sapiens; identical to SEQ ID NO: 4090
  misc_feature 1..40: note = chr14:36995010-36995050
  misc_feature 1..40: note = hyper
  source 1..40: mol_type = genomic DNA

SEQ ID NO: 21812 - DNA, 387 bp, Homo sapiens; identical to SEQ ID NO: 11829
  misc_feature 1..387: note = chr14:37116983-37117370
  misc_feature 1..387: note = hyper
  source 1..387: mol_type = genomic DNA

SEQ ID NO: 21813 - DNA, 107 bp, Homo sapiens
  misc_feature 1..107: note = chr14:37125545-37125652
  misc_feature 1..107: note = hyper
  source 1..107: mol_type = genomic DNA
gactgggggcgactcgcaagggcatcatgccacctagaggaaacgcgcagtgagtgagccctgggtcactgaaaatgggagaacgttcgagtcggtcaagatgactc

SEQ ID NO: 21814 - DNA, 85 bp, Homo sapiens
  misc_feature 1..85: note = chr14:37126156-37126241
  misc_feature 1..85: note = hyper
  source 1..85: mol_type = genomic DNA
gcaaccctggcaagacgaaatccccctccctctggctagatcagcccagcctcccctcagggaccttcctgcccctccctacccc

SEQ ID NO: 21815 - DNA, 32 bp, Homo sapiens
  misc_feature 1..32: note = chr14:37126297-37126329
  misc_feature 1..32: note = hyper
  source 1..32: mol_type = genomic DNA
cttgcaatcccgcagcccggagttttgccccg

SEQ ID NO: 21816 - DNA, 18 bp, Homo sapiens
  misc_feature 1..18: note = chr14:37126548-37126566
  misc_feature 1..18: note = hyper
  source 1..18: mol_type = genomic DNA
gaaaacttccaaatgcgc

SEQ ID NO: 21817 - DNA, 169 bp, Homo sapiens; identical to SEQ ID NO: 11836
  misc_feature 1..169: note = chr14:37126964-37127133
  misc_feature 1..169: note = hyper
  source 1..169: mol_type = genomic DNA

SEQ ID NO: 21818 - DNA, 118 bp, Homo sapiens
  misc_feature 1..118: note = chr14:37127537-37127655
  misc_feature 1..118: note = hyper
  source 1..118: mol_type = genomic DNA
cgagtggacaagaggcgggcaccgtcgcctgggcctcgcttggggggggggggtcctgtccccagcagggggcaagttggaggaatcagctccttaatattttctgctagctctgctt

SEQ ID NO: 21819 - DNA, 30 bp, Homo sapiens; identical to SEQ ID NO: 11839
  misc_feature 1..30: note = chr14:37130494-37130524
  misc_feature 1..30: note = hyper
  source 1..30: mol_type = genomic DNA

SEQ ID NO: 21820 - DNA, 85 bp, Homo sapiens
  misc_feature 1..85: note = chr14:37132290-37132375
  misc_feature 1..85: note = hyper
  source 1..85: mol_type = genomic DNA
cgatcttgccaggagccatcgggggcagcaagccccgggtcactacccccaccgtggtgaaacacatccggacctacaagcagag

SEQ ID NO: 21821 - DNA, 163 bp, Homo sapiens
  misc_feature 1..163: note = chr14:37132838-37133001
  misc_feature 1..163: note = hyper
  source 1..163: mol_type = genomic DNA
tttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttcca

SEQ ID NO: 21822 - DNA, 59 bp, Homo sapiens
  misc_feature 1..59: note = chr14:37133052-37133111
  misc_feature 1..59: note = hyper
  source 1..59: mol_type = genomic DNA
gagagtgcggccggggctggacttggggcgcagcccgggaggcccgagcctgcttgggg

SEQ ID NO: 21823 - DNA, 16 bp, Homo sapiens
  misc_feature 1..16: note = chr14:37136345-37136361
  misc_feature 1..16: note = hyper
  source 1..16: mol_type = genomic DNA
gcggagaggggcaccc

SEQ ID NO: 21824 - DNA, 30 bp, Homo sapiens; identical to SEQ ID NO: 11845
  misc_feature 1..30: note = chr14:38052911-38052941
  misc_feature 1..30: note = hyper
  source 1..30: mol_type = genomic DNA

SEQ ID NO: 21825 - DNA, 30 bp, Homo sapiens; identical to SEQ ID NO: 11846
  misc_feature 1..30: note = chr14:38057303-38057333
  misc_feature 1..30: note = hyper
  source 1..30: mol_type = genomic DNA

SEQ ID NO: 21826 - DNA, 102 bp, Homo sapiens
  misc_feature 1..102: note = chr14:38725258-38725360
  misc_feature 1..102: note = hyper
  source 1..102: mol_type = genomic DNA
aacttggatctgtcccgctcgaggacgcagagctgtgtctggagcgcggtcaccgccctctacagctggcttccccaacccggttccccctcccttcccctc

SEQ ID NO: 21827 - DNA, 183 bp, Homo sapiens; identical to SEQ ID NO: 11850
  misc_feature 1..183: note = chr14:42075097-42075280
  misc_feature 1..183: note = hyper
  source 1..183: mol_type = genomic DNA

SEQ ID NO: 21828 - DNA, 50 bp, Homo sapiens
  misc_feature 1..50: note = chr14:42075538-42075588
  misc_feature 1..50: note = hyper
  source 1..50: mol_type = genomic DNA
gttcttttcagaatccgctcccatctgattagtaagcaaatcaccaccca

SEQ ID NO: 21829 - DNA, 20 bp, Homo sapiens
  misc_feature 1..20: note = chr14:42076803-42076823
  misc_feature 1..20: note = hyper
  source 1..20: mol_type = genomic DNA
gcaaatgtgttaactcggcg

SEQ ID NO: 21830 - DNA, 114 bp, Homo sapiens
  misc_feature 1..114: note = chr14:42076853-42076967
  misc_feature 1..114: note = hyper
  source 1..114: mol_type = genomic DNA
ctctgaggacgcccagacccattttcctggctggatttggagcggctgctgggctgtggacccaggtgtgtggatcgctttacccagaagcttggaaagcgccaatattaacct

SEQ ID NO: 21831 - DNA, 227 bp, Homo sapiens
  misc_feature 1..227: note = chr14:42079062-42079289
  misc_feature 1..227: note = hyper
  source 1..227: mol_type = genomic DNA
tgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacgg

SEQ ID NO: 21832 - DNA, 100 bp, Homo sapiens
  misc_feature 1..100: note = chr14:42079328-42079428
  misc_feature 1..100: note = hyper
  source 1..100: mol_type = genomic DNA
gaccccctggcagacagcaagcgcatcgtggccgaggcggccgcctggatgcgagaggagggagatgcccagagccacagaggagcgtggagggcggtgg

SEQ ID NO: 21833 - DNA, 102 bp, Homo sapiens; identical to SEQ ID NO: 11855
  misc_feature 1..102: note = chr14:48143617-48143719
  misc_feature 1..102: note = hyper
  source 1..102: mol_type = genomic DNA

SEQ ID NO: 21834 - DNA, 105 bp, Homo sapiens
  misc_feature 1..105: note = chr14:48145257-48145362
  misc_feature 1..105: note = hyper
  source 1..105: mol_type = genomic DNA
gctgctgggctgctgggctgccggggaggaaggctgtgtgtggtcacgttgtgcgctacgtgctgagagcgcgagctgctagccgcagccgggcgacgtcaaagc

SEQ ID NO: 21835 - DNA, 197 bp, Homo sapiens; identical to SEQ ID NO: 4105
  misc_feature 1..197: note = chr14:48145469-48145666
  misc_feature 1..197: note = hyper
  source 1..197: mol_type = genomic DNA

SEQ ID NO: 21836 - DNA, 51 bp, Homo sapiens; identical to SEQ ID NO: 11859
  misc_feature 1..51: note = chr14:51410612-51410663
  misc_feature 1..51: note = hyper
  source 1..51: mol_type = genomic DNA

SEQ ID NO: 21837 - DNA, 92 bp, Homo sapiens
  misc_feature 1..92: note = chr14:51561428-51561520
  misc_feature 1..92: note = hyper
  source 1..92: mol_type = genomic DNA
cgctgtccgcctcgctgtataggctcatcttgtccaggtccagatagtcatagtcggagaccccggagcccgcggcccgatggctctggggg

SEQ ID NO: 21838 - DNA, 74 bp, Homo sapiens; identical to SEQ ID NO: 11863
  misc_feature 1..74: note = chr14:51562419-51562493
  misc_feature 1..74: note = hyper
  source 1..74: mol_type = genomic DNA

SEQ ID NO: 21839 - DNA, 221 bp, Homo sapiens
  misc_feature 1..221: note = chr14:52534791-52535012
  misc_feature 1..221: note = hyper
  source 1..221: mol_type = genomic DNA
gatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctgg

SEQ ID NO: 21840 - DNA, 220 bp, Homo sapiens
  misc_feature 1..220: note = chr14:54422431-54422651
  misc_feature 1..220: note = hyper
  source 1..220: mol_type = genomic DNA
aagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaag

SEQ ID NO: 21841 - DNA, 34 bp, Homo sapiens; identical to SEQ ID NO: 11874
  misc_feature 1..34: note = chr14:54422926-54422960
  misc_feature 1..34: note = hyper
  source 1..34: mol_type = genomic DNA

SEQ ID NO: 21842 - DNA, 260 bp, Homo sapiens; identical to SEQ ID NO: 11875
  misc_feature 1..260: note = chr14:54430156-54430416
  misc_feature 1..260: note = hyper
  source 1..260: mol_type = genomic DNA

SEQ ID NO: 21843 - DNA, 71 bp, Homo sapiens
  misc_feature 1..71: note = chr14:57260875-57260946
  misc_feature 1..71: note = hyper
  source 1..71: mol_type = genomic DNA
attcgttaaaccagccgtctaaacgggccctggcactgggtatccgaccgctccacgcgccagctggtgag

SEQ ID NO: 21844 - DNA, 26 bp, Homo sapiens
  misc_feature 1..26: note = chr14:57261821-57261847
  misc_feature 1..26: note = hyper
  source 1..26: mol_type = genomic DNA
gcaccggagcccgaagtcttccccac

SEQ ID NO: 21845 - DNA, 30 bp, Homo sapiens; identical to SEQ ID NO: 11880
  misc_feature 1..30: note = chr14:57263831-57263861
  misc_feature 1..30: note = hyper
  source 1..30: mol_type = genomic DNA

SEQ ID NO: 21846 - DNA, 57 bp, Homo sapiens; identical to SEQ ID NO: 11884
  misc_feature 1..57: note = chr14:57265517-57265574
  misc_feature 1..57: note = hyper
  source 1..57: mol_type = genomic DNA

SEQ ID NO: 21847 - DNA, 30 bp, Homo sapiens; identical to SEQ ID NO: 11888
  misc_feature 1..30: note = chr14:57273051-57273081
  misc_feature 1..30: note = hyper
  source 1..30: mol_type = genomic DNA

SEQ ID NO: 21848 - DNA, 69 bp, Homo sapiens
  misc_feature 1..69: note = chr14:57274417-57274486
  misc_feature 1..69: note = hyper
  source 1..69: mol_type = genomic DNA
gattctctccacaaccggcctaggtatgcactctgcatagaaggcatgggcccttcaatctaactttca

SEQ ID NO: 21849 - DNA, 111 bp, Homo sapiens
  misc_feature 1..111: note = chr14:57275485-57275596
  misc_feature 1..111: note = hyper
  source 1..111: mol_type = genomic DNA
agggtcggcgccgctcggccttcgctccccgcgcaccagttctatctgtgaaggaagcaaaagccaactcggtggaatcctgacaggggacttgggtttccaaaaatatgt

SEQ ID NO: 21850 - DNA, 336 bp, Homo sapiens
  misc_feature 1..336: note = chr14:57276104-57276440
  misc_feature 1..336: note = hyper
  source 1..336: mol_type = genomic DNA
gggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatc

SEQ ID NO: 21851 - DNA, 30 bp, Homo sapiens; identical to SEQ ID NO: 11897
  misc_feature 1..30: note = chr14:57281138-57281168
  misc_feature 1..30: note = hyper
  source 1..30: mol_type = genomic DNA

SEQ ID NO: 21852 - DNA, 15 bp, Homo sapiens
  misc_feature 1..15: note = chr14:57283299-57283314
  misc_feature 1..15: note = hyper
  source 1..15: mol_type = genomic DNA
catacctgagataca

SEQ ID NO: 21853 - DNA, 43 bp, Homo sapiens
  misc_feature 1..43: note = chr14:58332254-58332297
  misc_feature 1..43: note = hyper
  source 1..43: mol_type = genomic DNA
cagcaccgaggacagcggacatacttttctccccggggggtcc

SEQ ID NO: 21854 - DNA, 68 bp, Homo sapiens; identical to SEQ ID NO: 11902
  misc_feature 1..68: note = chr14:58332640-58332708
  misc_feature 1..68: note = hyper
  source 1..68: mol_type = genomic DNA

SEQ ID NO: 21855 - DNA, 30 bp, Homo sapiens; identical to SEQ ID NO: 11903
  misc_feature 1..30: note = chr14:60043273-60043303
  misc_feature 1..30: note = hyper
  source 1..30: mol_type = genomic DNA

SEQ ID NO: 21856 - DNA, 44 bp, Homo sapiens
  misc_feature 1..44: note = chr14:60097566-60097610
  misc_feature 1..44: note = hyper
  source 1..44: mol_type = genomic DNA
aggtttgggaggaggggaaaaagggctgacggtgggggtgagag

SEQ ID NO: 21857 - DNA, 42 bp, Homo sapiens; identical to SEQ ID NO: 11906
  misc_feature 1..42: note = chr14:60336952-60336994
  misc_feature 1..42: note = hyper
  source 1..42: mol_type = genomic DNA

SEQ ID NO: 21858 - DNA, 18 bp, Homo sapiens
  misc_feature 1..18: note = chr14:60386701-60386719
  misc_feature 1..18: note = hyper
  source 1..18: mol_type = genomic DNA
ttccgctgattggttgga

SEQ ID NO: 21859 - DNA, 162 bp, Homo sapiens
  misc_feature 1..162: note = chr14:60794473-60794635
  misc_feature 1..162: note = hyper
  source 1..162: mol_type = genomic DNA
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcgg

SEQ ID NO: 21860 - DNA, 136 bp, Homo sapiens
  misc_feature 1..136: note = chr14:60794667-60794803
  misc_feature 1..136: note = hyper
  source 1..136: mol_type = genomic DNA
gcgccgcctgcgggaggacctccgggagccgagctgcctccccgcaaacccggcccgggcccacgcgggctcagggcgccaggcggggtgcgccgaggtgcagctccccggccctaggcttcgctggggtgggggt

SEQ ID NO: 21861 - DNA, 17 bp, Homo sapiens
  misc_feature 1..17: note = chr14:60978147-60978164
  misc_feature 1..17: note = hyper
  source 1..17: mol_type = genomic DNA
ggcgccctttggccgcg

SEQ ID NO: 21862 - DNA, 408 bp, Homo sapiens
  misc_feature 1..408: note = chr14:60981268-60981676
  misc_feature 1..408: note = hyper
  source 1..408: mol_type = genomic DNA
gacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcg

SEQ ID NO: 21863 - DNA, 40 bp, Homo sapiens
  misc_feature 1..40: note = chr14:60982911-60982951
  misc_feature 1..40: note = hyper
  source 1..40: mol_type = genomic DNA
acaagcagtttcacgcctccctgcccgctcatgctgtttc

SEQ ID NO: 21864 - DNA, 50 bp, Homo sapiens
  misc_feature 1..50: note = chr14:61104241-61104291
  misc_feature 1..50: note = hyper
  source 1..50: mol_type = genomic DNA
cggttgcaccccggacccctgcagctgtggacgccggagctgtgcgcagt

SEQ ID NO: 21865 - DNA, 111 bp, Homo sapiens
  misc_feature 1..111: note = chr14:61109728-61109839
  misc_feature 1..111: note = hyper
  source 1..111: mol_type = genomic DNA
ctgtgccaggtgtcccgttggccctcagcggacaagggagagccgctaataagggtcgctgctcagcaaactcagagctcatccataagtgccaacgccactgcttctttc

SEQ ID NO: 21866 - DNA, 257 bp, Homo sapiens
  misc_feature 1..257: note = chr14:61114456-61114713
  misc_feature 1..257: note = hyper
  source 1..257: mol_type = genomic DNA
gccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgagga

SEQ ID NO: 21867 - DNA, 314 bp, Homo sapiens
  misc_feature 1..314: note = chr14:61114997-61115311
  misc_feature 1..314: note = hyper
  source 1..314: mol_type = genomic DNA
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcc

SEQ ID NO: 21868 - DNA, 122 bp, Homo sapiens; identical to SEQ ID NO: 11927
  misc_feature 1..122: note = chr14:61115927-61116049
  misc_feature 1..122: note = hyper
  source 1..122: mol_type = genomic DNA

SEQ ID NO: 21869 - DNA, 30 bp, Homo sapiens; identical to SEQ ID NO: 11928
  misc_feature 1..30: note = chr14:61116998-61117028
  misc_feature 1..30: note = hyper
  source 1..30: mol_type = genomic DNA

SEQ ID NO: 21870 - DNA, 30 bp, Homo sapiens; identical to SEQ ID NO: 11929
  misc_feature 1..30: note = chr14:61655802-61655832
  misc_feature 1..30: note = hyper
  source 1..30: mol_type = genomic DNA

SEQ ID NO: 21871 - DNA, 73 bp, Homo sapiens; identical to SEQ ID NO: 11930
  misc_feature 1..73: note = chr14:61788757-61788830
  misc_feature 1..73: note = hyper
  source 1..73: mol_type = genomic DNA

SEQ ID NO: 21872 - DNA, 154 bp, Homo sapiens; identical to SEQ ID NO: 4151
  misc_feature 1..154: note = chr14:62279322-62279476
  misc_feature 1..154: note = hyper
  source 1..154: mol_type = genomic DNA

SEQ ID NO: 21873 - DNA, 59 bp, Homo sapiens
  misc_feature 1..59: note = chr14:62279519-62279578
  misc_feature 1..59: note = hyper
  source 1..59: mol_type = genomic DNA
cgactgacagtgagtgcgctccggccgcggaggccaggggtggggggaggccgcggtgc

SEQ ID NO: 21874 - DNA, 59 bp, Homo sapiens
  misc_feature 1..59: note = chr14:62583750-62583809
  misc_feature 1..59: note = hyper
  source 1..59: mol_type = genomic DNA
agccaaggcctgcagcgagtgacctgcccggggaggcgcgggaccgaggctcacctacc

SEQ ID NO: 21875 - DNA, 348 bp, Homo sapiens; identical to SEQ ID NO: 11936
  misc_feature 1..348: note = chr14:62583918-62584266
  misc_feature 1..348: note = hyper
  source 1..348: mol_type = genomic DNA

SEQ ID NO: 21876 - DNA, 124 bp, Homo sapiens; identical to SEQ ID NO: 4155
  misc_feature 1..124: note = chr14:63511883-63512007
  misc_feature 1..124: note = hyper
  source 1..124: mol_type = genomic DNA

SEQ ID NO: 21877 - DNA, 37 bp, Homo sapiens
  misc_feature 1..37: note = chr14:63512063-63512100
  misc_feature 1..37: note = hyper
  source 1..37: mol_type = genomic DNA
cgacccggatgagcagctctggggaggaggaccaggc

SEQ ID NO: 21878 - DNA, 282 bp, Homo sapiens
  misc_feature 1..282: note = chr14:63512291-63512573
  misc_feature 1..282: note = hyper
  source 1..282: mol_type = genomic DNA
tctgcatctctccccctgctggggagcgcaagcgggaactcaagcccccaccctcccaatccccctcagctcagaccgagaccccttccccgcgccttcgtctcccggtctcctcgtccaccccctcgcgcagcgagctccgggctgaacagcgtagcccaacttctgggctgtgcgcctggtggttgctcctctccccggagatcgaggcaagcgatcgctgtccaatcgggccggtggaatgggagaagagggtgccagagagagcagtggccagtcgga

SEQ ID NO: 21879 - skipped

SEQ ID NO: 21880 - DNA, 73 bp, Homo sapiens; identical to SEQ ID NO: 4158
  misc_feature 1..73: note = chr14:63513035-63513108
  misc_feature 1..73: note = hyper
  source 1..73: mol_type = genomic DNA

SEQ ID NO: 21881 - DNA, 66 bp, Homo sapiens; identical to SEQ ID NO: 11941
  misc_feature 1..66: note = chr14:64761073-64761139
  misc_feature 1..66: note = hyper
  source 1..66: mol_type = genomic DNA

SEQ ID NO: 21882 - DNA, 15 bp, Homo sapiens
  misc_feature 1..15: note = chr14:65007522-65007537
  misc_feature 1..15: note = hyper
  source 1..15: mol_type = genomic DNA
tctccctggttttcc

SEQ ID NO: 21883 - DNA, 15 bp, Homo sapiens
  misc_feature 1..15: note = chr14:65007552-65007567
  misc_feature 1..15: note = hyper
  source 1..15: mol_type = genomic DNA
cgcctttcagtcagg

SEQ ID NO: 21884 - skipped

SEQ ID NO: 21885 - DNA, 282 bp, Homo sapiens; identical to SEQ ID NO: 11945
  misc_feature 1..282: note = chr14:69726381-69726663
  misc_feature 1..282: note = hyper
  source 1..282: mol_type = genomic DNA

SEQ ID NO: 21886 - DNA, 34 bp, Homo sapiens; identical to SEQ ID NO: 11946
  misc_feature 1..34: note = chr14:69727831-69727865
  misc_feature 1..34: note = hyper
  source 1..34: mol_type = genomic DNA

SEQ ID NO: 21887 - DNA, 24 bp, Homo sapiens
  misc_feature 1..24: note = chr14:70014699-70014723
  misc_feature 1..24: note = hyper
  source 1..24: mol_type = genomic DNA
acagacaaagccttgcgggctcca

SEQ ID NO: 21888 - DNA, 116 bp, Homo sapiens
  misc_feature 1..116: note = chr14:70346020-70346136
  misc_feature 1..116: note = hyper
  source 1..116: mol_type = genomic DNA
cacctgccagagggtcggcttcaacaggcctcttggcccgtcaatcaggcccgccgtgctccgccccgcccctcccgggggtttataacgggaattcccatggcccgggctcaggc

SEQ ID NO: 21889 - DNA, 39 bp, Homo sapiens
  misc_feature 1..39: note = chr14:70346491-70346530
  misc_feature 1..39: note = hyper
  source 1..39: mol_type = genomic DNA
agggtaagtgcgcccccagctttgcgcccacctgcggag

SEQ ID NO: 21890 - DNA, 66 bp, Homo sapiens; identical to SEQ ID NO: 11949
  misc_feature 1..66: note = chr14:70653713-70653779
  misc_feature 1..66: note = hyper
  source 1..66: mol_type = genomic DNA

SEQ ID NO: 21891 - DNA, 220 bp, Homo sapiens; identical to SEQ ID NO: 1184
  misc_feature 1..220: note = chr14:70654070-70654290
  misc_feature 1..220: note = hyper
  source 1..220: mol_type = genomic DNA

SEQ ID NO: 21892 - DNA, 52 bp, Homo sapiens
  misc_feature 1..52: note = chr14:70654291-70654343
  misc_feature 1..52: note = hyper
  source 1..52: mol_type = genomic DNA
ctagcctctgaatcagggctttgactgtgtgtgtgtgtgtgtgtgtgtgtgt

SEQ ID NO: 21893 - DNA, 74 bp, Homo sapiens
  misc_feature 1..74: note = chr14:70654713-70654787
  misc_feature 1..74: note = hyper
  source 1..74: mol_type = genomic DNA
acacacaacacagcagtcagtctccccaaacagcacccgctaccaacccagcatgctcacgatccaactgtacc

SEQ ID NO: 21894 - DNA, 498 bp, Homo sapiens
  misc_feature 1..498: note = chr14:70655032-70655530
  misc_feature 1..498: note = hyper
  source 1..498: mol_type = genomic DNA
ctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctc

SEQ ID NO: 21895 - DNA, 57 bp, Homo sapiens
  misc_feature 1..57: note = chr14:72398686-72398743
  misc_feature 1..57: note = hyper
  source 1..57: mol_type = genomic DNA
ttttaatttagagggcgccagcaacacgtcagtgagggagattcagaagccgccggg

SEQ ID NO: 21896 - DNA, 214 bp, Homo sapiens
  misc_feature 1..214: note = chr14:72399019-72399233
  misc_feature 1..214: note = hyper
  source 1..214: mol_type = genomic DNA
gcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 21897 - DNA, 61 bp, Homo sapiens; identical to SEQ ID NO: 11959
  misc_feature 1..61: note = chr14:74208236-74208297
  misc_feature 1..61: note = hyper
  source 1..61: mol_type = genomic DNA

SEQ ID NO: 21898 - DNA, 175 bp, Homo sapiens
  misc_feature 1..175: note = chr14:74706222-74706397
  misc_feature 1..175: note = hyper
  source 1..175: mol_type = genomic DNA
agctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccc

SEQ ID NO: 21899 - DNA, 38 bp, Homo sapiens
  misc_feature 1..38: note = chr14:74707873-74707911
  misc_feature 1..38: note = hyper
  source 1..38: mol_type = genomic DNA
ccgcttttcagattctgaagatgtttcctccagcgatc

SEQ ID NO: 21900 - DNA, 418 bp, Homo sapiens; identical to SEQ ID NO: 1192
  misc_feature 1..418: note = chr14:74707912-74708330
  misc_feature 1..418: note = hyper
  source 1..418: mol_type = genomic DNA

SEQ ID NO: 21901 - DNA, 81 bp, Homo sapiens
  misc_feature 1..81: note = chr14:74708955-74709036
  misc_feature 1..81: note = hyper
  source 1..81: mol_type = genomic DNA
gggccgccacagactctgcgccctttcaagacatttctccactagggcgttctctggcacccccgccgccacatcgttttc

SEQ ID NO: 21902 - DNA, 30 bp, Homo sapiens; identical to SEQ ID NO: 11967
  misc_feature 1..30: note = chr14:75077906-75077936
  misc_feature 1..30: note = hyper
  source 1..30: mol_type = genomic DNA

SEQ ID NO: 21903 - DNA, 185 bp, Homo sapiens; identical to SEQ ID NO: 11968
  misc_feature 1..185: note = chr14:75078651-75078836
  misc_feature 1..185: note = hyper
  source 1..185: mol_type = genomic DNA

SEQ ID NO: 21904 - DNA, 85 bp, Homo sapiens
  misc_feature 1..85: note = chr14:76604597-76604682
  misc_feature 1..85: note = hyper
  source 1..85: mol_type = genomic DNA
tcagggttggcttcacggaggagggggtatctgagctgagctttgatgaatacgtcagatttgggggaaaggttgctgctggata

SEQ ID NO: 21905 - DNA, 89 bp, Homo sapiens
  misc_feature 1..89: note = chr14:76604716-76604805
  misc_feature 1..89: note = hyper
  source 1..89: mol_type = genomic DNA
tgccaacaggtcagggggggaaagttggggaatggggtgggaggaggaagaattagactggccccttccatcatcgccatccttctgtg

SEQ ID NO: 21906 - DNA, 32 bp, Homo sapiens
  misc_feature 1..32: note = chr14:76605040-76605072
  misc_feature 1..32: note = hyper
  source 1..32: mol_type = genomic DNA
caagaaaaaagggagcgcagcgccgttcccac

SEQ ID NO: 21907 - DNA, 92 bp, Homo sapiens; identical to SEQ ID NO: 11971
  misc_feature 1..92: note = chr14:76819300-76819392
  misc_feature 1..92: note = hyper
  source 1..92: mol_type = genomic DNA

SEQ ID NO: 21908 - DNA, 10 bp, Homo sapiens
  misc_feature 1..10: note = chr14:76843732-76843742
  misc_feature 1..10: note = hyper
  source 1..10: mol_type = genomic DNA
cgctccacct

SEQ ID NO: 21909 - DNA, 41 bp, Homo sapiens
  misc_feature 1..41: note = chr14:76843953-76843994
  misc_feature 1..41: note = hyper
  source 1..41: mol_type = genomic DNA
ccaagtcagcgtttctccagttccaccgtgctttcatttgt

SEQ ID NO: 21910 - DNA, 102 bp, Homo sapiens; identical to SEQ ID NO: 11973
  misc_feature 1..102: note = chr14:77227622-77227724
  misc_feature 1..102: note = hyper
  source 1..102: mol_type = genomic DNA

SEQ ID NO: 21911 - DNA, 60 bp, Homo sapiens; identical to SEQ ID NO: 11974
  misc_feature 1..60: note = chr14:77228674-77228734
  misc_feature 1..60: note = hyper
  source 1..60: mol_type = genomic DNA

SEQ ID NO: 21912 - DNA, 46 bp, Homo sapiens; identical to SEQ ID NO: 11975
  misc_feature 1..46: note = chr14:77591352-77591398
  misc_feature 1..46: note = hyper
  source 1..46: mol_type = genomic DNA

SEQ ID NO: 21913 - DNA, 43 bp, Homo sapiens; identical to SEQ ID NO: 11976
  misc_feature 1..43: note = chr14:77606813-77606856
  misc_feature 1..43: note = hyper
  source 1..43: mol_type = genomic DNA

SEQ ID NO: 21914 - DNA, 89 bp, Homo sapiens; identical to SEQ ID NO: 11978
  misc_feature 1..89: note = chr14:77607253-77607342
  misc_feature 1..89: note = hyper
  source 1..89: mol_type = genomic DNA

SEQ ID NO: 21915 - DNA, 177 bp, Homo sapiens; identical to SEQ ID NO: 11979
  misc_feature 1..177: note = chr14:77607930-77608107
  misc_feature 1..177: note = hyper
  source 1..177: mol_type = genomic DNA

SEQ ID NO: 21916 - DNA, 75 bp, Homo sapiens; identical to SEQ ID NO: 11980
  misc_feature 1..75: note = chr14:77737071-77737146
  misc_feature 1..75: note = hyper
  source 1..75: mol_type = genomic DNA

SEQ ID NO: 21917 - DNA, 65 bp, Homo sapiens
  misc_feature 1..65: note = chr14:77737147-77737212
  misc_feature 1..65: note = hyper
  source 1..65: mol_type = genomic DNA
aggcagcctccacccgcatccccgggcgctcgtgtagccctcacctggcaaacaggacggtgccg

SEQ ID NO: 21918 - DNA, 148 bp, Homo sapiens; identical to SEQ ID NO: 11982
  misc_feature 1..148: note = chr14:77964498-77964646
  misc_feature 1..148: note = hyper
  source 1..148: mol_type = genomic DNA

SEQ ID NO: 21919 - DNA, 30 bp, Homo sapiens; identical to SEQ ID NO: 11983
  misc_feature 1..30: note = chr14:78624601-78624631
  misc_feature 1..30: note = hyper
  source 1..30: mol_type = genomic DNA

SEQ ID NO: 21920 - DNA, 10 bp, Homo sapiens
  misc_feature 1..10: note = chr14:85999522-85999532
  misc_feature 1..10: note = hyper
  source 1..10: mol_type = genomic DNA
gctccaggag

SEQ ID NO: 21921 - DNA, 57 bp, Homo sapiens
  misc_feature 1..57: note = chr14:85999613-85999670
  misc_feature 1..57: note = hyper
  source 1..57: mol_type = genomic DNA
aaacatatccgggggtgtcaggaggggtaggggtgggggccgcggcgcctacattag

SEQ ID NO: 21922 - DNA, 120 bp, Homo sapiens; identical to SEQ ID NO: 11990
  misc_feature 1..120: note = chr14:88789455-88789575
  misc_feature 1..120: note = hyper
  source 1..120: mol_type = genomic DNA

SEQ ID NO: 21923 - DNA, 90 bp, Homo sapiens; identical to SEQ ID NO: 11991
  misc_feature 1..90: note = chr14:88790076-88790166
  misc_feature 1..90: note = hyper
  source 1..90: mol_type = genomic DNA

SEQ ID NO: 21924 - DNA, 67 bp, Homo sapiens; identical to SEQ ID NO: 11992
  misc_feature 1..67: note = chr14:88790467-88790534
  misc_feature 1..67: note = hyper
  source 1..67: mol_type = genomic DNA

SEQ ID NO: 21925 - DNA, 80 bp, Homo sapiens; identical to SEQ ID NO: 11993
  misc_feature 1..80: note = chr14:88793005-88793085
  misc_feature 1..80: note = hyper
  source 1..80: mol_type = genomic DNA

SEQ ID NO: 21926 - DNA, 487 bp, Homo sapiens; identical to SEQ ID NO: 4176
  misc_feature 1..487: note = chr14:90084100-90084587
  misc_feature 1..487: note = hyper
  source 1..487: mol_type = genomic DNA

SEQ ID NO: 21927 - DNA, 266 bp, Homo sapiens; identical to SEQ ID NO: 11996
  misc_feature 1..266: note = chr14:90526555-90526821
  misc_feature 1..266: note = hyper
  source 1..266: mol_type = genomic DNA

SEQ ID NO: 21928 - DNA, 173 bp, Homo sapiens
  misc_feature 1..173: note = chr14:90527758-90527931
  misc_feature 1..173: note = hyper
  source 1..173: mol_type = genomic DNA
tcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 21929 - DNA, 118 bp, Homo sapiens; identical to SEQ ID NO: 11998
  misc_feature 1..118: note = chr14:90528584-90528702
  misc_feature 1..118: note = hyper
  source 1..118: mol_type = genomic DNA

SEQ ID NO: 21930 - DNA, 53 bp, Homo sapiens; identical to SEQ ID NO: 11999
  misc_feature 1..53: note = chr14:90850275-90850328
  misc_feature 1..53: note = hyper
  source 1..53: mol_type = genomic DNA

SEQ ID NO: 21931 - DNA, 53 bp, Homo sapiens; identical to SEQ ID NO: 12000
  misc_feature 1..53: note = chr14:91580352-91580405
  misc_feature 1..53: note = hyper
  source 1..53: mol_type = genomic DNA

SEQ ID NO: 21932 - DNA, 38 bp, Homo sapiens; identical to SEQ ID NO: 12001
  misc_feature 1..38: note = chr14:92040828-92040866
  misc_feature 1..38: note = hyper
  source 1..38: mol_type = genomic DNA

SEQ ID NO: 21933 - DNA, 10 bp, Homo sapiens
  misc_feature 1..10: note = chr14:92789502-92789512
  misc_feature 1..10: note = hyper
  source 1..10: mol_type = genomic DNA
cctctcagac

SEQ ID NO: 21934 - DNA, 20 bp, Homo sapiens
  misc_feature 1..20: note = chr14:92789802-92789822
  misc_feature 1..20: note = hyper
  source 1..20: mol_type = genomic DNA
agggctgtggccgggcgagc

SEQ ID NO: 21935 - DNA, 201 bp, Homo sapiens
  misc_feature 1..201: note = chr14:92790436-92790637
  misc_feature 1..201: note = hyper
  source 1..201: mol_type = genomic DNA
gccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctc

SEQ ID NO: 21936 - DNA, 53 bp, Homo sapiens; identical to SEQ ID NO: 12006
  misc_feature 1..53: note = chr14:92979781-92979834
  misc_feature 1..53: note = hyper
  source 1..53: mol_type = genomic DNA

SEQ ID NO: 21937 - DNA, 232 bp, Homo sapiens; identical to SEQ ID NO: 12007
  misc_feature 1..232: note = chr14:92980429-92980661
  misc_feature 1..232: note = hyper
  source 1..232: mol_type = genomic DNA

SEQ ID NO: 21938 - DNA, 242 bp, Homo sapiens; identical to SEQ ID NO: 12010
  misc_feature 1..242: note = chr14:93897200-93897442
  misc_feature 1..242: note = hyper
  source 1..242: mol_type = genomic DNA

SEQ ID NO: 21939 - DNA, 54 bp, Homo sapiens
  misc_feature 1..54: note = chr14:94254335-94254389
  misc_feature 1..54: note = hyper
  source 1..54: mol_type = genomic DNA
agctccagaatactgcgtgcataccttggccccatggacacctccagaaacagc

SEQ ID NO: 21940 - DNA, 124 bp, Homo sapiens
  misc_feature 1..124: note = chr14:94254513-94254637
  misc_feature 1..124: note = hyper
  source 1..124: mol_type = genomic DNA
atccccgtgcacacccaccgactcctgcctgcaccctcgctgaccctgcatgcacggccccaagaaatctcacgctgcctgcacccacactgcccagccggcctcattgcgcacactgcaacat

SEQ ID NO: 21941 - skipped

SEQ ID NO: 21942 - DNA, 42 bp, Homo sapiens; identical to SEQ ID NO: 12014
  misc_feature 1..42: note = chr14:94255304-94255346
  misc_feature 1..42: note = hyper
  source 1..42: mol_type = genomic DNA

SEQ ID NO: 21943 - DNA, 23 bp, Homo sapiens
  misc_feature 1..23: note = chr14:94255584-94255607
  misc_feature 1..23: note = hyper
  source 1..23: mol_type = genomic DNA
cccccaagcctctcccgaggctg

SEQ ID NO: 21944 - DNA, 46 bp, Homo sapiens; identical to SEQ ID NO: 12016
  misc_feature 1..46: note = chr14:94255669-94255715
  misc_feature 1..46: note = hyper
  source 1..46: mol_type = genomic DNA

SEQ ID NO: 21945 - DNA, 33 bp, Homo sapiens
  misc_feature 1..33: note = chr14:94405701-94405734
  misc_feature 1..33: note = hyper
  source 1..33: mol_type = genomic DNA
ttgtgcgcaggcagccgtggcggatggccacga

SEQ ID NO: 21946 - DNA, 203 bp, Homo sapiens
  misc_feature 1..203: note = chr14:94405785-94405988
  misc_feature 1..203: note = hyper
  source 1..203: mol_type = genomic DNA
gctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcgg

SEQ ID NO: 21947 - DNA, 14 bp, Homo sapiens
  misc_feature 1..14: note = chr14:95235369-95235383
  misc_feature 1..14: note = hyper
  source 1..14: mol_type = genomic DNA
ctggaagaggttct

SEQ ID NO: 21948 - DNA, 30 bp, Homo sapiens; identical to SEQ ID NO: 12019
  misc_feature 1..30: note = chr14:95235665-95235695
  misc_feature 1..30: note = hyper
  source 1..30: mol_type = genomic DNA

SEQ ID NO: 21949 - DNA, 79 bp, Homo sapiens
  misc_feature 1..79: note = chr14:95236111-95236190
  misc_feature 1..79: note = hyper
  source 1..79: mol_type = genomic DNA
tgtagccgaggcgggagccgctgaccgcggccgggaggcccgcgccgccgggggccacggggcgcgggtagaaggcgcc

SEQ ID NO: 21950 - DNA, 30 bp, Homo sapiens; identical to SEQ ID NO: 12021
  misc_feature 1..30: note = chr14:95237011-95237041
  misc_feature 1..30: note = hyper
  source 1..30: mol_type = genomic DNA

SEQ ID NO: 21951 - DNA, 30 bp, Homo sapiens; identical to SEQ ID NO: 12023
  misc_feature 1..30: note = chr14:95240484-95240514
  misc_feature 1..30: note = hyper
  source 1..30: mol_type = genomic DNA

SEQ ID NO: 21952 - DNA, 24 bp, Homo sapiens
  misc_feature 1..24: note = chr14:96342286-96342310
  misc_feature 1..24: note = hyper
  source 1..24: mol_type = genomic DNA
aagccacattcgccacgctcccgc

SEQ ID NO: 21953 - DNA, 26 bp, Homo sapiens
  misc_feature 1..26: note = chr14:96342605-96342631
  misc_feature 1..26: note = hyper
  source 1..26: mol_type = genomic DNA
cgcagcgcgcgtcagcgggggctccc

SEQ ID NO: 21954-21955 - skipped (2 entries)

SEQ ID NO: 21956 - DNA, 84 bp, Homo sapiens
  misc_feature 1..84: note = chr14:96343701-96343785
  misc_feature 1..84: note = hyper
  source 1..84: mol_type = genomic DNA
ctttcttctgccttctggagaaagatgtgggtttgacatgcaggcgggagacctgtctggtctagataacggcatgtgtatgca

SEQ ID NO: 21957 - DNA, 173 bp, Homo sapiens
  misc_feature 1..173: note = chr14:97499315-97499488
  misc_feature 1..173: note = hyper
  source 1..173: mol_type = genomic DNA
gatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccc

SEQ ID NO: 21958 - DNA, 73 bp, Homo sapiens
  misc_feature 1..73: note = chr14:97684971-97685044
  misc_feature 1..73: note = hyper
  source 1..73: mol_type = genomic DNA
agtgacgactggattcggaattttcctctcacttcgtggtagtgaagaatttaactacaacagtaacaacact

SEQ ID NO: 21959 - DNA, 131 bp, Homo sapiens; identical to SEQ ID NO: 4180
  misc_feature 1..131: note = chr14:97685497-97685628
  misc_feature 1..131: note = hyper
  source 1..131: mol_type = genomic DNA

SEQ ID NO: 21960 - skipped

SEQ ID NO: 21961 - DNA, 32 bp, Homo sapiens; identical to SEQ ID NO: 12035
  misc_feature 1..32: note = chr14:99740538-99740570
  misc_feature 1..32: note = hyper
  source 1..32: mol_type = genomic DNA

SEQ ID NO: 21962 - DNA, 84 bp, Homo sapiens; identical to SEQ ID NO: 12036
  misc_feature 1..84: note = chr14:100111793-100111877
  misc_feature 1..84: note = hyper
  source 1..84: mol_type = genomic DNA

SEQ ID NO: 21963 - DNA, 333 bp, Homo sapiens; identical to SEQ ID NO: 12037
  misc_feature 1..333: note = chr14:100125656-100125989
  misc_feature 1..333: note = hyper
  source 1..333: mol_type = genomic DNA

SEQ ID NO: 21964 - DNA, 234 bp, Homo sapiens
  misc_feature 1..234: note = chr14:100437560-100437794
  misc_feature 1..234: note = hyper
  source 1..234: mol_type = genomic DNA
ggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggcc

SEQ ID NO: 21965 - DNA, 160 bp, Homo sapiens; identical to SEQ ID NO: 12039
  misc_feature 1..160: note = chr14:100438017-100438177
  misc_feature 1..160: note = hyper
  source 1..160: mol_type = genomic DNA

SEQ ID NO: 21966 - DNA, 30 bp, Homo sapiens; identical to SEQ ID NO: 12040
  misc_feature 1..30: note = chr14:100438385-100438415
  misc_feature 1..30: note = hyper
  source 1..30: mol_type = genomic DNA

SEQ ID NO: 21967 - DNA, 74 bp, Homo sapiens
  misc_feature 1..74: note = chr14:100438631-100438705
  misc_feature 1..74: note = hyper
  source 1..74: mol_type = genomic DNA
tctgcaaggggcaggcggcgctggctttggctgcttgtggggtcctcttaggctccggggggcctgcggcggcc

SEQ ID NO: 21968 - DNA, 120 bp, Homo sapiens
  misc_feature 1..120: note = chr14:100438811-100438931
  misc_feature 1..120: note = hyper
  source 1..120: mol_type = genomic DNA
tgaagcccccaggcgttgccgaagcctccccctgccagcgcccagagccgcgtttgggcttttacaggtgtagtttcccctcgacttggagcccgtcaaccccttcgtctcctaattctc

SEQ ID NO: 21969 - DNA, 45 bp, Homo sapiens; identical to SEQ ID NO: 12042
  misc_feature 1..45: note = chr14:101033483-101033528
  misc_feature 1..45: note = hyper
  source 1..45: mol_type = genomic DNA

SEQ ID NO: 21970 - DNA, 50 bp, Homo sapiens; identical to SEQ ID NO: 12043
  misc_feature 1..50: note = chr14:101034056-101034106
  misc_feature 1..50: note = hyper
  source 1..50: mol_type = genomic DNA

SEQ ID NO: 21971 - DNA, 328 bp, Homo sapiens; identical to SEQ ID NO: 12044
  misc_feature 1..328: note = chr14:101035152-101035480
  misc_feature 1..328: note = hyper
  source 1..328: mol_type = genomic DNA

SEQ ID NO: 21972 - DNA, 40 bp, Homo sapiens
  misc_feature 1..40: note = chr14:101543828-101543868
  misc_feature 1..40: note = hyper
  source 1..40: mol_type = genomic DNA
gggatgcaatttccccggtgtttttcaggcccagagctat

SEQ ID NO: 21973 - DNA, 40 bp, Homo sapiens
  misc_feature 1..40: note = chr14:101923560-101923600
  misc_feature 1..40: note = hyper
  source 1..40: mol_type = genomic DNA
aaaagaggttctcagcggagcgtgtgtgaggcggggggtt

SEQ ID NO: 21974 - DNA, 10 bp, Homo sapiens
  misc_feature 1..10: note = chr14:101924047-101924057
  misc_feature 1..10: note = hyper
  source 1..10: mol_type = genomic DNA
tccccgacgc

SEQ ID NO: 21975-21976 - skipped (2 entries)

SEQ ID NO: 21977 - DNA, 191 bp, Homo sapiens
  misc_feature 1..191: note = chr14:101924858-101925049
  misc_feature 1..191: note = hyper
  source 1..191: mol_type = genomic DNA
ggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgc

SEQ ID NO: 21978 - DNA, 81 bp, Homo sapiens
  misc_feature 1..81: note = chr14:101925901-101925982
  misc_feature 1..81: note = hyper
  source 1..81: mol_type = genomic DNA
acccaggaaggacgcccgccgttcccagcaccccagcgtctgaaaaatgaatgtgaactccgcaagcgtgctcccgcggac

SEQ ID NO: 21979 - DNA, 146 bp, Homo sapiens
  misc_feature 1..146: note = chr14:102026214-102026360
  misc_feature 1..146: note = hyper
  source 1..146: mol_type = genomic DNA
cgctggcggcggcggcggcttccgacttgggctcagaccccgccgctccagacaagtccccgcgactgcgacagtgtctcgggcagttcagctccccagacgggagacagaccctcgcgacctggttcaggccttgccctggggga

SEQ ID NO: 21980 - DNA, 274 bp, Homo sapiens; identical to SEQ ID NO: 12055
  misc_feature 1..274: note = chr14:102029904-102030178
  misc_feature 1..274: note = hyper
  source 1..274: mol_type = genomic DNA

SEQ ID NO: 21981 - DNA, 48 bp, Homo sapiens; identical to SEQ ID NO: 12056
  misc_feature 1..48: note = chr14:102030756-102030804
  misc_feature 1..48: note = hyper
  source 1..48: mol_type = genomic DNA

SEQ ID NO: 21982 - DNA, 120 bp, Homo sapiens
  misc_feature 1..120: note = chr14:102247792-102247912
  misc_feature 1..120: note = hyper
  source 1..120: mol_type = genomic DNA
acccgcgtgggctcccgccgggccctcctgccgccccccagcctccccgcccctgcccttgccagcctgcgccttcctgggcgcctgacgcacccctctgccccaaccacgttttctcaa

SEQ ID NO: 21983 - DNA, 49 bp, Homo sapiens
  misc_feature 1..49: note = chr14:103021342-103021391
  misc_feature 1..49: note = hyper
  source 1..49: mol_type = genomic DNA
cgctttgggtcttgtcgcgcccaggccagcgccagcccaggcttgccat

SEQ ID NO: 21984 - DNA, 85 bp, Homo sapiens
  misc_feature 1..85: note = chr14:103022003-103022088
  misc_feature 1..85: note = hyper
  source 1..85: mol_type = genomic DNA
agcttctctggaagacctggtgctggtccgctctcccgggacctcattttccttatgtggacaacgggggcggggtcacagcagc

SEQ ID NO: 21985 - DNA, 90 bp, Homo sapiens; identical to SEQ ID NO: 12059
  misc_feature 1..90: note = chr14:103389798-103389888
  misc_feature 1..90: note = hyper
  source 1..90: mol_type = genomic DNA

SEQ ID NO: 21986 - DNA, 101 bp, Homo sapiens; identical to SEQ ID NO: 12060
  misc_feature 1..101: note = chr14:103394683-103394784
  misc_feature 1..101: note = hyper
  source 1..101: mol_type = genomic DNA

SEQ ID NO: 21987 - DNA, 112 bp, Homo sapiens
  misc_feature 1..112: note = chr14:103395101-103395213
  misc_feature 1..112: note = hyper
  source 1..112: mol_type = genomic DNA
tgccgtcttccgcgactctgaccgcttctcctggcatgacccgcacctgtggcgctctggggacgaggcacctggcctcttcttcgtggacgccgagcgcgtgccctgccgc

SEQ ID NO: 21988 - DNA, 92 bp, Homo sapiens; identical to SEQ ID NO: 12062
  misc_feature 1..92: note = chr14:103550468-103550560
  misc_feature 1..92: note = hyper
  source 1..92: mol_type = genomic DNA

SEQ ID NO: 21989 - DNA, 45 bp, Homo sapiens
  misc_feature 1..45: note = chr14:103655601-103655646
  misc_feature 1..45: note = hyper
  source 1..45: mol_type = genomic DNA
agtgtgcaggggccaccctctccccagccccgccccccgagtcca

SEQ ID NO: 21990 - DNA, 44 bp, Homo sapiens; identical to SEQ ID NO: 12065
  misc_feature 1..44: note = chr14:103687345-103687389
  misc_feature 1..44: note = hyper
  source 1..44: mol_type = genomic DNA

SEQ ID NO: 21991 - DNA, 18 bp, Homo sapiens
  misc_feature 1..18: note = chr14:103739949-103739967
  misc_feature 1..18: note = hyper
  source 1..18: mol_type = genomic DNA
ctccgaggcttcctacgt

SEQ ID NO: 21992 - skipped

SEQ ID NO: 21993 - DNA, 102 bp, Homo sapiens; identical to SEQ ID NO: 12069
  misc_feature 1..102: note = chr14:103989352-103989454
  misc_feature 1..102: note = hyper
  source 1..102: mol_type = genomic DNA

SEQ ID NO: 21994 - DNA, 35 bp, Homo sapiens; identical to SEQ ID NO: 12070
  misc_feature 1..35: note = chr14:104602310-104602345
  misc_feature 1..35: note = hyper
  source 1..35: mol_type = genomic DNA

SEQ ID NO: 21995 - DNA, 65 bp, Homo sapiens; identical to SEQ ID NO: 12071
  misc_feature 1..65: note = chr14:104602711-104602776
  misc_feature 1..65: note = hyper
  source 1..65: mol_type = genomic DNA

SEQ ID NO: 21996 - DNA, 36 bp, Homo sapiens; identical to SEQ ID NO: 12072
  misc_feature 1..36: note = chr14:104604637-104604673
  misc_feature 1..36: note = hyper
  source 1..36: mol_type = genomic DNA

SEQ ID NO: 21997 - DNA, 130 bp, Homo sapiens
  misc_feature 1..130: note = chr14:104604902-104605032
  misc_feature 1..130: note = hyper
  source 1..130: mol_type = genomic DNA
agccaccgcgctcctcgcgacactcgcaggctctgcgaacttccgagcggctgggccgggccatgggggcgcctcggggccggatcacgtagccgcggcgcccccggagagccagcgtggccgggagcgc

SEQ ID NO: 21998 - DNA, 156 bp, Homo sapiens
  misc_feature 1..156: note = chr14:104605114-104605270
  misc_feature 1..156: note = hyper
  source 1..156: mol_type = genomic DNA
ggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcc

SEQ ID NO: 21999 - DNA, 91 bp, Homo sapiens; identical to SEQ ID NO: 12074
  misc_feature 1..91: note = chr14:105070996-105071087
  misc_feature 1..91: note = hyper
  source 1..91: mol_type = genomic DNA

SEQ ID NO: 22000 - DNA, 47 bp, Homo sapiens; identical to SEQ ID NO: 12075
  misc_feature 1..47: note = chr14:105310190-105310237
  misc_feature 1..47: note = hyper
  source 1..47: mol_type = genomic DNA

SEQ ID NO: 22001 - DNA, 77 bp, Homo sapiens; identical to SEQ ID NO: 12076
  misc_feature 1..77: note = chr14:105310576-105310653
  misc_feature 1..77: note = hyper
  source 1..77: mol_type = genomic DNA

SEQ ID NO: 22002 - DNA, 62 bp, Homo sapiens
  misc_feature 1..62: note = chr14:105714334-105714396
  misc_feature 1..62: note = hyper
  source 1..62: mol_type = genomic DNA
gctccagggctgcaggcccagggccagatcctgacttgcccacccgccggctgtgtgacctt

SEQ ID NO: 22003 - DNA, 60 bp, Homo sapiens
  misc_feature 1..60: note = chr15:23158337-23158397
  misc_feature 1..60: note = hyper
  source 1..60: mol_type = genomic DNA
cgggtcaccgcaccccgagatgtgcccccaaggctctttcgaccgccgtgaagtggcggg

SEQ ID NO: 22004 - DNA, 38 bp, Homo sapiens
  misc_feature 1..38: note = chr15:23158489-23158527
  misc_feature 1..38: note = hyper
  source 1..38: mol_type = genomic DNA
ggctcagtgtctagggccggtcccggcagccctctctc

SEQ ID NO: 22005 - DNA, 236 bp, Homo sapiens
  misc_feature 1..236: note = chr15:26107860-26108096
  misc_feature 1..236: note = hyper
  source 1..236: mol_type = genomic DNA
cacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcg

SEQ ID NO: 22006 - DNA, 17 bp, Homo sapiens
  misc_feature 1..17: note = chr15:26327547-26327564
  misc_feature 1..17: note = hyper
  source 1..17: mol_type = genomic DNA
ctgcgcctgcgcctgcg

SEQ ID NO: 22007 - DNA, 213 bp, Homo sapiens; identical to SEQ ID NO: 12082
  misc_feature 1..213: note = chr15:26327610-26327823
  misc_feature 1..213: note = hyper
  source 1..213: mol_type = genomic DNA

SEQ ID NO: 22008 - DNA, 30 bp, Homo sapiens; identical to SEQ ID NO: 12083
  misc_feature 1..30: note = chr15:27016662-27016692
  misc_feature 1..30: note = hyper
  source 1..30: mol_type = genomic DNA

SEQ ID NO: 22009 - DNA, 30 bp, Homo sapiens; identical to SEQ ID NO: 12084
  misc_feature 1..30: note = chr15:27017778-27017808
  misc_feature 1..30: note = hyper
  source 1..30: mol_type = genomic DNA

SEQ ID NO: 22010 - DNA, 28 bp, Homo sapiens
  misc_feature 1..28: note = chr15:27018301-27018329
  misc_feature 1..28: note = hyper
  source 1..28: mol_type = genomic DNA
cgcgcgggcgcggggcgggggaggaggc

SEQ ID NO: 22011 - DNA, 17 bp, Homo sapiens
  misc_feature 1..17: note = chr15:27113012-27113029
  misc_feature 1..17: note = hyper
  source 1..17: mol_type = genomic DNA
cgcgctcccagcccagg

SEQ ID NO: 22012 - DNA, 139 bp, Homo sapiens; identical to SEQ ID NO: 12088
  misc_feature 1..139: note = chr15:28340433-28340572
  misc_feature 1..139: note = hyper
  source 1..139: mol_type = genomic DNA

SEQ ID NO: 22013 - DNA, 15 bp, Homo sapiens
  misc_feature 1..15: note = chr15:28342521-28342536
  misc_feature 1..15: note = hyper
  source 1..15: mol_type = genomic DNA
cggccccaaggagct

SEQ ID NO: 22014 - DNA, 30 bp, Homo sapiens; identical to SEQ ID NO: 12092
  misc_feature 1..30: note = chr15:28344134-28344164
  misc_feature 1..30: note = hyper
  source 1..30: mol_type = genomic DNA

SEQ ID NO: 22015 - DNA, 61 bp, Homo sapiens; identical to SEQ ID NO: 12093
  misc_feature 1..61: note = chr15:28351758-28351819
  misc_feature 1..61: note = hyper
  source 1..61: mol_type = genomic DNA

SEQ ID NO: 22016 - DNA, 77 bp, Homo sapiens; identical to SEQ ID NO: 4192
  misc_feature 1..77: note = chr15:28352021-28352098
  misc_feature 1..77: note = hyper
  source 1..77: mol_type = genomic DNA

SEQ ID NO: 22017 - DNA, 22 bp, Homo sapiens
  misc_feature 1..22: note = chr15:28352099-28352121
  misc_feature 1..22: note = hyper
  source 1..22: mol_type = genomic DNA
ggctctggccccacggtgagcc

SEQ ID NO: 22018 - DNA, 88 bp, Homo sapiens
  misc_feature 1..88: note = chr15:28352152-28352240
  misc_feature 1..88: note = hyper
  source 1..88: mol_type = genomic DNA
cgcgcggggagggagagtccggcagggtcacgaggcgccggccccggggccgcttgaaacccgaagagaccccgctcgctcgcgcgcc

SEQ ID NO: 22019 - DNA, 38 bp, Homo sapiens
  misc_feature 1..38: note = chr15:29077246-29077284
  misc_feature 1..38: note = hyper
  source 1..38: mol_type = genomic DNA
acttccgtaggagtgcgggtgtgcgtgcgtgccgcgga

SEQ ID NO: 22020 - DNA, 11 bp, Homo sapiens
  misc_feature 1..11: note = chr15:29077383-29077394
  misc_feature 1..11: note = hyper
  source 1..11: mol_type = genomic DNA
gagcggcgaag

SEQ ID NO: 22021 - DNA, 170 bp, Homo sapiens; identical to SEQ ID NO: 4196
  misc_feature 1..170: note = chr15:29077428-29077598
  misc_feature 1..170: note = hyper
  source 1..170: mol_type = genomic DNA

SEQ ID NO: 22022 - DNA, 50 bp, Homo sapiens
  misc_feature 1..50: note = chr15:29130757-29130807
  misc_feature 1..50: note = hyper
  source 1..50: mol_type = genomic DNA
caaggtgcggagcctcgcgttcaccggctctacctgcggagcctcgcgtt

SEQ ID NO: 22023 - DNA, 32 bp, Homo sapiens
  misc_feature 1..32: note = chr15:29131875-29131907
  misc_feature 1..32: note = hyper
  source 1..32: mol_type = genomic DNA
acccaagcccagatcttcgcccccttcccttt

SEQ ID NO: 22024 - DNA, 30 bp, Homo sapiens; identical to SEQ ID NO: 12102
  misc_feature 1..30: note = chr15:29407444-29407474
  misc_feature 1..30: note = hyper
  source 1..30: mol_type = genomic DNA

SEQ ID NO: 22025 - DNA, 97 bp, Homo sapiens; identical to SEQ ID NO: 12103
  misc_feature 1..97: note = chr15:29862098-29862195
  misc_feature 1..97: note = hyper
  source 1..97: mol_type = genomic DNA

SEQ ID NO: 22026 - DNA, 47 bp, Homo sapiens; identical to SEQ ID NO: 12104
  misc_feature 1..47: note = chr15:29863563-29863610
  misc_feature 1..47: note = hyper
  source 1..47: mol_type = genomic DNA

SEQ ID NO: 22027 - DNA, 90 bp, Homo sapiens; identical to SEQ ID NO: 12105
  misc_feature 1..90: note = chr15:30260547-30260637
  misc_feature 1..90: note = hyper
  source 1..90: mol_type = genomic DNA

SEQ ID NO: 22028 - DNA, 95 bp, Homo sapiens; identical to SEQ ID NO: 12106
  misc_feature 1..95: note = chr15:30261046-30261141
  misc_feature 1..95: note = hyper
  source 1..95: mol_type = genomic DNA

SEQ ID NO: 22029 - skipped

SEQ ID NO: 22030 - DNA, 113 bp, Homo sapiens
  misc_feature 1..113: note = chr15:31775483-31775596
  misc_feature 1..113: note = hyper
  source 1..113: mol_type = genomic DNA
cgcgccgcgccgctcagggccgggccccgcgcgcctcgcgccgccgccgcagctcctcgcggtagcagtaggagcagtagtgctcggtctcggcgcgcccgtagaacgcacag

SEQ ID NO: 22031 - DNA, 76 bp, Homo sapiens
  misc_feature 1..76: note = chr15:33603118-33603194
  misc_feature 1..76: note = hyper
  source 1..76: mol_type = genomic DNA
ggaggaggtggaggacgaggacgaaaaggaggaggagaaagagcgcagcagcagtcagcgcacgccgagcggctgc

SEQ ID NO: 22032 - DNA, 114 bp, Homo sapiens; identical to SEQ ID NO: 4206
  misc_feature 1..114: note = chr15:33603647-33603761
  misc_feature 1..114: note = hyper
  source 1..114: mol_type = genomic DNA

SEQ ID NO: 22033 - DNA, 594 bp, Homo sapiens
  misc_feature 1..594: note = chr15:34728884-34729478
  misc_feature 1..594: note = hyper
  source 1..594: mol_type = genomic DNA
gccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgct

SEQ ID NO: 22034 - DNA, 13 bp, Homo sapiens
  misc_feature 1..13: note = chr15:34729582-34729595
  misc_feature 1..13: note = hyper
  source 1..13: mol_type = genomic DNA
aggttccccagct

SEQ ID NO: 22035 - DNA, 31 bp, Homo sapiens
  misc_feature 1..31: note = chr15:34787304-34787335
  misc_feature 1..31: note = hyper
  source 1..31: mol_type = genomic DNA
cgttacctggcgccgtcggggcccagcggca

SEQ ID NO: 22036 - DNA, 34 bp, Homo sapiens; identical to SEQ ID NO: 12120
  misc_feature 1..34: note = chr15:34806507-34806541
  misc_feature 1..34: note = hyper
  source 1..34: mol_type = genomic DNA

SEQ ID NO: 22037 - DNA, 69 bp, Homo sapiens; identical to SEQ ID NO: 12121
  misc_feature 1..69: note = chr15:34806978-34807047
  misc_feature 1..69: note = hyper
  source 1..69: mol_type = genomic DNA

SEQ ID NO: 22038 - DNA, 16 bp, Homo sapiens
  misc_feature 1..16: note = chr15:35047133-35047149
  misc_feature 1..16: note = hyper
  source 1..16: mol_type = genomic DNA
ccggcgcggcagcctg

SEQ ID NO: 22039 - DNA, 13 bp, Homo sapiens
  misc_feature 1..13: note = chr15:35047293-35047306
  misc_feature 1..13: note = hyper
  source 1..13: mol_type = genomic DNA
cgtcggagcccga

SEQ ID NO: 22040 - DNA, 55 bp, Homo sapiens
  misc_feature 1..55: note = chr15:37180743-37180798
  misc_feature 1..55: note = hyper
  source 1..55: mol_type = genomic DNA
aggtgagggccagggtagccctctgcacgcccctctgccgcggcccaagcctctg

SEQ ID NO: 22041 - DNA, 29 bp, Homo sapiens
  misc_feature 1..29: note = chr15:40211790-40211819
  misc_feature 1..29: note = hyper
  source 1..29: mol_type = genomic DNA
gaggagggggactcccgcctggatcccgc

SEQ ID NO: 22042 - DNA, 54 bp, Homo sapiens
  misc_feature 1..54: note = chr15:40212190-40212244
  misc_feature 1..54: note = hyper
  source 1..54: mol_type = genomic DNA
tggcatttggagagatccagctcccgttatgtcccatggcgaggctgggactcc

SEQ ID NO: 22043 - DNA, 41 bp, Homo sapiens
  misc_feature 1..41: note = chr15:40575589-40575630
  misc_feature 1..41: note = hyper
  source 1..41: mol_type = genomic DNA
ccacatgcacccaaccgggccaatcccaaagtcgcagtctt

SEQ ID NO: 22044 - DNA, 137 bp, Homo sapiens; identical to SEQ ID NO: 12128
  misc_feature 1..137: note = chr15:41787125-41787262
  misc_feature 1..137: note = hyper
  source 1..137: mol_type = genomic DNA

SEQ ID NO: 22045 - DNA, 79 bp, Homo sapiens; identical to SEQ ID NO: 12129
  misc_feature 1..79: note = chr15:41804733-41804812
  misc_feature 1..79: note = hyper
  source 1..79: mol_type = genomic DNA

SEQ ID NO: 22046 - DNA, 35 bp, Homo sapiens; identical to SEQ ID NO: 12131
  misc_feature 1..35: note = chr15:41877632-41877667
  misc_feature 1..35: note = hyper
  source 1..35: mol_type = genomic DNA

SEQ ID NO: 22047 - DNA, 17 bp, Homo sapiens
  misc_feature 1..17: note = chr15:41913733-41913750
  misc_feature 1..17: note = hyper
  source 1..17: mol_type = genomic DNA
tccgggacccgcgagcg

SEQ ID NO: 22048 - DNA, 64 bp, Homo sapiens
  misc_feature 1..64: note = chr15:41913807-41913871
  misc_feature 1..64: note = hyper
  source 1..64: mol_type = genomic DNA
tgccacgcgctacgcccgtccccacgcgcctggtggcgtgttcttggcgcgaagtgttaagagt

SEQ ID NO: 22049 - DNA, 30 bp, Homo sapiens
  misc_feature 1..30: note = chr15:41952542-41952572
  misc_feature 1..30: note = hyper
  source 1..30: mol_type = genomic DNA
ccttttgcgcctgcgcggcgggctccgagc

SEQ ID NO: 22050 - DNA, 35 bp, Homo sapiens
  misc_feature 1..35: note = chr15:41952711-41952746
  misc_feature 1..35: note = hyper
  source 1..35: mol_type = genomic DNA
acgccccgcacggtaactctcgggcctgggtggag

SEQ ID NO: 22051 - DNA, 31 bp, Homo sapiens
  misc_feature 1..31: note = chr15:45403605-45403636
  misc_feature 1..31: note = hyper
  source 1..31: mol_type = genomic DNA
gcccggtggcggggtcgggcgccgcccacat

SEQ ID NO: 22052 - DNA, 42 bp, Homo sapiens
  misc_feature 1..42: note = chr15:45405117-45405159
  misc_feature 1..42: note = hyper
  source 1..42: mol_type = genomic DNA
cagggcctttcgcgccccggcccttcgcgagccacggcccca

SEQ ID NO: 22053 - DNA, 124 bp, Homo sapiens; identical to SEQ ID NO: 12137
  misc_feature 1..124: note = chr15:45406627-45406751
  misc_feature 1..124: note = hyper
  source 1..124: mol_type = genomic DNA

SEQ ID NO: 22054 - DNA, 192 bp, Homo sapiens; identical to SEQ ID NO: 12138
  misc_feature 1..192: note = chr15:45421473-45421665
  misc_feature 1..192: note = hyper
  source 1..192: mol_type = genomic DNA

SEQ ID NO: 22055 - DNA, 14 bp, Homo sapiens
  misc_feature 1..14: note = chr15:45479446-45479460
  misc_feature 1..14: note = hyper
  source 1..14: mol_type = genomic DNA
agagtttggggctt

SEQ ID NO: 22056 - skipped

SEQ ID NO: 22057 - DNA, 63 bp, Homo sapiens; identical to SEQ ID NO: 12142
  misc_feature 1..63: note = chr15:48009607-48009670
  misc_feature 1..63: note = hyper
  source 1..63: mol_type = genomic DNA

SEQ ID NO: 22058 - DNA, 449 bp, Homo sapiens; identical to SEQ ID NO: 12143
  misc_feature 1..449: note = chr15:48010067-48010516
  misc_feature 1..449: note = hyper
  source 1..449: mol_type = genomic DNA

SEQ ID NO: 22059 - DNA, 62 bp, Homo sapiens; identical to SEQ ID NO: 12144
  misc_feature 1..62: note = chr15:48010760-48010822
  misc_feature 1..62: note = hyper
  source 1..62: mol_type = genomic DNA

SEQ ID NO: 22060 - DNA, 63 bp, Homo sapiens; identical to SEQ ID NO: 12145
  misc_feature 1..63: note = chr15:48470388-48470451
  misc_feature 1..63: note = hyper
  source 1..63: mol_type = genomic DNA

SEQ ID NO: 22061 - DNA, 225 bp, Homo sapiens
  misc_feature 1..225: note = chr15:48937987-48938212
  misc_feature 1..225: note = hyper
  source 1..225: mol_type = genomic DNA
ttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgg

SEQ ID NO: 22062 - DNA, 49 bp, Homo sapiens
  misc_feature 1..49: note = chr15:51385864-51385913
  misc_feature 1..49: note = hyper
  source 1..49: mol_type = genomic DNA
cgggagctgtgggcacgtgaggagggcgagcgggtcctaggtgcgtaga

SEQ ID NO: 22063 - DNA, 25 bp, Homo sapiens
  misc_feature 1..25: note = chr15:51386181-51386206
  misc_feature 1..25: note = hyper
  source 1..25: mol_type = genomic DNA
ccttctccgccggctgcgcggcagc

SEQ ID NO: 22064 - DNA, 414 bp, Homo sapiens; identical to SEQ ID NO: 12151
  misc_feature 1..414: note = chr15:51559380-51559794
  misc_feature 1..414: note = hyper
  source 1..414: mol_type = genomic DNA

SEQ ID NO: 22065 - DNA, 165 bp, Homo sapiens
  misc_feature 1..165: note = chr15:53077361-53077526
  misc_feature 1..165: note = hyper
  source 1..165: mol_type = genomic DNA
ctcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatg

SEQ ID NO: 22066 - DNA, 24 bp, Homo sapiens
  misc_feature 1..24: note = chr15:53078040-53078064
  misc_feature 1..24: note = hyper
  source 1..24: mol_type = genomic DNA
ctgttatttcgtgaccggaaggcg

SEQ ID NO: 22067 - DNA, 70 bp, Homo sapiens; identical to SEQ ID NO: 12156
  misc_feature 1..70: note = chr15:53078922-53078992
  misc_feature 1..70: note = hyper
  source 1..70: mol_type = genomic DNA

SEQ ID NO: 22068 - DNA, 76 bp, Homo sapiens
  misc_feature 1..76: note = chr15:53079264-53079340
  misc_feature 1..76: note = hyper
  source 1..76: mol_type = genomic DNA
ggaacctcagttgctcgcgggcagcccacgggtggagatatggtgccggtagcacaagagctagagagtggaaaac

SEQ ID NO: 22069 - DNA, 243 bp, Homo sapiens; identical to SEQ ID NO: 4229
  misc_feature 1..243: note = chr15:53081054-53081297
  misc_feature 1..243: note = hyper
  source 1..243: mol_type = genomic DNA

SEQ ID NO: 22070 - DNA, 14 bp, Homo sapiens
  misc_feature 1..14: note = chr15:53081677-53081691
  misc_feature 1..14: note = hyper
  source 1..14: mol_type = genomic DNA
gggtggtggtggtg

SEQ ID NO: 22071 - DNA, 56 bp, Homo sapiens; identical to SEQ ID NO: 12164
  misc_feature 1..56: note = chr15:53082987-53083043
  misc_feature 1..56: note = hyper
  source 1..56: mol_type = genomic DNA

SEQ ID NO: 22072 - DNA, 19 bp, Homo sapiens
  misc_feature 1..19: note = chr15:53083116-53083135
  misc_feature 1..19: note = hyper
  source 1..19: mol_type = genomic DNA
cgttgacccggcacccttc

SEQ ID NO: 22073 - skipped

SEQ ID NO: 22074 - DNA, 401 bp, Homo sapiens; identical to SEQ ID NO: 12167
  misc_feature 1..401: note = chr15:53095746-53096147
  misc_feature 1..401: note = hyper
  source 1..401: mol_type = genomic DNA

SEQ ID NO: 22075 - DNA, 36 bp, Homo sapiens; identical to SEQ ID NO: 12168
  misc_feature 1..36: note = chr15:53096459-53096495
  misc_feature 1..36: note = hyper
  source 1..36: mol_type = genomic DNA

SEQ ID NO: 22076 - DNA, 133 bp, Homo sapiens
  misc_feature 1..133: note = chr15:53097098-53097231
  misc_feature 1..133: note = hyper
  source 1..133: mol_type = genomic DNA
tggtcaggccagcctcgcatttggggatgcaacttgcatttgaatagctgcctgggcttgttatggacccgggaaagctctgaaagggaatcactatgcaaattgtcccagttacaatcgaaaggttcgatct

SEQ ID NO: 22077 - DNA, 75 bp, Homo sapiens
  misc_feature 1..75: note = chr15:53097261-53097336
  misc_feature 1..75: note = hyper
  source 1..75: mol_type = genomic DNA
gctatctatgcattagggttgcattaccgccttcgtcggcctcctcgccacccccgctcgcgcctgcaggggagg

SEQ ID NO: 22078 - DNA, 15 bp, Homo sapiens
  misc_feature 1..15: note = chr15:53097554-53097569
  misc_feature 1..15: note = hyper
  source 1..15: mol_type = genomic DNA
tttttttcgctttgc

SEQ ID NO: 22079 - DNA, 32 bp, Homo sapiens
  misc_feature 1..32: note = chr15:53098658-53098690
  misc_feature 1..32: note = hyper
  source 1..32: mol_type = genomic DNA
agtagggtgaagggcaacggtcattagcactt

SEQ ID NO: 22080 - DNA, 45 bp, Homo sapiens; identical to SEQ ID NO: 12173
  misc_feature 1..45: note = chr15:54051776-54051821
  misc_feature 1..45: note = hyper
  source 1..45: mol_type = genomic DNA

SEQ ID NO: 22081 - DNA, 190 bp, Homo sapiens
  misc_feature 1..190: note = chr15:54270707-54270897
  misc_feature 1..190: note = hyper
  source 1..190: mol_type = genomic DNA
ctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaa

SEQ ID NO: 22082 - DNA, 45 bp, Homo sapiens; identical to SEQ ID NO: 12175
  misc_feature 1..45: note = chr15:56034885-56034930
  misc_feature 1..45: note = hyper
  source 1..45: mol_type = genomic DNA

SEQ ID NO: 22083 - DNA, 155 bp, Homo sapiens; identical to SEQ ID NO: 12177
  misc_feature 1..155: note = chr15:58358573-58358728
  misc_feature 1..155: note = hyper
  source 1..155: mol_type = genomic DNA

SEQ ID NO: 22084 - DNA, 205 bp, Homo sapiens
  misc_feature 1..205: note = chr15:60295917-60296122
  misc_feature 1..205: note = hyper
  source 1..205: mol_type = genomic DNA
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccat

SEQ ID NO: 22085 - DNA, 61 bp, Homo sapiens
  misc_feature 1..61: note = chr15:60298108-60298169
  misc_feature 1..61: note = hyper
  source 1..61: mol_type = genomic DNA
cctccgccttgcactcggtggcggtgcactgacccgcaggagcccacgccccctctcgttc

SEQ ID NO: 22086 - DNA, 82 bp, Homo sapiens; identical to SEQ ID NO: 12187
  misc_feature 1..82: note = chr15:61519939-61520021
  misc_feature 1..82: note = hyper
  source 1..82: mol_type = genomic DNA

SEQ ID NO: 22087 - DNA, 30 bp, Homo sapiens; identical to SEQ ID NO: 12188
  misc_feature 1..30: note = chr15:61520432-61520462
  misc_feature 1..30: note = hyper
  source 1..30: mol_type = genomic DNA

SEQ ID NO: 22088 - DNA, 30 bp, Homo sapiens; identical to SEQ ID NO: 12190
  misc_feature 1..30: note = chr15:61521442-61521472
  misc_feature 1..30: note = hyper
  source 1..30: mol_type = genomic DNA

SEQ ID NO: 22089 - DNA, 75 bp, Homo sapiens; identical to SEQ ID NO: 12192
  misc_feature 1..75: note = chr15:62457193-62457268
  misc_feature 1..75: note = hyper
  source 1..75: mol_type = genomic DNA

SEQ ID NO: 22090 - DNA, 91 bp, Homo sapiens; identical to SEQ ID NO: 12193
  misc_feature 1..91: note = chr15:65669680-65669771
  misc_feature 1..91: note = hyper
  source 1..91: mol_type = genomic DNA

SEQ ID NO: 22091 - DNA, 35 bp, Homo sapiens; identical to SEQ ID NO: 12194
  misc_feature 1..35: note = chr15:65715528-65715563
  misc_feature 1..35: note = hyper
  source 1..35: mol_type = genomic DNA

SEQ ID NO: 22092 - DNA, 126 bp, Homo sapiens; identical to SEQ ID NO: 12195
  misc_feature 1..126: note = chr15:68113248-68113374
  misc_feature 1..126: note = hyper
  source 1..126: mol_type = genomic DNA

SEQ ID NO: 22093 - DNA, 204 bp, Homo sapiens
  misc_feature 1..204: note = chr15:68114195-68114399
  misc_feature 1..204: note = hyper
  source 1..204: mol_type = genomic DNA
ggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgaggga

SEQ ID NO: 22094 - DNA, 775 bp, Homo sapiens
  misc_feature 1..775: note = chr15:68115594-68116369
  misc_feature 1..775: note = hyper
  source 1..775: mol_type = genomic DNA
cggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccagga

SEQ ID NO: 22095 - DNA, 165 bp, Homo sapiens
  misc_feature 1..165: note = chr15:68117665-68117830
  misc_feature 1..165: note = hyper
  source 1..165: mol_type = genomic DNA
cttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcaga

SEQ ID NO: 22096 - DNA, 24 bp, Homo sapiens
  misc_feature 1..24: note = chr15:68118633-68118657
  misc_feature 1..24: note = hyper
  source 1..24: mol_type = genomic DNA
gcgagaggccgaacgcctgtgcaa

SEQ ID NO: 22097 - DNA, 10 bp, Homo sapiens
  misc_feature 1..10: note = chr15:68122673-68122683
  misc_feature 1..10: note = hyper
  source 1..10: mol_type = genomic DNA
ccaggagctg

SEQ ID NO: 22098 - DNA, 38 bp, Homo sapiens
  misc_feature 1..38: note = chr15:68125223-68125261
  misc_feature 1..38: note = hyper
  source 1..38: mol_type = genomic DNA
gattgaacttcttatcgcggcaatttccatggtttcta

SEQ ID NO: 22099 - DNA, 47 bp, Homo sapiens
  misc_feature 1..47: note = chr15:68125664-68125711
  misc_feature 1..47: note = hyper
  source 1..47: mol_type = genomic DNA
atagtgggactagtgaggaaggccacgatccacgtggatcaggatct

SEQ ID NO: 22100 - DNA, 33 bp, Homo sapiens; identical to SEQ ID NO: 12203
  misc_feature 1..33: note = chr15:68126071-68126104
  misc_feature 1..33: note = hyper
  source 1..33: mol_type = genomic DNA

SEQ ID NO: 22101 - DNA, 35 bp, Homo sapiens
  misc_feature 1..35: note = chr15:68127766-68127801
  misc_feature 1..35: note = hyper
  source 1..35: mol_type = genomic DNA
ggctagtgggggtcccgggttgagcccttctttta

SEQ ID NO: 22102 - DNA, 63 bp, Homo sapiens
  misc_feature 1..63: note = chr15:68128350-68128413
  misc_feature 1..63: note = hyper
  source 1..63: mol_type = genomic DNA
gggcgggacagcgcgggtgtgggagtttgccggcccctttccccaccgcggattgcacctttg

SEQ ID NO: 22103 - DNA, 44 bp, Homo sapiens; identical to SEQ ID NO: 12205
  misc_feature 1..44: note = chr15:68723523-68723567
  misc_feature 1..44: note = hyper
  source 1..44: mol_type = genomic DNA

SEQ ID NO: 22104 - DNA, 124 bp, Homo sapiens; identical to SEQ ID NO: 12206
  misc_feature 1..124: note = chr15:68723898-68724022
  misc_feature 1..124: note = hyper
  source 1..124: mol_type = genomic DNA

SEQ ID NO: 22105 - DNA, 121 bp, Homo sapiens; identical to SEQ ID NO: 12207
  misc_feature 1..121: note = chr15:69136224-69136345
  misc_feature 1..121: note = hyper
  source 1..121: mol_type = genomic DNA

SEQ ID NO: 22106 - DNA, 34 bp, Homo sapiens; identical to SEQ ID NO: 12208
  misc_feature 1..34: note = chr15:71408553-71408587
  misc_feature 1..34: note = hyper
  source 1..34: mol_type = genomic DNA

SEQ ID NO: 22107 - DNA, 132 bp, Homo sapiens; identical to SEQ ID NO: 12209
  misc_feature 1..132: note = chr15:72476743-72476875
  misc_feature 1..132: note = hyper
  source 1..132: mol_type = genomic DNA

SEQ ID NO: 22108 - DNA, 404 bp, Homo sapiens
  misc_feature 1..404: note = chr15:73659600-73660004
  misc_feature 1..404: note = hyper
  source 1..404: mol_type = genomic DNA
aatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcct

SEQ ID NO: 22109 - DNA, 260 bp, Homo sapiens
  misc_feature 1..260: note = chr15:73660067-73660327
  misc_feature 1..260: note = hyper
  source 1..260: mol_type = genomic DNA
gctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaag

SEQ ID NO: 22110 - DNA, 267 bp, Homo sapiens; identical to SEQ ID NO: 12211
  misc_feature 1..267: note = chr15:73660446-73660713
  misc_feature 1..267: note = hyper
  source 1..267: mol_type = genomic DNA

SEQ ID NO: 22111 - DNA, 69 bp, Homo sapiens
  misc_feature 1..69: note = chr15:73661666-73661735
  misc_feature 1..69: note = hyper
  source 1..69: mol_type = genomic DNA
tcccggccttcccgcaaccctcctggagagggggcttccggaaatgcgccgcgtcggggaggctcccac

SEQ ID NO: 22112 - DNA, 30 bp, Homo sapiens; identical to SEQ ID NO: 12214
  misc_feature 1..30: note = chr15:74428205-74428235
  misc_feature 1..30: note = hyper
  source 1..30: mol_type = genomic DNA

SEQ ID NO: 22113 - DNA, 59 bp, Homo sapiens; identical to SEQ ID NO: 12215
  misc_feature 1..59: note = chr15:74429026-74429085
  misc_feature 1..59: note = hyper
  source 1..59: mol_type = genomic DNA

SEQ ID NO: 22114 - skipped

SEQ ID NO: 22115 - DNA, 58 bp, Homo sapiens
  misc_feature 1..58: note = chr15:74658587-74658645
  misc_feature 1..58: note = hyper
  source 1..58: mol_type = genomic DNA
gtgctctgaccttcaaatctccctcccccgattttttttttttttttttttttgagac

SEQ ID NO: 22116 - DNA, 10 bp, Homo sapiens
  misc_feature 1..10: note = chr15:75471217-75471227
  misc_feature 1..10: note = hyper
  source 1..10: mol_type = genomic DNA
cggtttcccc

SEQ ID NO: 22117 - DNA, 462 bp, Homo sapiens; identical to SEQ ID NO: 4252
  misc_feature 1..462: note = chr15:76628564-76629026
  misc_feature 1..462: note = hyper
  source 1..462: mol_type = genomic DNA

SEQ ID NO: 22118 - DNA, 38 bp, Homo sapiens; identical to SEQ ID NO: 12228
  misc_feature 1..38: note = chr15:76638937-76638975
  misc_feature 1..38: note = hyper
  source 1..38: mol_type = genomic DNA

SEQ ID NO: 22119 - DNA, 83 bp, Homo sapiens; identical to SEQ ID NO: 12229
  misc_feature 1..83: note = chr15:77924565-77924648
  misc_feature 1..83: note = hyper
  source 1..83: mol_type = genomic DNA

SEQ ID NO: 22120 - DNA, 148 bp, Homo sapiens; identical to SEQ ID NO: 12230
  misc_feature 1..148: note = chr15:78111627-78111775
  misc_feature 1..148: note = hyper
  source 1..148: mol_type = genomic DNA

SEQ ID NO: 22121 - DNA, 111 bp, Homo sapiens; identical to SEQ ID NO: 12231
  misc_feature 1..111: note = chr15:78236783-78236894
  misc_feature 1..111: note = hyper
  source 1..111: mol_type = genomic DNA

SEQ ID NO: 22122 - DNA, 59 bp, Homo sapiens; identical to SEQ ID NO: 12232
  misc_feature 1..59: note = chr15:78633047-78633106
  misc_feature 1..59: note = hyper
  source 1..59: mol_type = genomic DNA

SEQ ID NO: 22123 - DNA, 182 bp, Homo sapiens
  misc_feature 1..182: note = chr15:78912441-78912623
  misc_feature 1..182: note = hyper
  source 1..182: mol_type = genomic DNA
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaa

SEQ ID NO: 22124 - DNA, 174 bp, Homo sapiens; identical to SEQ ID NO: 12236
  misc_feature 1..174: note = chr15:78913296-78913470
  misc_feature 1..174: note = hyper
  source 1..174: mol_type = genomic DNA

SEQ ID NO: 22125 - DNA, 55 bp, Homo sapiens
  misc_feature 1..55: note = chr15:78913480-78913535
  misc_feature 1..55: note = hyper
  source 1..55: mol_type = genomic DNA
cgaccagatctgagcaggtgctgtcaccaccaccaggaaggagagggactcagtt

SEQ ID NO: 22126 - DNA, 26 bp, Homo sapiens
  misc_feature 1..26: note = chr15:78913651-78913677
  misc_feature 1..26: note = hyper
  source 1..26: mol_type = genomic DNA
atgctattaaataattgttaaatatt

SEQ ID NO: 22127 - DNA, 230 bp, Homo sapiens; identical to SEQ ID NO: 12238
  misc_feature 1..230: note = chr15:78933407-78933637
  misc_feature 1..230: note = hyper
  source 1..230: mol_type = genomic DNA

SEQ ID NO: 22128 - DNA, 215 bp, Homo sapiens
  misc_feature 1..215: note = chr15:79382571-79382786
  misc_feature 1..215: note = hyper
  source 1..215: mol_type = genomic DNA
tccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgc

SEQ ID NO: 22129 - DNA, 67 bp, Homo sapiens; identical to SEQ ID NO: 1226
  misc_feature 1..67: note = chr15:79383317-79383384
  misc_feature 1..67: note = hyper
  source 1..67: mol_type = genomic DNA

SEQ ID NO: 22130 - DNA, 81 bp, Homo sapiens; identical to SEQ ID NO: 1227
  misc_feature 1..81: note = chr15:79383438-79383519
  misc_feature 1..81: note = hyper
  source 1..81: mol_type = genomic DNA

SEQ ID NO: 22131 - DNA, 169 bp, Homo sapiens
  misc_feature 1..169: note = chr15:79383977-79384146
  misc_feature 1..169: note = hyper
  source 1..169: mol_type = genomic DNA
aacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 22132 - DNA, 41 bp, Homo sapiens
  misc_feature 1..41: note = chr15:79502170-79502211
  misc_feature 1..41: note = hyper
  source 1..41: mol_type = genomic DNA
actgtaagtgttggacggagaactgataagggtaggtgatt

SEQ ID NO: 22133 - DNA, 94 bp, Homo sapiens; identical to SEQ ID NO: 12245
  misc_feature 1..94: note = chr15:79574968-79575062
  misc_feature 1..94: note = hyper
  source 1..94: mol_type = genomic DNA

SEQ ID NO: 22134 - DNA, 25 bp, Homo sapiens
  misc_feature 1..25: note = chr15:79575474-79575499
  misc_feature 1..25: note = hyper
  source 1..25: mol_type = genomic DNA
gggtgctggacgccccctgattttg

SEQ ID NO: 22135 - DNA, 85 bp, Homo sapiens
  misc_feature 1..85: note = chr15:79576060-79576145
  misc_feature 1..85: note = hyper
  source 1..85: mol_type = genomic DNA
gctggcacactctgccggcgcggccggagccccggagttcagcacctcggacagagcccgagccccgccgcccgaggcgcacagt

SEQ ID NO: 22136 - skipped

SEQ ID NO: 22137 - DNA, 151 bp, Homo sapiens
  misc_feature 1..151: note = chr15:79724351-79724502
  misc_feature 1..151: note = hyper
  source 1..151: mol_type = genomic DNA
cgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggg

SEQ ID NO: 22138 - DNA, 162 bp, Homo sapiens; identical to SEQ ID NO: 12252
  misc_feature 1..162: note = chr15:80544504-80544666
  misc_feature 1..162: note = hyper
  source 1..162: mol_type = genomic DNA

SEQ ID NO: 22139 - DNA, 197 bp, Homo sapiens
  misc_feature 1..197: note = chr15:82336972-82337169
  misc_feature 1..197: note = hyper
  source 1..197: mol_type = genomic DNA
aggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccat

SEQ ID NO: 22140 - DNA, 63 bp, Homo sapiens
  misc_feature 1..63: note = chr15:82340007-82340070
  misc_feature 1..63: note = hyper
  source 1..63: mol_type = genomic DNA
tgccctgcctgaccccggctacaggaacgagcgctgtgggcctcggtttctcacccgtaaaat

SEQ ID NO: 22141 - DNA, 30 bp, Homo sapiens
  misc_feature 1..30: note = chr15:82340157-82340187
  misc_feature 1..30: note = hyper
  source 1..30: mol_type = genomic DNA
agacagttccgcaagcgcctttacttttga

SEQ ID NO: 22142 - DNA, 35 bp, Homo sapiens; identical to SEQ ID NO: 12255
  misc_feature 1..35: note = chr15:83314969-83315004
  misc_feature 1..35: note = hyper
  source 1..35: mol_type = genomic DNA

SEQ ID NO: 22143 - DNA, 39 bp, Homo sapiens
  misc_feature 1..39: note = chr15:83315297-83315336
  misc_feature 1..39: note = hyper
  source 1..39: mol_type = genomic DNA
ccccagctgagagcacggtgcaaggggccagggctgcag

SEQ ID NO: 22144 - DNA, 20 bp, Homo sapiens
  misc_feature 1..20: note = chr15:83316231-83316251
  misc_feature 1..20: note = hyper
  source 1..20: mol_type = genomic DNA
cgtgcgacggcagtgtgaga

SEQ ID NO: 22145 - DNA, 164 bp, Homo sapiens
  misc_feature 1..164: note = chr15:83349070-83349234
  misc_feature 1..164: note = hyper
  source 1..164: mol_type = genomic DNA
gggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcg

SEQ ID NO: 22146 - DNA, 23 bp, Homo sapiens
  misc_feature 1..23: note = chr15:83349686-83349709
  misc_feature 1..23: note = hyper
  source 1..23: mol_type = genomic DNA
agagtttccggtagtttttgtga

SEQ ID NO: 22147 - DNA, 165 bp, Homo sapiens; identical to SEQ ID NO: 12261
  misc_feature 1..165: note = chr15:83378857-83379022
  misc_feature 1..165: note = hyper
  source 1..165: mol_type = genomic DNA

SEQ ID NO: 22148 - DNA, 69 bp, Homo sapiens; identical to SEQ ID NO: 4272
  misc_feature 1..69: note = chr15:83775933-83776002
  misc_feature 1..69: note = hyper
  source 1..69: mol_type = genomic DNA

SEQ ID NO: 22149 - DNA, 116 bp, Homo sapiens; identical to SEQ ID NO: 4273
  misc_feature 1..116: note = chr15:83776022-83776138
  misc_feature 1..116: note = hyper
  source 1..116: mol_type = genomic DNA

SEQ ID NO: 22150 - DNA, 98 bp, Homo sapiens
  misc_feature 1..98: note = chr15:83776157-83776255
  misc_feature 1..98: note = hyper
  source 1..98: mol_type = genomic DNA
cgtggcgcccctggcaggagcactgcaaggacgcctcccgggactgcaccgcggccctgcgcacttggggcgacggggccaggcgcgggggacggctg

SEQ ID NO: 22151 - DNA, 260 bp, Homo sapiens; identical to SEQ ID NO: 12268
  misc_feature 1..260: note = chr15:83876223-83876483
  misc_feature 1..260: note = hyper
  source 1..260: mol_type = genomic DNA

SEQ ID NO: 22152 - DNA, 34 bp, Homo sapiens; identical to SEQ ID NO: 12269
  misc_feature 1..34: note = chr15:83876788-83876822
  misc_feature 1..34: note = hyper
  source 1..34: mol_type = genomic DNA

SEQ ID NO: 22153 - DNA, 19 bp, Homo sapiens
  misc_feature 1..19: note = chr15:83877036-83877055
  misc_feature 1..19: note = hyper
  source 1..19: mol_type = genomic DNA
agtgggggacaaaggcgct

SEQ ID NO: 22154 - DNA, 159 bp, Homo sapiens
  misc_feature 1..159: note = chr15:84115966-84116125
  misc_feature 1..159: note = hyper
  source 1..159: mol_type = genomic DNA
gccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcga

SEQ ID NO: 22155 - DNA, 41 bp, Homo sapiens; identical to SEQ ID NO: 12274
  misc_feature 1..41: note = chr15:84116828-84116869
  misc_feature 1..41: note = hyper
  source 1..41: mol_type = genomic DNA

SEQ ID NO: 22156 - DNA, 33 bp, Homo sapiens; identical to SEQ ID NO: 12275
  misc_feature 1..33: note = chr15:84322478-84322511
  misc_feature 1..33: note = hyper
  source 1..33: mol_type = genomic DNA

SEQ ID NO: 22157 - DNA, 109 bp, Homo sapiens
  misc_feature 1..109: note = chr15:84749260-84749369
  misc_feature 1..109: note = hyper
  source 1..109: mol_type = genomic DNA
gggatcctcaaatagaacgaatccgggaccctgcagaaatgaagggcatgtagtgtagaggtttttcctttttatttagaaaggaatgaaagaccgacagtgcacctgc

SEQ ID NO: 22158 - DNA, 41 bp, Homo sapiens; identical to SEQ ID NO: 12279
  misc_feature 1..41: note = chr15:88799221-88799262
  misc_feature 1..41: note = hyper
  source 1..41: mol_type = genomic DNA

SEQ ID NO: 22159 - DNA, 30 bp, Homo sapiens
  misc_feature 1..30: note = chr15:88799507-88799537
  misc_feature 1..30: note = hyper
  source 1..30: mol_type = genomic DNA
cctctgcctttgaaacgccgagcgatcaga

SEQ ID NO: 22160 - DNA, 129 bp, Homo sapiens
  misc_feature 1..129: note = chr15:88800412-88800541
  misc_feature 1..129: note = hyper
  source 1..129: mol_type = genomic DNA
cgcgctacccggttttgctgcaatccggaccgcggtaggaagtgaaatgaacgtggcggaggtgattggggagtgctcccaagccttgggtggggggcgctcccaagcctgggtgggtggggggcgcag

SEQ ID NO: 22161 - DNA, 30 bp, Homo sapiens; identical to SEQ ID NO: 12283
  misc_feature 1..30: note = chr15:88801202-88801232
  misc_feature 1..30: note = hyper
  source 1..30: mol_type = genomic DNA

SEQ ID NO: 22162 - DNA, 30 bp, Homo sapiens; identical to SEQ ID NO: 12284
  misc_feature 1..30: note = chr15:89147617-89147647
  misc_feature 1..30: note = hyper
  source 1..30: mol_type = genomic DNA

SEQ ID NO: 22163 - DNA, 35 bp, Homo sapiens; identical to SEQ ID NO: 12285
  misc_feature 1..35: note = chr15:89148146-89148181
  misc_feature 1..35: note = hyper
  source 1..35: mol_type = genomic DNA

SEQ ID NO: 22164 - DNA, 231 bp, Homo sapiens; identical to SEQ ID NO: 12286
  misc_feature 1..231: note = chr15:89148437-89148668
  misc_feature 1..231: note = hyper
  source 1..231: mol_type = genomic DNA

SEQ ID NO: 22165 - DNA, 40 bp, Homo sapiens; identical to SEQ ID NO: 12287
  misc_feature 1..40: note = chr15:89148879-89148919
  misc_feature 1..40: note = hyper
  source 1..40: mol_type = genomic DNA

SEQ ID NO: 22166 - DNA, 30 bp, Homo sapiens
  misc_feature 1..30: note = chr15:89149139-89149169
  misc_feature 1..30: note = hyper
  source 1..30: mol_type = genomic DNA
gcccctcagaccccacgcggaggaggtcag

SEQ ID NO: 22167 - DNA, 53 bp, Homo sapiens; identical to SEQ ID NO: 12289
  misc_feature 1..53: note = chr15:89248428-89248481
  misc_feature 1..53: note = hyper
  source 1..53: mol_type = genomic DNA

SEQ ID NO: 22168 - DNA, 58 bp, Homo sapiens
  misc_feature 1..58: note = chr15:89248695-89248753
  misc_feature 1..58: note = hyper
  source 1..58: mol_type = genomic DNA
ggggagggactggatcgggcgccaatcccgcccgccgcgcgccgcccgggctccctcg

SEQ ID NO: 22169 - DNA, 12 bp, Homo sapiens
  misc_feature 1..12: note = chr15:89346038-89346050
  misc_feature 1..12: note = hyper
  source 1..12: mol_type = genomic DNA
agactcgcagct

SEQ ID NO: 22170 - DNA, 68 bp, Homo sapiens
  misc_feature 1..68: note = chr15:89346393-89346461
  misc_feature 1..68: note = hyper
  source 1..68: mol_type = genomic DNA
ccgccagccccggagctgccgggtccgcgccgccccggggagcgctcctctcccgccctgagcgcagg

SEQ ID NO: 22171 - DNA, 273 bp, Homo sapiens
  misc_feature 1..273: note = chr15:89346943-89347216
  misc_feature 1..273: note = hyper
  source 1..273: mol_type = genomic DNA
gcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagca

SEQ ID NO: 22172 - DNA, 53 bp, Homo sapiens
  misc_feature 1..53: note = chr15:89903431-89903484
  misc_feature 1..53: note = hyper
  source 1..53: mol_type = genomic DNA
cccacaagaatcatccgaggctgcaccgtgaccagcccctcaagacagagcga

SEQ ID NO: 22173 - DNA, 86 bp, Homo sapiens; identical to SEQ ID NO: 12295
  misc_feature 1..86: note = chr15:89906156-89906242
  misc_feature 1..86: note = hyper
  source 1..86: mol_type = genomic DNA

SEQ ID NO: 22174 - DNA, 30 bp, Homo sapiens; identical to SEQ ID NO: 12296
  misc_feature 1..30: note = chr15:89909322-89909352
  misc_feature 1..30: note = hyper
  source 1..30: mol_type = genomic DNA

SEQ ID NO: 22175 - DNA, 290 bp, Homo sapiens
  misc_feature 1..290: note = chr15:89910748-89911038
  misc_feature 1..290: note = hyper
  source 1..290: mol_type = genomic DNA
ggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcag

SEQ ID NO: 22176 - DNA, 486 bp, Homo sapiens; identical to SEQ ID NO: 12298
  misc_feature 1..486: note = chr15:89911610-89912096
  misc_feature 1..486: note = hyper
  source 1..486: mol_type = genomic DNA

SEQ ID NO: 22177 - DNA, 95 bp, Homo sapiens; identical to SEQ ID NO: 12299
  misc_feature 1..95: note = chr15:89913460-89913555
  misc_feature 1..95: note = hyper
  source 1..95: mol_type = genomic DNA

SEQ ID NO: 22178 - DNA, 345 bp, Homo sapiens
  misc_feature 1..345: note = chr15:89914895-89915240
  misc_feature 1..345: note = hyper
  source 1..345: mol_type = genomic DNA
ccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccct

SEQ ID NO: 22179 - DNA, 201 bp, Homo sapiens
  misc_feature 1..201: note = chr15:89922546-89922747
  misc_feature 1..201: note = hyper
  source 1..201: mol_type = genomic DNA
acggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggcca

SEQ ID NO: 22180 - DNA, 90 bp, Homo sapiens
  misc_feature 1..90: note = chr15:89942665-89942755
  misc_feature 1..90: note = hyper
  source 1..90: mol_type = genomic DNA
ggcagaaccactgaccggcaggcggcgctccccggggctcccggctcgagccccagggcaccgggaggagtaaggaccccgagcgggagg

SEQ ID NO: 22181 - DNA, 310 bp, Homo sapiens
  misc_feature 1..310: note = chr15:89942945-89943255
  misc_feature 1..310: note = hyper
  source 1..310: mol_type = genomic DNA
agcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaa

SEQ ID NO: 22182 - DNA, 176 bp, Homo sapiens
  misc_feature 1..176: note = chr15:89951113-89951289
  misc_feature 1..176: note = hyper
  source 1..176: mol_type = genomic DNA
ggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacaca

SEQ ID NO: 22183 - DNA, 28 bp, Homo sapiens
  misc_feature 1..28: note = chr15:89951349-89951377
  misc_feature 1..28: note = hyper
  source 1..28: mol_type = genomic DNA
gataaactcgcttttcttccggtaagtg

SEQ ID NO: 22184 - skipped

SEQ ID NO: 22185 - DNA, 19 bp, Homo sapiens
  misc_feature 1..19: note = chr15:89953055-89953074
  misc_feature 1..19: note = hyper
  source 1..19: mol_type = genomic DNA
agggcggggagtagggatt

SEQ ID NO: 22186 - DNA, 19 bp, Homo sapiens
  misc_feature 1..19: note = chr15:89954335-89954354
  misc_feature 1..19: note = hyper
  source 1..19: mol_type = genomic DNA
ctggcgctgccttccagga

SEQ ID NO: 22187 - DNA, 42 bp, Homo sapiens; identical to SEQ ID NO: 12313
  misc_feature 1..42: note = chr15:89954800-89954842
  misc_feature 1..42: note = hyper
  source 1..42: mol_type = genomic DNA

SEQ ID NO: 22188 - DNA, 28 bp, Homo sapiens
  misc_feature 1..28: note = chr15:89955001-89955029
  misc_feature 1..28: note = hyper
  source 1..28: mol_type = genomic DNA
gggatagtcgcaccgacaaaaatcacag

SEQ ID NO: 22189 - DNA, 15 bp, Homo sapiens
  misc_feature 1..15: note = chr15:89956339-89956354
  misc_feature 1..15: note = hyper
  source 1..15: mol_type = genomic DNA
tatattttaagcccc

SEQ ID NO: 22190 - DNA, 30 bp, Homo sapiens; identical to SEQ ID NO: 12316
  misc_feature 1..30: note = chr15:89962817-89962847
  misc_feature 1..30: note = hyper
  source 1..30: mol_type = genomic DNA

SEQ ID NO: 22191 - DNA, 97 bp, Homo sapiens
  misc_feature 1..97: note = chr15:90039711-90039808
  misc_feature 1..97: note = hyper
  source 1..97: mol_type = genomic DNA
taatcacctgcaggagcaggcaggtgagcggcagccgccagcggaggttggtgttccaggccatgctgcaggggtgcctggccgggctggcagcggg

SEQ ID NO: 22192 - DNA, 177 bp, Homo sapiens; identical to SEQ ID NO: 12318
  misc_feature 1..177: note = chr15:90357883-90358060
  misc_feature 1..177: note = hyper
  source 1..177: mol_type = genomic DNA

SEQ ID NO: 22193 - DNA, 248 bp, Homo sapiens; identical to SEQ ID NO: 12319
  misc_feature 1..248: note = chr15:90358102-90358350
  misc_feature 1..248: note = hyper
  source 1..248: mol_type = genomic DNA

SEQ ID NO: 22194 - DNA, 120 bp, Homo sapiens; identical to SEQ ID NO: 12320
  misc_feature 1..120: note = chr15:91427788-91427908
  misc_feature 1..120: note = hyper
  source 1..120: mol_type = genomic DNA

SEQ ID NO: 22195 - DNA, 42 bp, Homo sapiens; identical to SEQ ID NO: 12321
  misc_feature 1..42: note = chr15:92936971-92937013
  misc_feature 1..42: note = hyper
  source 1..42: mol_type = genomic DNA

SEQ ID NO: 22196 - DNA, 35 bp, Homo sapiens; identical to SEQ ID NO: 4298
  misc_feature 1..35: note = chr15:92937700-92937735
  misc_feature 1..35: note = hyper
  source 1..35: mol_type = genomic DNA

SEQ ID NO: 22197 - DNA, 191 bp, Homo sapiens
  misc_feature 1..191: note = chr15:92937736-92937927
  misc_feature 1..191: note = hyper
  source 1..191: mol_type = genomic DNA
ggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagaca

SEQ ID NO: 22198 - DNA, 84 bp, Homo sapiens; identical to SEQ ID NO: 12325
  misc_feature 1..84: note = chr15:93198720-93198804
  misc_feature 1..84: note = hyper
  source 1..84: mol_type = genomic DNA

SEQ ID NO: 22199 - DNA, 95 bp, Homo sapiens; identical to SEQ ID NO: 12326
  misc_feature 1..95: note = chr15:93616156-93616251
  misc_feature 1..95: note = hyper
  source 1..95: mol_type = genomic DNA

SEQ ID NO: 22200 - DNA, 108 bp, Homo sapiens; identical to SEQ ID NO: 12327
  misc_feature 1..108: note = chr15:93616545-93616653
  misc_feature 1..108: note = hyper
  source 1..108: mol_type = genomic DNA

SEQ ID NO: 22201 - DNA, 107 bp, Homo sapiens
  misc_feature 1..107: note = chr15:93631632-93631739
  misc_feature 1..107: note = hyper
  source 1..107: mol_type = genomic DNA
cgtacgccggcgcgccgaggcaaagggccgccgggacgcgagcccacgcggtgcactgcgccgacatccccgagggcaggagatggccaggcagctccgcagccggg

SEQ ID NO: 22202 - DNA, 369 bp, Homo sapiens
  misc_feature 1..369: note = chr15:93632291-93632660
  misc_feature 1..369: note = hyper
  source 1..369: mol_type = genomic DNA
ggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagca

SEQ ID NO: 22203 - DNA, 33 bp, Homo sapiens
  misc_feature 1..33: note = chr15:93633233-93633266
  misc_feature 1..33: note = hyper
  source 1..33: mol_type = genomic DNA
gcttgaacacggccacgtcgggagcagtaaatc

SEQ ID NO: 22204 - DNA, 14 bp, Homo sapiens
  misc_feature 1..14: note = chr15:95388665-95388679
  misc_feature 1..14: note = hyper
  source 1..14: mol_type = genomic DNA
ggagaagaatatct

SEQ ID NO: 22205 - DNA, 30 bp, Homo sapiens; identical to SEQ ID NO: 12333
  misc_feature 1..30: note = chr15:96865078-96865108
  misc_feature 1..30: note = hyper
  source 1..30: mol_type = genomic DNA

SEQ ID NO: 22206 - DNA, 57 bp, Homo sapiens
  misc_feature 1..57: note = chr15:96897877-96897934
  misc_feature 1..57: note = hyper
  source 1..57: mol_type = genomic DNA
gttccgccacgggtccgacggggcaccctgggtccccgcagcccgtcacaggcgttt

SEQ ID NO: 22207 - DNA, 117 bp, Homo sapiens
  misc_feature 1..117: note = chr15:96911442-96911559
  misc_feature 1..117: note = hyper
  source 1..117: mol_type = genomic DNA
gaacccgaagctgaacgtgaataagggacagggtaggacctgaaattgcagagacatagaaaatcaatacgtggtcgggagtcaactgcgcgcgaccaagggctctgccctccctct

SEQ ID NO: 22208 - DNA, 157 bp, Homo sapiens
  misc_feature 1..157: note = chr15:98836021-98836178
  misc_feature 1..157: note = hyper
  source 1..157: mol_type = genomic DNA
taattaggtaaactacgccaagagaggctcagaaacctgcccaaaatgagctggagcatcagcaggggttccaaatggcaggcgtcctctcccctctgtcccacaaagaacagtccgtcccctgggctgggagctgggcccggagccccggggcagc

SEQ ID NO: 22209 - DNA, 30 bp, Homo sapiens; identical to SEQ ID NO: 12340
  misc_feature 1..30: note = chr15:98965287-98965317
  misc_feature 1..30: note = hyper
  source 1..30: mol_type = genomic DNA

SEQ ID NO: 22210 - DNA, 30 bp, Homo sapiens; identical to SEQ ID NO: 12341
  misc_feature 1..30: note = chr15:98971901-98971931
  misc_feature 1..30: note = hyper
  source 1..30: mol_type = genomic DNA

SEQ ID NO: 22211 - DNA, 437 bp, Homo sapiens; identical to SEQ ID NO: 12342
  misc_feature 1..437: note = chr15:100881407-100881844
  misc_feature 1..437: note = hyper
  source 1..437: mol_type = genomic DNA

SEQ ID NO: 22212 - DNA, 70 bp, Homo sapiens; identical to SEQ ID NO: 12345
  misc_feature 1..70: note = chr16:215301-215371
  misc_feature 1..70: note = hyper
  source 1..70: mol_type = genomic DNA

SEQ ID NO: 22213 - DNA, 93 bp, Homo sapiens
  misc_feature 1..93: note = chr16:216583-216676
  misc_feature 1..93: note = hyper
  source 1..93: mol_type = genomic DNA
aatccagtgtttccacgtcgtgctggcctcccacctgcaggacgagttcaccgtgcaaatgcaagcggcgtgggacaagttcctgactggtgt

SEQ ID NO: 22214 - DNA, 38 bp, Homo sapiens; identical to SEQ ID NO: 12350
  misc_feature 1..38: note = chr16:223349-223387
  misc_feature 1..38: note = hyper
  source 1..38: mol_type = genomic DNA

SEQ ID NO: 22215 - DNA, 30 bp, Homo sapiens; identical to SEQ ID NO: 12352
  misc_feature 1..30: note = chr16:230859-230889
  misc_feature 1..30: note = hyper
  source 1..30: mol_type = genomic DNA

SEQ ID NO: 22216 - DNA, 270 bp, Homo sapiens; identical to SEQ ID NO: 12353
  misc_feature 1..270: note = chr16:610046-610316
  misc_feature 1..270: note = hyper
  source 1..270: mol_type = genomic DNA

SEQ ID NO: 22217 - DNA, 151 bp, Homo sapiens; identical to SEQ ID NO: 12354
  misc_feature 1..151: note = chr16:610343-610494
  misc_feature 1..151: note = hyper
  source 1..151: mol_type = genomic DNA

SEQ ID NO: 22218 - DNA, 30 bp, Homo sapiens; identical to SEQ ID NO: 12355
  misc_feature 1..30: note = chr16:681006-681036
  misc_feature 1..30: note = hyper
  source 1..30: mol_type = genomic DNA

SEQ ID NO: 22219 - DNA, 253 bp, Homo sapiens; identical to SEQ ID NO: 12356
  misc_feature 1..253: note = chr16:725597-725850
  misc_feature 1..253: note = hyper
  source 1..253: mol_type = genomic DNA

SEQ ID NO: 22220 - DNA, 343 bp, Homo sapiens; identical to SEQ ID NO: 12357
  misc_feature 1..343: note = chr16:750505-750848
  misc_feature 1..343: note = hyper
  source 1..343: mol_type = genomic DNA

SEQ ID NO: 22221 - DNA, 43 bp, Homo sapiens
  misc_feature 1..43: note = chr16:1030655-1030698
  misc_feature 1..43: note = hyper
  source 1..43: mol_type = genomic DNA
tccgagccaccctcggggacggccgggccgaggccacctcgcg

SEQ ID NO: 22222 - DNA, 284 bp, Homo sapiens; identical to SEQ ID NO: 12359
  misc_feature 1..284: note = chr16:1031782-1032066
  misc_feature 1..284: note = hyper
  source 1..284: mol_type = genomic DNA

SEQ ID NO: 22223 - DNA, 276 bp, Homo sapiens; identical to SEQ ID NO: 12360
  misc_feature 1..276: note = chr16:1203265-1203541
  misc_feature 1..276: note = hyper
  source 1..276: mol_type = genomic DNA

SEQ ID NO: 22224 - DNA, 50 bp, Homo sapiens; identical to SEQ ID NO: 12361
  misc_feature 1..50: note = chr16:1203913-1203963
  misc_feature 1..50: note = hyper
  source 1..50: mol_type = genomic DNA

SEQ ID NO: 22225 - DNA, 77 bp, Homo sapiens
  misc_feature 1..77: note = chr16:1204034-1204111
  misc_feature 1..77: note = hyper
  source 1..77: mol_type = genomic DNA
ccatatccttcccggccggcggggggcggggggcggggggcgtggggagggtgggggcccggggcgcgggactccct

SEQ ID NO: 22226 - DNA, 103 bp, Homo sapiens; identical to SEQ ID NO: 12363
  misc_feature 1..103: note = chr16:1204128-1204231
  misc_feature 1..103: note = hyper
  source 1..103: mol_type = genomic DNA

SEQ ID NO: 22227 - DNA, 248 bp, Homo sapiens; identical to SEQ ID NO: 12364
  misc_feature 1..248: note = chr16:1382374-1382622
  misc_feature 1..248: note = hyper
  source 1..248: mol_type = genomic DNA

SEQ ID NO: 22228 - DNA, 26 bp, Homo sapiens
  misc_feature 1..26: note = chr16:1382940-1382966
  misc_feature 1..26: note = hyper
  source 1..26: mol_type = genomic DNA
ttcgggaccagcgggttggggacagg

SEQ ID NO: 22229 - DNA, 30 bp, Homo sapiens; identical to SEQ ID NO: 12366
  misc_feature 1..30: note = chr16:1384604-1384634
  misc_feature 1..30: note = hyper
  source 1..30: mol_type = genomic DNA

SEQ ID NO: 22230 - DNA, 67 bp, Homo sapiens
  misc_feature 1..67: note = chr16:2040847-2040914
  misc_feature 1..67: note = hyper
  source 1..67: mol_type = genomic DNA
aacctctgggccagccgcacctcggcgcctgtcttggaggagggcggtgcccacggtggggcagggg

SEQ ID NO: 22231 - DNA, 40 bp, Homo sapiens
  misc_feature 1..40: note = chr16:2042160-2042200
  misc_feature 1..40: note = hyper
  source 1..40: mol_type = genomic DNA
agcagcgtccgcgaccgccggcgcgcggtgttgctggacc

SEQ ID NO: 22232 - DNA, 30 bp, Homo sapiens; identical to SEQ ID NO: 12371
  misc_feature 1..30: note = chr16:2070078-2070108
  misc_feature 1..30: note = hyper
  source 1..30: mol_type = genomic DNA

SEQ ID NO: 22233 - DNA, 15 bp, Homo sapiens
  misc_feature 1..15: note = chr16:2892527-2892542
  misc_feature 1..15: note = hyper
  source 1..15: mol_type = genomic DNA
gctccccactgttgt

SEQ ID NO: 22234 - DNA, 37 bp, Homo sapiens; identical to SEQ ID NO: 12374
  misc_feature 1..37: note = chr16:3016812-3016849
  misc_feature 1..37: note = hyper
  source 1..37: mol_type = genomic DNA

SEQ ID NO: 22235 - DNA, 153 bp, Homo sapiens
  misc_feature 1..153: note = chr16:3068201-3068354
  misc_feature 1..153: note = hyper
  source 1..153: mol_type = genomic DNA
ggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggca

SEQ ID NO: 22236 - DNA, 30 bp, Homo sapiens; identical to SEQ ID NO: 12377
  misc_feature 1..30: note = chr16:3096912-3096942
  misc_feature 1..30: note = hyper
  source 1..30: mol_type = genomic DNA

SEQ ID NO: 22237 - DNA, 30 bp, Homo sapiens; identical to SEQ ID NO: 12382
  misc_feature 1..30: note = chr16:3224981-3225011
  misc_feature 1..30: note = hyper
  source 1..30: mol_type = genomic DNA

SEQ ID NO: 22238 - DNA, 98 bp, Homo sapiens
  misc_feature 1..98: note = chr16:3232641-3232739
  misc_feature 1..98: note = hyper
  source 1..98: mol_type = genomic DNA
tccgggatttgaacccgggacctctcgcaccctaagcgagaatcatacccctagaccaacgagccacacgccccgtagcctccggcttgtctttgtgg

SEQ ID NO: 22239 - DNA, 447 bp, Homo sapiens
  misc_feature 1..447: note = chr16:3238546-3238993
  misc_feature 1..447: note = hyper
  source 1..447: mol_type = genomic DNA
agggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcac

SEQ ID NO: 22240 - DNA, 25 bp, Homo sapiens
  misc_feature 1..25: note = chr16:3355209-3355234
  misc_feature 1..25: note = hyper
  source 1..25: mol_type = genomic DNA
acccggcgaggctcccgggaccaaa

SEQ ID NO: 22241 - DNA, 29 bp, Homo sapiens
  misc_feature 1..29: note = chr16:3355250-3355279
  misc_feature 1..29: note = hyper
  source 1..29: mol_type = genomic DNA
cgcagaacagacgcggcagtgcgacgcct

SEQ ID NO: 22242 - DNA, 154 bp, Homo sapiens; identical to SEQ ID NO: 12394
  misc_feature 1..154: note = chr16:4363926-4364080
  misc_feature 1..154: note = hyper
  source 1..154: mol_type = genomic DNA

SEQ ID NO: 22243 - DNA, 329 bp, Homo sapiens; identical to SEQ ID NO: 12395
  misc_feature 1..329: note = chr16:4377992-4378321
  misc_feature 1..329: note = hyper
  source 1..329: mol_type = genomic DNA

SEQ ID NO: 22244 - DNA, 201 bp, Homo sapiens; identical to SEQ ID NO: 12396
  misc_feature 1..201: note = chr16:4588308-4588509
  misc_feature 1..201: note = hyper
  source 1..201: mol_type = genomic DNA

SEQ ID NO: 22245 - DNA, 86 bp, Homo sapiens; identical to SEQ ID NO: 12397
  misc_feature 1..86: note = chr16:5037621-5037707
  misc_feature 1..86: note = hyper
  source 1..86: mol_type = genomic DNA

SEQ ID NO: 22246 - DNA, 30 bp, Homo sapiens; identical to SEQ ID NO: 12399
  misc_feature 1..30: note = chr16:6070172-6070202
  misc_feature 1..30: note = hyper
  source 1..30: mol_type = genomic DNA

SEQ ID NO: 22247 - DNA, 30 bp, Homo sapiens; identical to SEQ ID NO: 12400
  misc_feature 1..30: note = chr16:6533480-6533510
  misc_feature 1..30: note = hyper
  source 1..30: mol_type = genomic DNA

SEQ ID NO: 22248 - DNA, 212 bp, Homo sapiens; identical to SEQ ID NO: 12402
  misc_feature 1..212: note = chr16:10274813-10275025
  misc_feature 1..212: note = hyper
  source 1..212: mol_type = genomic DNA

SEQ ID NO: 22249 - DNA, 106 bp, Homo sapiens
  misc_feature 1..106: note = chr16:10275392-10275498
  misc_feature 1..106: note = hyper
  source 1..106: mol_type = genomic DNA
tcctcaggtggtgcacacgcatgaactgcggcaggtgcacagccctgcgtacctgcaaataccagcacggtcgtgcacgcgtgccctgacgcgcgcctctcgggac

SEQ ID NO: 22250 - DNA, 94 bp, Homo sapiens; identical to SEQ ID NO: 12408
  misc_feature 1..94: note = chr16:10480064-10480158
  misc_feature 1..94: note = hyper
  source 1..94: mol_type = genomic DNA

SEQ ID NO: 22251 - skipped

SEQ ID NO: 22252 - DNA, 110 bp, Homo sapiens
  misc_feature 1..110: note = chr16:12994952-12995062
  misc_feature 1..110: note = hyper
  source 1..110: mol_type = genomic DNA
ctcagggctggagggcgcagccgggaagggcaaggaggccccgcacgcctgggaggggcgatcctgaccagactgcacccagtctgtcttggagtgaaagccatttagtc

SEQ ID NO: 22253 - DNA, 24 bp, Homo sapiens
  misc_feature 1..24: note = chr16:12995593-12995617
  misc_feature 1..24: note = hyper
  source 1..24: mol_type = genomic DNA
ctccacccccgcctcacccagtgg

SEQ ID NO: 22254 - DNA, 289 bp, Homo sapiens
  misc_feature 1..289: note = chr16:12996328-12996617
  misc_feature 1..289: note = hyper
  source 1..289: mol_type = genomic DNA
ccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtca

SEQ ID NO: 22255 - DNA, 113 bp, Homo sapiens
  misc_feature 1..113: note = chr16:12996720-12996833
  misc_feature 1..113: note = hyper
  source 1..113: mol_type = genomic DNA
gtgtgactctgctccctcaccctctggccgcctcctcccgctggtgactgaggcggacttgagacacgtagcctgggagcccgtggccccgaaatcttcgggtttggggagag

SEQ ID NO: 22256 - DNA, 63 bp, Homo sapiens; identical to SEQ ID NO: 12414
  misc_feature 1..63: note = chr16:15950853-15950916
  misc_feature 1..63: note = hyper
  source 1..63: mol_type = genomic DNA

SEQ ID NO: 22257 - DNA, 91 bp, Homo sapiens
  misc_feature 1..91: note = chr16:19567111-19567202
  misc_feature 1..91: note = hyper
  source 1..91: mol_type = genomic DNA
tacttgtgatggggtcggcctgggtctgagagtgtgaattcctctctgtcgggttctggtggtcgaccggccacccccaagttgtcttgac

SEQ ID NO: 22258 - DNA, 30 bp, Homo sapiens; identical to SEQ ID NO: 12416
  misc_feature 1..30: note = chr16:20085391-20085421
  misc_feature 1..30: note = hyper
  source 1..30: mol_type = genomic DNA

SEQ ID NO: 22259 - DNA, 299 bp, Homo sapiens; identical to SEQ ID NO: 12417
  misc_feature 1..299: note = chr16:21294997-21295296
  misc_feature 1..299: note = hyper
  source 1..299: mol_type = genomic DNA

SEQ ID NO: 22260 - DNA, 22 bp, Homo sapiens
  misc_feature 1..22: note = chr16:21295340-21295362
  misc_feature 1..22: note = hyper
  source 1..22: mol_type = genomic DNA
cgctggccgctgctccagacgc

SEQ ID NO: 22261 - DNA, 49 bp, Homo sapiens; identical to SEQ ID NO: 12419
  misc_feature 1..49: note = chr16:21675345-21675394
  misc_feature 1..49: note = hyper
  source 1..49: mol_type = genomic DNA

SEQ ID NO: 22262 - DNA, 13 bp, Homo sapiens
  misc_feature 1..13: note = chr16:21831608-21831621
  misc_feature 1..13: note = hyper
  source 1..13: mol_type = genomic DNA
atcttacccagtc

SEQ ID NO: 22263 - DNA, 83 bp, Homo sapiens; identical to SEQ ID NO: 12421
  misc_feature 1..83: note = chr16:22173801-22173884
  misc_feature 1..83: note = hyper
  source 1..83: mol_type = genomic DNA

SEQ ID NO: 22264 - DNA, 377 bp, Homo sapiens; identical to SEQ ID NO: 12422
  misc_feature 1..377: note = chr16:22203596-22203973
  misc_feature 1..377: note = hyper
  source 1..377: mol_type = genomic DNA

SEQ ID NO: 22265 - DNA, 100 bp, Homo sapiens
  misc_feature 1..100: note = chr16:22824601-22824701
  misc_feature 1..100: note = hyper
  source 1..100: mol_type = genomic DNA
tcctcactcagccctcggcgaccctctggtaccctggacagctccccggggagcagtctaccgctaggcggcggctgctaagagaggaaccctcctgacg

SEQ ID NO: 22266 - DNA, 30 bp, Homo sapiens; identical to SEQ ID NO: 12426
  misc_feature 1..30: note = chr16:22826278-22826308
  misc_feature 1..30: note = hyper
  source 1..30: mol_type = genomic DNA

SEQ ID NO: 22267 - DNA, 64 bp, Homo sapiens
  misc_feature 1..64: note = chr16:23313400-23313464
  misc_feature 1..64: note = hyper
  source 1..64: mol_type = genomic DNA
gtatcgctggtgtcccgaggtggggagggagaatgcggagcgcgtgcgtgcggggggcgtccag

SEQ ID NO: 22268 - DNA, 31 bp, Homo sapiens
  misc_feature 1..31: note = chr16:23706520-23706551
  misc_feature 1..31: note = hyper
  source 1..31: mol_type = genomic DNA
ctcctgcaaggaggcccggcagagctccagg

SEQ ID NO: 22269 - DNA, 30 bp, Homo sapiens; identical to SEQ ID NO: 12429
  misc_feature 1..30: note = chr16:23765970-23766000
  misc_feature 1..30: note = hyper
  source 1..30: mol_type = genomic DNA

SEQ ID NO: 22270 - DNA, 216 bp, Homo sapiens; identical to SEQ ID NO: 1259
  misc_feature 1..216: note = chr16:23846838-23847054
  misc_feature 1..216: note = hyper
  source 1..216: mol_type = genomic DNA

SEQ ID NO: 22271 - DNA, 47 bp, Homo sapiens
  misc_feature 1..47: note = chr16:23847956-23848003
  misc_feature 1..47: note = hyper
  source 1..47: mol_type = genomic DNA
cacctgactaggagcgcgcggggtctgtgcctgccctggagggcagc

SEQ ID NO: 22272 - DNA, 68 bp, Homo sapiens; identical to SEQ ID NO: 1265
  misc_feature 1..68: note = chr16:23848004-23848072
  misc_feature 1..68: note = hyper
  source 1..68: mol_type = genomic DNA

SEQ ID NO: 22273 - DNA, 181 bp, Homo sapiens; identical to SEQ ID NO: 12437
  misc_feature 1..181: note = chr16:23848310-23848491
  misc_feature 1..181: note = hyper
  source 1..181: mol_type = genomic DNA

SEQ ID NO: 22274 - DNA, 90 bp, Homo sapiens
  misc_feature 1..90: note = chr16:24267025-24267115
  misc_feature 1..90: note = hyper
  source 1..90: mol_type = genomic DNA
aggattgaagaatgccgcgttgggtgggtgctgagggagcgccagagtgcgctacgggcttcgctccccttcccctttccttaacccttc

SEQ ID NO: 22275 - DNA, 265 bp, Homo sapiens
  misc_feature 1..265: note = chr16:24267220-24267485
  misc_feature 1..265: note = hyper
  source 1..265: mol_type = genomic DNA
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccag

SEQ ID NO: 22276 - DNA, 30 bp, Homo sapiens
  misc_feature 1..30: note = chr16:24267578-24267608
  misc_feature 1..30: note = hyper
  source 1..30: mol_type = genomic DNA
ctattttttgccatccgccctcacccccag

SEQ ID NO: 22277 - DNA, 37 bp, Homo sapiens; identical to SEQ ID NO: 12440
  misc_feature 1..37: note = chr16:24621912-24621949
  misc_feature 1..37: note = hyper
  source 1..37: mol_type = genomic DNA

SEQ ID NO: 22278 - DNA, 98 bp, Homo sapiens; identical to SEQ ID NO: 12441
  misc_feature 1..98: note = chr16:25702837-25702935
  misc_feature 1..98: note = hyper
  source 1..98: mol_type = genomic DNA

SEQ ID NO: 22279 - DNA, 490 bp, Homo sapiens
  misc_feature 1..490: note = chr16:25703152-25703642
  misc_feature 1..490: note = hyper
  source 1..490: mol_type = genomic DNA
cgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcgg

SEQ ID NO: 22280 - DNA, 16 bp, Homo sapiens
  misc_feature 1..16: note = chr16:25704628-25704644
  misc_feature 1..16: note = hyper
  source 1..16: mol_type = genomic DNA
tcggctgagagggctg

SEQ ID NO: 22281 - DNA, 214 bp, Homo sapiens
  misc_feature 1..214: note = chr16:28074684-28074898
  misc_feature 1..214: note = hyper
  source 1..214: mol_type = genomic DNA
gcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccc

SEQ ID NO: 22282 - DNA, 30 bp, Homo sapiens; identical to SEQ ID NO: 12447
  misc_feature 1..30: note = chr16:31498683-31498713
  misc_feature 1..30: note = hyper
  source 1..30: mol_type = genomic DNA

SEQ ID NO: 22283 - DNA, 100 bp, Homo sapiens; identical to SEQ ID NO: 12448
  misc_feature 1..100: note = chr16:31540961-31541061
  misc_feature 1..100: note = hyper
  source 1..100: mol_type = genomic DNA

SEQ ID NO: 22284 - DNA, 80 bp, Homo sapiens
  misc_feature 1..80: note = chr16:31580480-31580560
  misc_feature 1..80: note = hyper
  source 1..80: mol_type = genomic DNA
tctttggtgtcatttcgatttataaatccatatccatttctgacgttgaaccatttgacagtgccaaggactttggtggc

SEQ ID NO: 22285 - DNA, 132 bp, Homo sapiens; identical to SEQ ID NO: 12450
  misc_feature 1..132: note = chr16:47177106-47177238
  misc_feature 1..132: note = hyper
  source 1..132: mol_type = genomic DNA

SEQ ID NO: 22286 - DNA, 62 bp, Homo sapiens
  misc_feature 1..62: note = chr16:49309108-49309170
  misc_feature 1..62: note = hyper
  source 1..62: mol_type = genomic DNA
tgttctcattaagagcggatgcgcccgggctctgagcattagcgctccagtgcagcttggaa

SEQ ID NO: 22287 - DNA, 186 bp, Homo sapiens
  misc_feature 1..186: note = chr16:49309262-49309448
  misc_feature 1..186: note = hyper
  source 1..186: mol_type = genomic DNA
ctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgca

SEQ ID NO: 22288 - DNA, 56 bp, Homo sapiens
  misc_feature 1..56: note = chr16:49311467-49311523
  misc_feature 1..56: note = hyper
  source 1..56: mol_type = genomic DNA
acagggctgcaagggcgcccgctagagctgctccacggcttaccggattgcatgcg

SEQ ID NO: 22289 - DNA, 86 bp, Homo sapiens
  misc_feature 1..86: note = chr16:49313936-49314022
  misc_feature 1..86: note = hyper
  source 1..86: mol_type = genomic DNA
ccggaaaaacaaaaacgaacaaacaaaaagcccctgatccctcctggacccagctgccaggacacagtggagaagccactgtgatt

SEQ ID NO: 22290 - DNA, 301 bp, Homo sapiens
  misc_feature 1..301: note = chr16:49314118-49314419
  misc_feature 1..301: note = hyper
  source 1..301: mol_type = genomic DNA
ggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaa

SEQ ID NO: 22291 - DNA, 155 bp, Homo sapiens
  misc_feature 1..155: note = chr16:49315764-49315919
  misc_feature 1..155: note = hyper
  source 1..155: mol_type = genomic DNA
caaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcgg

SEQ ID NO: 22292 - DNA, 35 bp, Homo sapiens; identical to SEQ ID NO: 12458
  misc_feature 1..35: note = chr16:49317700-49317735
  misc_feature 1..35: note = hyper
  source 1..35: mol_type = genomic DNA

SEQ ID NO: 22293 - DNA, 18 bp, Homo sapiens
  misc_feature 1..18: note = chr16:51184406-51184424
  misc_feature 1..18: note = hyper
  source 1..18: mol_type = genomic DNA
tggcggccagcagcactc

SEQ ID NO: 22294 - DNA, 37 bp, Homo sapiens
  misc_feature 1..37: note = chr16:51184770-51184807
  misc_feature 1..37: note = hyper
  source 1..37: mol_type = genomic DNA
ccggaaaagcagggacggagaagccaggccggcatgc

SEQ ID NO: 22295 - DNA, 302 bp, Homo sapiens
  misc_feature 1..302: note = chr16:51185542-51185844
  misc_feature 1..302: note = hyper
  source 1..302: mol_type = genomic DNA
gggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatca

SEQ ID NO: 22296 - DNA, 175 bp, Homo sapiens
  misc_feature 1..175: note = chr16:51186939-51187114
  misc_feature 1..175: note = hyper
  source 1..175: mol_type = genomic DNA
aactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccg

SEQ ID NO: 22297 - DNA, 30 bp, Homo sapiens; identical to SEQ ID NO: 12467
  misc_feature 1..30: note = chr16:51189298-51189328
  misc_feature 1..30: note = hyper
  source 1..30: mol_type = genomic DNA

SEQ ID NO: 22298 - DNA, 60 bp, Homo sapiens; identical to SEQ ID NO: 12469
  misc_feature 1..60: note = chr16:54318670-54318730
  misc_feature 1..60: note = hyper
  source 1..60: mol_type = genomic DNA

SEQ ID NO: 22299 - DNA, 43 bp, Homo sapiens
  misc_feature 1..43: note = chr16:54319377-54319420
  misc_feature 1..43: note = hyper
  source 1..43: mol_type = genomic DNA
tgctctccctggtggcgttcttgggacgggacgggtccccgaa

SEQ ID NO: 22300 - DNA, 14 bp, Homo sapiens
  misc_feature 1..14: note = chr16:54319468-54319482
  misc_feature 1..14: note = hyper
  source 1..14: mol_type = genomic DNA
ggcagccgcggccg

SEQ ID NO: 22301 - DNA, 30 bp, Homo sapiens; identical to SEQ ID NO: 12473
  misc_feature 1..30: note = chr16:54966792-54966822
  misc_feature 1..30: note = hyper
  source 1..30: mol_type = genomic DNA

SEQ ID NO: 22302 - DNA, 20 bp, Homo sapiens
  misc_feature 1..20: note = chr16:54971546-54971566
  misc_feature 1..20: note = hyper
  source 1..20: mol_type = genomic DNA
cttagctttgaactccggcc

SEQ ID NO: 22303 - DNA, 30 bp, Homo sapiens; identical to SEQ ID NO: 12476
  misc_feature 1..30: note = chr16:54972930-54972960
  misc_feature 1..30: note = hyper
  source 1..30: mol_type = genomic DNA

SEQ ID NO: 22304 - DNA, 304 bp, Homo sapiens
  misc_feature 1..304: note = chr16:55357622-55357926
  misc_feature 1..304: note = hyper
  source 1..304: mol_type = genomic DNA
ggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtc

SEQ ID NO: 22305 - DNA, 230 bp, Homo sapiens
  misc_feature 1..230: note = chr16:55358086-55358316
  misc_feature 1..230: note = hyper
  source 1..230: mol_type = genomic DNA
tcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgc

SEQ ID NO: 22306 - DNA, 260 bp, Homo sapiens
  misc_feature 1..260: note = chr16:55364843-55365103
  misc_feature 1..260: note = hyper
  source 1..260: mol_type = genomic DNA
ggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagt

SEQ ID NO: 22307 - skipped

SEQ ID NO: 22308 - DNA, 19 bp, Homo sapiens
  misc_feature 1..19: note = chr16:55512935-55512954
  misc_feature 1..19: note = hyper
  source 1..19: mol_type = genomic DNA
cggccggggaaaagaggtg

SEQ ID NO: 22309 - DNA, 138 bp, Homo sapiens; identical to SEQ ID NO: 12486
  misc_feature 1..138: note = chr16:55513226-55513364
  misc_feature 1..138: note = hyper
  source 1..138: mol_type = genomic DNA

SEQ ID NO: 22310 - DNA, 40 bp, Homo sapiens; identical to SEQ ID NO: 12487
  misc_feature 1..40: note = chr16:55513482-55513522
  misc_feature 1..40: note = hyper
  source 1..40: mol_type = genomic DNA

SEQ ID NO: 22311 - DNA, 30 bp, Homo sapiens; identical to SEQ ID NO: 12488
  misc_feature 1..30: note = chr16:55514115-55514145
  misc_feature 1..30: note = hyper
  source 1..30: mol_type = genomic DNA

SEQ ID NO: 22312 - DNA, 89 bp, Homo sapiens; identical to SEQ ID NO: 4359
  misc_feature 1..89: note = chr16:56224880-56224969
  misc_feature 1..89: note = hyper
  source 1..89: mol_type = genomic DNA

SEQ ID NO: 22313 - DNA, 30 bp, Homo sapiens; identical to SEQ ID NO: 12495
  misc_feature 1..30: note = chr16:56225583-56225613
  misc_feature 1..30: note = hyper
  source 1..30: mol_type = genomic DNA

SEQ ID NO: 22314 - DNA, 10 bp, Homo sapiens
  misc_feature 1..10: note = chr16:56228581-56228591
  misc_feature 1..10: note = hyper
  source 1..10: mol_type = genomic DNA
gaggggagtg

SEQ ID NO: 22315 - DNA, 116 bp, Homo sapiens; identical to SEQ ID NO: 12497
  misc_feature 1..116: note = chr16:56623236-56623352
  misc_feature 1..116: note = hyper
  source 1..116: mol_type = genomic DNA

SEQ ID NO: 22316 - DNA, 167 bp, Homo sapiens; identical to SEQ ID NO: 12498
  misc_feature 1..167: note = chr16:56623702-56623869
  misc_feature 1..167: note = hyper
  source 1..167: mol_type = genomic DNA

SEQ ID NO: 22317 - DNA, 47 bp, Homo sapiens
  misc_feature 1..47: note = chr16:56651275-56651322
  misc_feature 1..47: note = hyper
  source 1..47: mol_type = genomic DNA
gcccggccggcctgctgctcacagtccctccacgtacccacaggagg

SEQ ID NO: 22318 - DNA, 47 bp, Homo sapiens
  misc_feature 1..47: note = chr16:56659128-56659175
  misc_feature 1..47: note = hyper
  source 1..47: mol_type = genomic DNA
ctatgtaaggaggtgcgggaccgaggaacctaggtgtggacagggac

SEQ ID NO: 22319 - DNA, 65 bp, Homo sapiens
  misc_feature 1..65: note = chr16:56659673-56659738
  misc_feature 1..65: note = hyper
  source 1..65: mol_type = genomic DNA
cagccagttgcagggctccattctgctttccaactgcctgactgcttgttcgtctcactggtgtg

SEQ ID NO: 22320 - DNA, 44 bp, Homo sapiens; identical to SEQ ID NO: 12501
  misc_feature 1..44: note = chr16:56665985-56666029
  misc_feature 1..44: note = hyper
  source 1..44: mol_type = genomic DNA

SEQ ID NO: 22321 - DNA, 34 bp, Homo sapiens; identical to SEQ ID NO: 12502
  misc_feature 1..34: note = chr16:56666408-56666442
  misc_feature 1..34: note = hyper
  source 1..34: mol_type = genomic DNA

SEQ ID NO: 22322 - DNA, 308 bp, Homo sapiens; identical to SEQ ID NO: 12504
  misc_feature 1..308: note = chr16:56677180-56677488
  misc_feature 1..308: note = hyper
  source 1..308: mol_type = genomic DNA

SEQ ID NO: 22323 - DNA, 19 bp, Homo sapiens
  misc_feature 1..19: note = chr16:56710030-56710049
  misc_feature 1..19: note = hyper
  source 1..19: mol_type = genomic DNA
accacgcctcccacctgcc

SEQ ID NO: 22324 - DNA, 55 bp, Homo sapiens
  misc_feature 1..55: note = chr16:58018579-58018634
  misc_feature 1..55: note = hyper
  source 1..55: mol_type = genomic DNA
acgagggaaagctggcgcccatcgcgccaggcatcaaccgagtggactggccctg

SEQ ID NO: 22325 - DNA, 51 bp, Homo sapiens
  misc_feature 1..51: note = chr16:58018845-58018896
  misc_feature 1..51: note = hyper
  source 1..51: mol_type = genomic DNA
gtggcacttgcggtgggtggagccgagacgtgcgcgcggatctggaggcag

SEQ ID NO: 22326 - DNA, 61 bp, Homo sapiens
  misc_feature 1..61: note = chr16:58019164-58019225
  misc_feature 1..61: note = hyper
  source 1..61: mol_type = genomic DNA
ctggcgggtagggagcgctgcgcgcagacccgtccctgagcggggagcgggggtcctggtg

SEQ ID NO: 22327-22328 - skipped (2 entries)

SEQ ID NO: 22329 - DNA, 265 bp, Homo sapiens; identical to SEQ ID NO: 12510
  misc_feature 1..265: note = chr16:58497469-58497734
  misc_feature 1..265: note = hyper
  source 1..265: mol_type = genomic DNA

SEQ ID NO: 22330 - DNA, 181 bp, Homo sapiens
  misc_feature 1..181: note = chr16:58497994-58498175
  misc_feature 1..181: note = hyper
  source 1..181: mol_type = genomic DNA
tctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgt

SEQ ID NO: 22331 - DNA, 366 bp, Homo sapiens
  misc_feature 1..366: note = chr16:58498204-58498570
  misc_feature 1..366: note = hyper
  source 1..366: mol_type = genomic DNA
gctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgc

SEQ ID NO: 22332 - DNA, 138 bp, Homo sapiens; identical to SEQ ID NO: 12513
  misc_feature 1..138: note = chr16:62069136-62069274
  misc_feature 1..138: note = hyper
  source 1..138: mol_type = genomic DNA

SEQ ID NO: 22333 - DNA, 35 bp, Homo sapiens; identical to SEQ ID NO: 12514
  misc_feature 1..35: note = chr16:62069336-62069371
  misc_feature 1..35: note = hyper
  source 1..35: mol_type = genomic DNA

SEQ ID NO: 22334 - DNA, 13 bp, Homo sapiens
  misc_feature 1..13: note = chr16:62070773-62070786
  misc_feature 1..13: note = hyper
  source 1..13: mol_type = genomic DNA
taggaggaagagg

SEQ ID NO: 22335 - DNA, 172 bp, Homo sapiens; identical to SEQ ID NO: 12516
  misc_feature 1..172: note = chr16:65155754-65155926
  misc_feature 1..172: note = hyper
  source 1..172: mol_type = genomic DNA

SEQ ID NO: 22336 - DNA, 26 bp, Homo sapiens
  misc_feature 1..26: note = chr16:65156359-65156385
  misc_feature 1..26: note = hyper
  source 1..26: mol_type = genomic DNA
tccttcccccaaatccgctccagctg

SEQ ID NO: 22337 - DNA, 23 bp, Homo sapiens
  misc_feature 1..23: note = chr16:65156872-65156895
  misc_feature 1..23: note = hyper
  source 1..23: mol_type = genomic DNA
aagggcctaatggggcgcagcgc

SEQ ID NO: 22338 - DNA, 132 bp, Homo sapiens; identical to SEQ ID NO: 12519
  misc_feature 1..132: note = chr16:65157154-65157286
  misc_feature 1..132: note = hyper
  source 1..132: mol_type = genomic DNA

SEQ ID NO: 22339 - DNA, 15 bp, Homo sapiens
  misc_feature 1..15: note = chr16:65157823-65157838
  misc_feature 1..15: note = hyper
  source 1..15: mol_type = genomic DNA
gtaaccccccaacct

SEQ ID NO: 22340 - DNA, 208 bp, Homo sapiens
  misc_feature 1..208: note = chr16:66461578-66461786
  misc_feature 1..208: note = hyper
  source 1..208: mol_type = genomic DNA
gaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaa

SEQ ID NO: 22341 - DNA, 36 bp, Homo sapiens; identical to SEQ ID NO: 12523
  misc_feature 1..36: note = chr16:66638302-66638338
  misc_feature 1..36: note = hyper
  source 1..36: mol_type = genomic DNA

SEQ ID NO: 22342 - DNA, 32 bp, Homo sapiens; identical to SEQ ID NO: 12524
  misc_feature 1..32: note = chr16:66878288-66878320
  misc_feature 1..32: note = hyper
  source 1..32: mol_type = genomic DNA

SEQ ID NO: 22343 - DNA, 106 bp, Homo sapiens; identical to SEQ ID NO: 12525
  misc_feature 1..106: note = chr16:66878819-66878925
  misc_feature 1..106: note = hyper
  source 1..106: mol_type = genomic DNA

SEQ ID NO: 22344 - DNA, 31 bp, Homo sapiens
  misc_feature 1..31: note = chr16:67197667-67197698
  misc_feature 1..31: note = hyper
  source 1..31: mol_type = genomic DNA
ataccctcaagctcacgcgcgagccgcatcc

SEQ ID NO: 22345 - DNA, 240 bp, Homo sapiens
  misc_feature 1..240: note = chr16:67197769-67198009
  misc_feature 1..240: note = hyper
  source 1..240: mol_type = genomic DNA
agggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgca

SEQ ID NO: 22346 - DNA, 233 bp, Homo sapiens
  misc_feature 1..233: note = chr16:67198039-67198272
  misc_feature 1..233: note = hyper
  source 1..233: mol_type = genomic DNA
cctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgc

SEQ ID NO: 22347 - DNA, 142 bp, Homo sapiens
  misc_feature 1..142: note = chr16:67198775-67198917
  misc_feature 1..142: note = hyper
  source 1..142: mol_type = genomic DNA
tcggcaagctatgggcgctggtgggggacccaggcacagaccacctgatccgctggagcccggtgagggccggggcccctcgattccccctgtggtcccggggtccctccacgtcagtgaacacccatgcccgcccaacccc

SEQ ID NO: 22348 - DNA, 51 bp, Homo sapiens; identical to SEQ ID NO: 12528
  misc_feature 1..51: note = chr16:67199411-67199462
  misc_feature 1..51: note = hyper
  source 1..51: mol_type = genomic DNA

SEQ ID NO: 22349 - DNA, 45 bp, Homo sapiens; identical to SEQ ID NO: 12529
  misc_feature 1..45: note = chr16:68118410-68118455
  misc_feature 1..45: note = hyper
  source 1..45: mol_type = genomic DNA

SEQ ID NO: 22350 - DNA, 98 bp, Homo sapiens; identical to SEQ ID NO: 12530
  misc_feature 1..98: note = chr16:68118803-68118901
  misc_feature 1..98: note = hyper
  source 1..98: mol_type = genomic DNA

SEQ ID NO: 22351 - DNA, 69 bp, Homo sapiens; identical to SEQ ID NO: 12531
  misc_feature 1..69: note = chr16:68504068-68504137
  misc_feature 1..69: note = hyper
  source 1..69: mol_type = genomic DNA

SEQ ID NO: 22352 - DNA, 48 bp, Homo sapiens
  misc_feature 1..48: note = chr16:68676360-68676408
  misc_feature 1..48: note = hyper
  source 1..48: mol_type = genomic DNA
aagtggttggcacatcgccggctgtcagcaaatgtttttgaaatgaat

SEQ ID NO: 22353 - DNA, 48 bp, Homo sapiens
  misc_feature 1..48: note = chr16:71459979-71460027
  misc_feature 1..48: note = hyper
  source 1..48: mol_type = genomic DNA
ctccgccgcttgcaccggacccaggcgctcatcccccgcttcccccgc

SEQ ID NO: 22354 - DNA, 72 bp, Homo sapiens; identical to SEQ ID NO: 12537
  misc_feature 1..72: note = chr16:75528797-75528869
  misc_feature 1..72: note = hyper
  source 1..72: mol_type = genomic DNA

SEQ ID NO: 22355 - DNA, 207 bp, Homo sapiens; identical to SEQ ID NO: 12538
  misc_feature 1..207: note = chr16:75528922-75529129
  misc_feature 1..207: note = hyper
  source 1..207: mol_type = genomic DNA

SEQ ID NO: 22356 - DNA, 208 bp, Homo sapiens; identical to SEQ ID NO: 12539
  misc_feature 1..208: note = chr16:77246657-77246865
  misc_feature 1..208: note = hyper
  source 1..208: mol_type = genomic DNA

SEQ ID NO: 22357 - DNA, 48 bp, Homo sapiens; identical to SEQ ID NO: 12540
  misc_feature 1..48: note = chr16:77469028-77469076
  misc_feature 1..48: note = hyper
  source 1..48: mol_type = genomic DNA

SEQ ID NO: 22358 - DNA, 85 bp, Homo sapiens; identical to SEQ ID NO: 4369
  misc_feature 1..85: note = chr16:77822334-77822419
  misc_feature 1..85: note = hyper
  source 1..85: mol_type = genomic DNA

SEQ ID NO: 22359 - DNA, 169 bp, Homo sapiens
  misc_feature 1..169: note = chr16:77822420-77822589
  misc_feature 1..169: note = hyper
  source 1..169: mol_type = genomic DNA
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaagg

SEQ ID NO: 22360 - DNA, 234 bp, Homo sapiens
  misc_feature 1..234: note = chr16:77822874-77823108
  misc_feature 1..234: note = hyper
  source 1..234: mol_type = genomic DNA
gggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtc

SEQ ID NO: 22361 - DNA, 57 bp, Homo sapiens; identical to SEQ ID NO: 12543
  misc_feature 1..57: note = chr16:78079844-78079901
  misc_feature 1..57: note = hyper
  source 1..57: mol_type = genomic DNA

SEQ ID NO: 22362 - DNA, 83 bp, Homo sapiens; identical to SEQ ID NO: 12544
  misc_feature 1..83: note = chr16:79632686-79632769
  misc_feature 1..83: note = hyper
  source 1..83: mol_type = genomic DNA

SEQ ID NO: 22363 - DNA, 38 bp, Homo sapiens; identical to SEQ ID NO: 12545
  misc_feature 1..38: note = chr16:79633490-79633528
  misc_feature 1..38: note = hyper
  source 1..38: mol_type = genomic DNA

SEQ ID NO: 22364 - DNA, 153 bp, Homo sapiens; identical to SEQ ID NO: 12546
  misc_feature 1..153: note = chr16:80574886-80575039
  misc_feature 1..153: note = hyper
  source 1..153: mol_type = genomic DNA

SEQ ID NO: 22365 - DNA, 136 bp, Homo sapiens; identical to SEQ ID NO: 12548
  misc_feature 1..136: note = chr16:82661468-82661604
  misc_feature 1..136: note = hyper
  source 1..136: mol_type = genomic DNA

SEQ ID NO: 22366 - DNA, 49 bp, Homo sapiens; identical to SEQ ID NO: 12549
  misc_feature 1..49: note = chr16:84633325-84633374
  misc_feature 1..49: note = hyper
  source 1..49: mol_type = genomic DNA

SEQ ID NO: 22367 - DNA, 30 bp, Homo sapiens; identical to SEQ ID NO: 12550
  misc_feature 1..30: note = chr16:85203552-85203582
  misc_feature 1..30: note = hyper
  source 1..30: mol_type = genomic DNA

SEQ ID NO: 22368 - DNA, 228 bp, Homo sapiens; identical to SEQ ID NO: 12551
  misc_feature 1..228: note = chr16:85932377-85932605
  misc_feature 1..228: note = hyper
  source 1..228: mol_type = genomic DNA

SEQ ID NO: 22369 - DNA, 97 bp, Homo sapiens
  misc_feature 1..97: note = chr16:85932858-85932955
  misc_feature 1..97: note = hyper
  source 1..97: mol_type = genomic DNA
tgtcccgcgcggtccggtcccgcggggtccccgacgccaggcggggcgtgggggtggaactacctaccgtaatgtccccgggcgcagctcagtggcc

SEQ ID NO: 22370 - DNA, 30 bp, Homo sapiens; identical to SEQ ID NO: 12553
  misc_feature 1..30: note = chr16:86320396-86320426
  misc_feature 1..30: note = hyper
  source 1..30: mol_type = genomic DNA

SEQ ID NO: 22371 - DNA, 119 bp, Homo sapiens
  misc_feature 1..119: note = chr16:86320901-86321020
  misc_feature 1..119: note = hyper
  source 1..119: mol_type = genomic DNA
ccctctggtgccagccgccttcaggctgtgggtccgtccgctggtggaggggaaggtcggggctggccccgggccccgcgctgctgggccccatggtcagtggagacgcctcctggtct

SEQ ID NO: 22372 - DNA, 243 bp, Homo sapiens
  misc_feature 1..243: note = chr16:86531046-86531289
  misc_feature 1..243: note = hyper
  source 1..243: mol_type = genomic DNA
cctcggtcttcccggctcccaggacgccccccccgcccccgcccctccattcagcctgtcatctcggccctccgccgcctccggagccccgacggaggtgctgagttgtcaacgcaaattcctagttaagccacttgttgataaaccctctaggcaaattggttccgtctttacctgcccgccccgcccccgcccccggccccagccggcgcgcccctaattgctggaggagctcgacgccgg

SEQ ID NO: 22373 - DNA, 47 bp, Homo sapiens
  misc_feature 1..47: note = chr16:86531573-86531620
  misc_feature 1..47: note = hyper
  source 1..47: mol_type = genomic DNA
gtccctcccgccgcgcagggtctccgcgggcgcgccccgccccaaat

SEQ ID NO: 22374 - DNA, 42 bp, Homo sapiens; identical to SEQ ID NO: 12559
  misc_feature 1..42: note = chr16:86539385-86539427
  misc_feature 1..42: note = hyper
  source 1..42: mol_type = genomic DNA

SEQ ID NO: 22375 - DNA, 15 bp, Homo sapiens
  misc_feature 1..15: note = chr16:86539463-86539478
  misc_feature 1..15: note = hyper
  source 1..15: mol_type = genomic DNA
cgctctcggcccggg

SEQ ID NO: 22376 - DNA, 161 bp, Homo sapiens
  misc_feature 1..161: note = chr16:86600322-86600483
  misc_feature 1..161: note = hyper
  source 1..161: mol_type = genomic DNA
cctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctc

SEQ ID NO: 22377 - DNA, 64 bp, Homo sapiens; identical to SEQ ID NO: 12566
  misc_feature 1..64: note = chr16:86600877-86600941
  misc_feature 1..64: note = hyper
  source 1..64: mol_type = genomic DNA

SEQ ID NO: 22378 - DNA, 84 bp, Homo sapiens; identical to SEQ ID NO: 12569
  misc_feature 1..84: note = chr16:86775022-86775106
  misc_feature 1..84: note = hyper
  source 1..84: mol_type = genomic DNA

SEQ ID NO: 22379 - DNA, 33 bp, Homo sapiens
  misc_feature 1..33: note = chr16:87635070-87635103
  misc_feature 1..33: note = hyper
  source 1..33: mol_type = genomic DNA
cagtttctggctcaccgcgctgcggtcaccggc

SEQ ID NO: 22380 - DNA, 368 bp, Homo sapiens
  misc_feature 1..368: note = chr16:87636907-87637275
  misc_feature 1..368: note = hyper
  source 1..368: mol_type = genomic DNA
ctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaa

SEQ ID NO: 22381 - DNA, 54 bp, Homo sapiens; identical to SEQ ID NO: 12573
  misc_feature 1..54: note = chr16:87637599-87637653
  misc_feature 1..54: note = hyper
  source 1..54: mol_type = genomic DNA

SEQ ID NO: 22382 - DNA, 42 bp, Homo sapiens; identical to SEQ ID NO: 12574
  misc_feature 1..42: note = chr16:88449331-88449373
  misc_feature 1..42: note = hyper
  source 1..42: mol_type = genomic DNA

SEQ ID NO: 22383 - DNA, 215 bp, Homo sapiens; identical to SEQ ID NO: 12575
  misc_feature 1..215: note = chr16:88449705-88449920
  misc_feature 1..215: note = hyper
  source 1..215: mol_type = genomic DNA

SEQ ID NO: 22384 - DNA, 65 bp, Homo sapiens; identical to SEQ ID NO: 12576
  misc_feature 1..65: note = chr16:88450363-88450428
  misc_feature 1..65: note = hyper
  source 1..65: mol_type = genomic DNA

SEQ ID NO: 22385 - DNA, 11 bp, Homo sapiens
  misc_feature 1..11: note = chr16:89007509-89007520
  misc_feature 1..11: note = hyper
  source 1..11: mol_type = genomic DNA
tggtccccgcc

SEQ ID NO: 22386 - DNA, 173 bp, Homo sapiens
  misc_feature 1..173: note = chr16:89007558-89007731
  misc_feature 1..173: note = hyper
  source 1..173: mol_type = genomic DNA
ccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaa

SEQ ID NO: 22387 - DNA, 145 bp, Homo sapiens
  misc_feature 1..145: note = chr16:89267663-89267808
  misc_feature 1..145: note = hyper
  source 1..145: mol_type = genomic DNA
gcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcag

SEQ ID NO: 22388 - DNA, 30 bp, Homo sapiens; identical to SEQ ID NO: 12579
  misc_feature 1..30: note = chr16:89992943-89992973
  misc_feature 1..30: note = hyper
  source 1..30: mol_type = genomic DNA

SEQ ID NO: 22389 - DNA, 57 bp, Homo sapiens; identical to SEQ ID NO: 12580
  misc_feature 1..57: note = chr17:1083604-1083661
  misc_feature 1..57: note = hyper
  source 1..57: mol_type = genomic DNA

SEQ ID NO: 22390 - DNA, 45 bp, Homo sapiens; identical to SEQ ID NO: 12582
  misc_feature 1..45: note = chr17:1928077-1928122
  misc_feature 1..45: note = hyper
  source 1..45: mol_type = genomic DNA

SEQ ID NO: 22391 - DNA, 32 bp, Homo sapiens
  misc_feature 1..32: note = chr17:1959436-1959468
  misc_feature 1..32: note = hyper
  source 1..32: mol_type = genomic DNA
gggccccgaccgagggttgacagcccccggcc

SEQ ID NO: 22392 - DNA, 477 bp, Homo sapiens; identical to SEQ ID NO: 12584
  misc_feature 1..477: note = chr17:2627798-2628275
  misc_feature 1..477: note = hyper
  source 1..477: mol_type = genomic DNA

SEQ ID NO: 22393 - DNA, 41 bp, Homo sapiens; identical to SEQ ID NO: 12585
  misc_feature 1..41: note = chr17:2652548-2652589
  misc_feature 1..41: note = hyper
  source 1..41: mol_type = genomic DNA

SEQ ID NO: 22394 - DNA, 30 bp, Homo sapiens; identical to SEQ ID NO: 12586
  misc_feature 1..30: note = chr17:2659635-2659665
  misc_feature 1..30: note = hyper
  source 1..30: mol_type = genomic DNA

SEQ ID NO: 22395 - DNA, 118 bp, Homo sapiens; identical to SEQ ID NO: 12587
  misc_feature 1..118: note = chr17:2756282-2756400
  misc_feature 1..118: note = hyper
  source 1..118: mol_type = genomic DNA

SEQ ID NO: 22396 - DNA, 12 bp, Homo sapiens
  misc_feature 1..12: note = chr17:3438902-3438914
  misc_feature 1..12: note = hyper
  source 1..12: mol_type = genomic DNA
agaaggccccct

SEQ ID NO: 22397 - DNA, 59 bp, Homo sapiens; identical to SEQ ID NO: 12589
  misc_feature 1..59: note = chr17:3867044-3867103
  misc_feature 1..59: note = hyper
  source 1..59: mol_type = genomic DNA

SEQ ID NO: 22398 - DNA, 57 bp, Homo sapiens
  misc_feature 1..57: note = chr17:4544550-4544607
  misc_feature 1..57: note = hyper
  source 1..57: mol_type = genomic DNA
ttgtgcaatgaggggcgcacaggagcatgccctcaattccaaggagatcgggtagcg

SEQ ID NO: 22399 - DNA, 70 bp, Homo sapiens
  misc_feature 1..70: note = chr17:4544710-4544780
  misc_feature 1..70: note = hyper
  source 1..70: mol_type = genomic DNA
gagaatcggccagaggccaacgggggcgcatgtcctccccggtatttgactgactcggagccaggggcgc

SEQ ID NO: 22400 - DNA, 41 bp, Homo sapiens; identical to SEQ ID NO: 12591
  misc_feature 1..41: note = chr17:4981508-4981549
  misc_feature 1..41: note = hyper
  source 1..41: mol_type = genomic DNA

SEQ ID NO: 22401 - skipped

SEQ ID NO: 22402 - DNA, 27 bp, Homo sapiens
  misc_feature 1..27: note = chr17:5000401-5000428
  misc_feature 1..27: note = hyper
  source 1..27: mol_type = genomic DNA
gagcagcctcagcagcgcaggtggaca

SEQ ID NO: 22403 - DNA, 46 bp, Homo sapiens; identical to SEQ ID NO: 12594
  misc_feature 1..46: note = chr17:5001155-5001201
  misc_feature 1..46: note = hyper
  source 1..46: mol_type = genomic DNA

SEQ ID NO: 22404 - DNA, 62 bp, Homo sapiens; identical to SEQ ID NO: 12595
  misc_feature 1..62: note = chr17:6616271-6616333
  misc_feature 1..62: note = hyper
  source 1..62: mol_type = genomic DNA

SEQ ID NO: 22405 - DNA, 197 bp, Homo sapiens
  misc_feature 1..197: note = chr17:6616686-6616883
  misc_feature 1..197: note = hyper
  source 1..197: mol_type = genomic DNA
aggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaac

SEQ ID NO: 22406 - DNA, 27 bp, Homo sapiens
  misc_feature 1..27: note = chr17:6616884-6616911
  misc_feature 1..27: note = hyper
  source 1..27: mol_type = genomic DNA
cttcgggccagccctctaggggcagcc

SEQ ID NO: 22407 - DNA, 32 bp, Homo sapiens; identical to SEQ ID NO: 12598
  misc_feature 1..32: note = chr17:6679763-6679795
  misc_feature 1..32: note = hyper
  source 1..32: mol_type = genomic DNA

SEQ ID NO: 22408 - DNA, 36 bp, Homo sapiens; identical to SEQ ID NO: 12599
  misc_feature 1..36: note = chr17:6926208-6926244
  misc_feature 1..36: note = hyper
  source 1..36: mol_type = genomic DNA

SEQ ID NO: 22409 - DNA, 41 bp, Homo sapiens; identical to SEQ ID NO: 12600
  misc_feature 1..41: note = chr17:7554709-7554750
  misc_feature 1..41: note = hyper
  source 1..41: mol_type = genomic DNA

SEQ ID NO: 22410 - DNA, 30 bp, Homo sapiens; identical to SEQ ID NO: 12601
  misc_feature 1..30: note = chr17:8055644-8055674
  misc_feature 1..30: note = hyper
  source 1..30: mol_type = genomic DNA

SEQ ID NO: 22411 - DNA, 88 bp, Homo sapiens
  misc_feature 1..88: note = chr17:8230694-8230782
  misc_feature 1..88: note = hyper
  source 1..88: mol_type = genomic DNA
tagccactcctccttcccacccacccgcagcactctcgaggtcgcaacggcagtcaccaggtcccggggcctgcgttcagctgcttga

SEQ ID NO: 22412 - DNA, 155 bp, Homo sapiens
  misc_feature 1..155: note = chr17:8906518-8906673
  misc_feature 1..155: note = hyper
  source 1..155: mol_type = genomic DNA
ccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcg

SEQ ID NO: 22413 - DNA, 86 bp, Homo sapiens
  misc_feature 1..86: note = chr17:8906907-8906993
  misc_feature 1..86: note = hyper
  source 1..86: mol_type = genomic DNA
cggccctgccgcgcccgcgccccgggccaccccgcccggccccctcggcgctgcacccctcgctttccccatctccagccgctcgc

SEQ ID NO: 22414 - DNA, 153 bp, Homo sapiens
  misc_feature 1..153: note = chr17:8907575-8907728
  misc_feature 1..153: note = hyper
  source 1..153: mol_type = genomic DNA
gctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgct

SEQ ID NO: 22415 - DNA, 22 bp, Homo sapiens
  misc_feature 1..22: note = chr17:8907776-8907798
  misc_feature 1..22: note = hyper
  source 1..22: mol_type = genomic DNA
cgggtgacggaggctttatcct

SEQ ID NO: 22416 - DNA, 63 bp, Homo sapiens; identical to SEQ ID NO: 12610
  misc_feature 1..63: note = chr17:8925622-8925685
  misc_feature 1..63: note = hyper
  source 1..63: mol_type = genomic DNA

SEQ ID NO: 22417 - DNA, 97 bp, Homo sapiens
  misc_feature 1..97: note = chr17:10102318-10102415
  misc_feature 1..97: note = hyper
  source 1..97: mol_type = genomic DNA
cactcgcgcccccaccgccggggaccgcgggaatggaaacgcccctctgttctgtgcctgctttgtaggcctggcggcccgtggcgtgcgggcggct

SEQ ID NO: 22418 - DNA, 245 bp, Homo sapiens; identical to SEQ ID NO: 12614
  misc_feature 1..245: note = chr17:10633034-10633279
  misc_feature 1..245: note = hyper
  source 1..245: mol_type = genomic DNA

SEQ ID NO: 22419 - DNA, 34 bp, Homo sapiens; identical to SEQ ID NO: 12615
  misc_feature 1..34: note = chr17:13503911-13503945
  misc_feature 1..34: note = hyper
  source 1..34: mol_type = genomic DNA

SEQ ID NO: 22420 - DNA, 33 bp, Homo sapiens
  misc_feature 1..33: note = chr17:14201008-14201041
  misc_feature 1..33: note = hyper
  source 1..33: mol_type = genomic DNA
ggggctctgggccaccggttcaggctgccccag

SEQ ID NO: 22421 - DNA, 149 bp, Homo sapiens; identical to SEQ ID NO: 12620
  misc_feature 1..149: note = chr17:14203122-14203271
  misc_feature 1..149: note = hyper
  source 1..149: mol_type = genomic DNA

SEQ ID NO: 22422 - DNA, 115 bp, Homo sapiens; identical to SEQ ID NO: 12621
  misc_feature 1..115: note = chr17:14204011-14204126
  misc_feature 1..115: note = hyper
  source 1..115: mol_type = genomic DNA

SEQ ID NO: 22423 - DNA, 447 bp, Homo sapiens; identical to SEQ ID NO: 12622
  misc_feature 1..447: note = chr17:14205251-14205698
  misc_feature 1..447: note = hyper
  source 1..447: mol_type = genomic DNA

SEQ ID NO: 22424 - DNA, 30 bp, Homo sapiens; identical to SEQ ID NO: 12623
  misc_feature 1..30: note = chr17:14206313-14206343
  misc_feature 1..30: note = hyper
  source 1..30: mol_type = genomic DNA

SEQ ID NO: 22425 - DNA, 30 bp, Homo sapiens; identical to SEQ ID NO: 12624
  misc_feature 1..30: note = chr17:15164652-15164682
  misc_feature 1..30: note = hyper
  source 1..30: mol_type = genomic DNA

SEQ ID NO: 22426 - DNA, 66 bp, Homo sapiens; identical to SEQ ID NO: 12625
  misc_feature 1..66: note = chr17:15166283-15166349
  misc_feature 1..66: note = hyper
  source 1..66: mol_type = genomic DNA

SEQ ID NO: 22427 - DNA, 92 bp, Homo sapiens; identical to SEQ ID NO: 12626
  misc_feature 1..92: note = chr17:15166709-15166801
  misc_feature 1..92: note = hyper
  source 1..92: mol_type = genomic DNA

SEQ ID NO: 22428 - DNA, 63 bp, Homo sapiens
  misc_feature 1..63: note = chr17:15244987-15245050
  misc_feature 1..63: note = hyper
  source 1..63: mol_type = genomic DNA
cggccgccccggccggctcgccggagctgactggccagttataggagaggcgggagctgtcag

SEQ ID NO: 22429 - DNA, 35 bp, Homo sapiens; identical to SEQ ID NO: 12628
  misc_feature 1..35: note = chr17:15820977-15821012
  misc_feature 1..35: note = hyper
  source 1..35: mol_type = genomic DNA

SEQ ID NO: 22430 - DNA, 213 bp, Homo sapiens; identical to SEQ ID NO: 12629
  misc_feature 1..213: note = chr17:16472191-16472404
  misc_feature 1..213: note = hyper
  source 1..213: mol_type = genomic DNA

SEQ ID NO: 22431 - DNA, 109 bp, Homo sapiens
  misc_feature 1..109: note = chr17:16570794-16570903
  misc_feature 1..109: note = hyper
  source 1..109: mol_type = genomic DNA
ggggctgaaaggctgaagggcgggcagcgtgccgggtccctgcggctgggtccaccgcacgtcacgtggcagaatcccggggctgctttctctccggctgctcagccac

SEQ ID NO: 22432 - DNA, 74 bp, Homo sapiens; identical to SEQ ID NO: 12631
  misc_feature 1..74: note = chr17:17398902-17398976
  misc_feature 1..74: note = hyper
  source 1..74: mol_type = genomic DNA

SEQ ID NO: 22433 - DNA, 40 bp, Homo sapiens; identical to SEQ ID NO: 12633
  misc_feature 1..40: note = chr17:19437028-19437068
  misc_feature 1..40: note = hyper
  source 1..40: mol_type = genomic DNA

SEQ ID NO: 22434 - DNA, 51 bp, Homo sapiens; identical to SEQ ID NO: 12634
  misc_feature 1..51: note = chr17:19483136-19483187
  misc_feature 1..51: note = hyper
  source 1..51: mol_type = genomic DNA

SEQ ID NO: 22435 - DNA, 30 bp, Homo sapiens; identical to SEQ ID NO: 12635
  misc_feature 1..30: note = chr17:20755963-20755993
  misc_feature 1..30: note = hyper
  source 1..30: mol_type = genomic DNA

SEQ ID NO: 22436 - DNA, 34 bp, Homo sapiens; identical to SEQ ID NO: 12636
  misc_feature 1..34: note = chr17:26120627-26120661
  misc_feature 1..34: note = hyper
  source 1..34: mol_type = genomic DNA

SEQ ID NO: 22437 - DNA, 78 bp, Homo sapiens
  misc_feature 1..78: note = chr17:26554556-26554634
  misc_feature 1..78: note = hyper
  source 1..78: mol_type = genomic DNA
ggggctctccccctgcggccccgctccaccgggggcgtggctagatctgaccgcgcccttccaggccccgccctcagg

SEQ ID NO: 22438 - DNA, 48 bp, Homo sapiens
  misc_feature 1..48: note = chr17:26554705-26554753
  misc_feature 1..48: note = hyper
  source 1..48: mol_type = genomic DNA
caggtggcggtaaaagcgcccccatcaagtcacataacatcctgcctc

SEQ ID NO: 22439 - DNA, 178 bp, Homo sapiens; identical to SEQ ID NO: 12638
  misc_feature 1..178: note = chr17:26554791-26554969
  misc_feature 1..178: note = hyper
  source 1..178: mol_type = genomic DNA

SEQ ID NO: 22440 - DNA, 46 bp, Homo sapiens; identical to SEQ ID NO: 12639
  misc_feature 1..46: note = chr17:26578387-26578433
  misc_feature 1..46: note = hyper
  source 1..46: mol_type = genomic DNA

SEQ ID NO: 22441 - DNA, 35 bp, Homo sapiens
  misc_feature 1..35: note = chr17:27332660-27332695
  misc_feature 1..35: note = hyper
  source 1..35: mol_type = genomic DNA
cgcgaagcccgcgccccgcccggcttggccggcgc

SEQ ID NO: 22442 - DNA, 629 bp, Homo sapiens; identical to SEQ ID NO: 12642
  misc_feature 1..629: note = chr17:27949499-27950128
  misc_feature 1..629: note = hyper
  source 1..629: mol_type = genomic DNA

SEQ ID NO: 22443 - DNA, 30 bp, Homo sapiens; identical to SEQ ID NO: 12643
  misc_feature 1..30: note = chr17:28562797-28562827
  misc_feature 1..30: note = hyper
  source 1..30: mol_type = genomic DNA

SEQ ID NO: 22444 - DNA, 91 bp, Homo sapiens; identical to SEQ ID NO: 12644
  misc_feature 1..91: note = chr17:28705348-28705439
  misc_feature 1..91: note = hyper
  source 1..91: mol_type = genomic DNA

SEQ ID NO: 22445 - DNA, 67 bp, Homo sapiens
  misc_feature 1..67: note = chr17:29249650-29249717
  misc_feature 1..67: note = hyper
  source 1..67: mol_type = genomic DNA
ccccacctgcagctccgcgccgagccccgcggtgcgccccccgcgccctcctctcggttccttctga

SEQ ID NO: 22446 - skipped

SEQ ID NO: 22447 - DNA, 73 bp, Homo sapiens
  misc_feature 1..73: note = chr17:29718142-29718215
  misc_feature 1..73: note = hyper
  source 1..73: mol_type = genomic DNA
ctccagagatggcagcgaatcccggccctgcctcttgccagctgtgtggcctagagtgagtccgacctctctg

SEQ ID NO: 22448 - DNA, 102 bp, Homo sapiens
  misc_feature 1..102: note = chr17:29718269-29718371
  misc_feature 1..102: note = hyper
  source 1..102: mol_type = genomic DNA
cccccaggacatcctgagcgctcgggagacgccaggcgcggcagcgggcacggatagcggaaaggggcgcgaccccgcggaatcctccggcagggcagggcc

SEQ ID NO: 22449 - DNA, 382 bp, Homo sapiens
  misc_feature 1..382: note = chr17:29718805-29719187
  misc_feature 1..382: note = hyper
  source 1..382: mol_type = genomic DNA
gcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccggg

SEQ ID NO: 22450 - DNA, 64 bp, Homo sapiens; identical to SEQ ID NO: 12648
  misc_feature 1..64: note = chr17:30846542-30846606
  misc_feature 1..64: note = hyper
  source 1..64: mol_type = genomic DNA

SEQ ID NO: 22451 - DNA, 118 bp, Homo sapiens; identical to SEQ ID NO: 1281
  misc_feature 1..118: note = chr17:31618291-31618409
  misc_feature 1..118: note = hyper
  source 1..118: mol_type = genomic DNA

SEQ ID NO: 22452 - DNA, 15 bp, Homo sapiens
  misc_feature 1..15: note = chr17:31618410-31618425
  misc_feature 1..15: note = hyper
  source 1..15: mol_type = genomic DNA
cggagggcaactcac

SEQ ID NO: 22453 - DNA, 18 bp, Homo sapiens
  misc_feature 1..18: note = chr17:31619319-31619337
  misc_feature 1..18: note = hyper
  source 1..18: mol_type = genomic DNA
gggcgcccgcccggggct

SEQ ID NO: 22454 - DNA, 264 bp, Homo sapiens
  misc_feature 1..264: note = chr17:31619687-31619951
  misc_feature 1..264: note = hyper
  source 1..264: mol_type = genomic DNA
gagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtcc

SEQ ID NO: 22455 - DNA, 125 bp, Homo sapiens
  misc_feature 1..125: note = chr17:31620026-31620151
  misc_feature 1..125: note = hyper
  source 1..125: mol_type = genomic DNA
ccagccttgctgtctctcgcgtcttctctctgcccccgcggcgacaagagctggggactgcggggacccgccaacacctcccgggggtgacccggactcgctgctccgcgcgcccttctcctctc

SEQ ID NO: 22456 - DNA, 57 bp, Homo sapiens; identical to SEQ ID NO: 12653
  misc_feature 1..57: note = chr17:32906021-32906078
  misc_feature 1..57: note = hyper
  source 1..57: mol_type = genomic DNA

SEQ ID NO: 22457 - DNA, 153 bp, Homo sapiens; identical to SEQ ID NO: 12654
  misc_feature 1..153: note = chr17:32907265-32907418
  misc_feature 1..153: note = hyper
  source 1..153: mol_type = genomic DNA

SEQ ID NO: 22458 - DNA, 32 bp, Homo sapiens
  misc_feature 1..32: note = chr17:32907620-32907652
  misc_feature 1..32: note = hyper
  source 1..32: mol_type = genomic DNA
cttggaggaagaaagcggcgctatccatgtgc

SEQ ID NO: 22459 - DNA, 52 bp, Homo sapiens
  misc_feature 1..52: note = chr17:32907753-32907805
  misc_feature 1..52: note = hyper
  source 1..52: mol_type = genomic DNA
tgggctctaggtagcccccgggacgcccgcggccaccgggctccggactgca

SEQ ID NO: 22460 - DNA, 259 bp, Homo sapiens
  misc_feature 1..259: note = chr17:32907873-32908132
  misc_feature 1..259: note = hyper
  source 1..259: mol_type = genomic DNA
cgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccc

SEQ ID NO: 22461 - DNA, 65 bp, Homo sapiens
  misc_feature 1..65: note = chr17:32908582-32908647
  misc_feature 1..65: note = hyper
  source 1..65: mol_type = genomic DNA
gcgcgcaggccggtgcggggccgcgccgcccgtcgcctcgcttcctgcggcggtcctcgggaagg

SEQ ID NO: 22462 - DNA, 301 bp, Homo sapiens; identical to SEQ ID NO: 12660
  misc_feature 1..301: note = chr17:33700472-33700773
  misc_feature 1..301: note = hyper
  source 1..301: mol_type = genomic DNA

SEQ ID NO: 22463 - DNA, 402 bp, Homo sapiens; identical to SEQ ID NO: 12661
  misc_feature 1..402: note = chr17:33700974-33701376
  misc_feature 1..402: note = hyper
  source 1..402: mol_type = genomic DNA

SEQ ID NO: 22464 - DNA, 44 bp, Homo sapiens; identical to SEQ ID NO: 12662
  misc_feature 1..44: note = chr17:33775400-33775444
  misc_feature 1..44: note = hyper
  source 1..44: mol_type = genomic DNA

SEQ ID NO: 22465 - DNA, 347 bp, Homo sapiens; identical to SEQ ID NO: 12663
  misc_feature 1..347: note = chr17:35014262-35014609
  misc_feature 1..347: note = hyper
  source 1..347: mol_type = genomic DNA

SEQ ID NO: 22466 - DNA, 341 bp, Homo sapiens; identical to SEQ ID NO: 12664
  misc_feature 1..341: note = chr17:35078546-35078887
  misc_feature 1..341: note = hyper
  source 1..341: mol_type = genomic DNA

SEQ ID NO: 22467 - DNA, 52 bp, Homo sapiens
  misc_feature 1..52: note = chr17:35165593-35165645
  misc_feature 1..52: note = hyper
  source 1..52: mol_type = genomic DNA
cttcaattttatcagcggccggggagccgggcgggagataggaggccggccc

SEQ ID NO: 22468 - DNA, 30 bp, Homo sapiens; identical to SEQ ID NO: 12666
  misc_feature 1..30: note = chr17:35165897-35165927
  misc_feature 1..30: note = hyper
  source 1..30: mol_type = genomic DNA

SEQ ID NO: 22469 - DNA, 105 bp, Homo sapiens
  misc_feature 1..105: note = chr17:35285437-35285542
  misc_feature 1..105: note = hyper
  source 1..105: mol_type = genomic DNA
cctcccttcatccatcgcggaaggagcagcgggggggctggccctctcagccccgagagcagagagcggcagaagctgttaattcttgaggctaatgttcacatc

SEQ ID NO: 22470 - DNA, 129 bp, Homo sapiens
  misc_feature 1..129: note = chr17:35285666-35285795
  misc_feature 1..129: note = hyper
  source 1..129: mol_type = genomic DNA
ggagagctggtgggggtagaaggcggtgaggggccgaaaggctcctcaaacccagtttctttccatgctaaggctggggaaataacctcatggcaactacactttccgataacccgcctcattaatatt

SEQ ID NO: 22471 - DNA, 21 bp, Homo sapiens
  misc_feature 1..21: note = chr17:35290655-35290676
  misc_feature 1..21: note = hyper
  source 1..21: mol_type = genomic DNA
ctttcacggccttgtcactct

SEQ ID NO: 22472 - DNA, 307 bp, Homo sapiens
  misc_feature 1..307: note = chr17:35294154-35294461
  misc_feature 1..307: note = hyper
  source 1..307: mol_type = genomic DNA
accagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagaca

SEQ ID NO: 22473 - DNA, 542 bp, Homo sapiens
  misc_feature 1..542: note = chr17:35294505-35295047
  misc_feature 1..542: note = hyper
  source 1..542: mol_type = genomic DNA
gagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaag

SEQ ID NO: 22474 - DNA, 465 bp, Homo sapiens
  misc_feature 1..465: note = chr17:35295160-35295625
  misc_feature 1..465: note = hyper
  source 1..465: mol_type = genomic DNA
tcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctc

SEQ ID NO: 22475 - DNA, 30 bp, Homo sapiens; identical to SEQ ID NO: 12676
  misc_feature 1..30: note = chr17:35296016-35296046
  misc_feature 1..30: note = hyper
  source 1..30: mol_type = genomic DNA

SEQ ID NO: 22476 - DNA, 46 bp, Homo sapiens
  misc_feature 1..46: note = chr17:35296292-35296338
  misc_feature 1..46: note = hyper
  source 1..46: mol_type = genomic DNA
cttccctggctgccgaagttgtctggtggttcggcttcagccccag

SEQ ID NO: 22477 - DNA, 12 bp, Homo sapiens
  misc_feature 1..12: note = chr17:35296716-35296728
  misc_feature 1..12: note = hyper
  source 1..12: mol_type = genomic DNA
cgctgtccccag

SEQ ID NO: 22478 - DNA, 258 bp, Homo sapiens
  misc_feature 1..258: note = chr17:35296888-35297146
  misc_feature 1..258: note = hyper
  source 1..258: mol_type = genomic DNA
ccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 22479 - DNA, 90 bp, Homo sapiens; identical to SEQ ID NO: 4402
  misc_feature 1..90: note = chr17:35297147-35297237
  misc_feature 1..90: note = hyper
  source 1..90: mol_type = genomic DNA

SEQ ID NO: 22480 - DNA, 11 bp, Homo sapiens
  misc_feature 1..11: note = chr17:35298153-35298164
  misc_feature 1..11: note = hyper
  source 1..11: mol_type = genomic DNA
ggagaccggcc

SEQ ID NO: 22481 - DNA, 66 bp, Homo sapiens
  misc_feature 1..66: note = chr17:35299185-35299251
  misc_feature 1..66: note = hyper
  source 1..66: mol_type = genomic DNA
acagccccagagaagcggtaactgtgatagtgtgactgttagaaaaactccagctataccacaact

SEQ ID NO: 22482 - DNA, 15 bp, Homo sapiens
  misc_feature 1..15: note = chr17:35303325-35303340
  misc_feature 1..15: note = hyper
  source 1..15: mol_type = genomic DNA
acaacgtggttgtgg

SEQ ID NO: 22483 - DNA, 75 bp, Homo sapiens; identical to SEQ ID NO: 12687
  misc_feature 1..75: note = chr17:36102404-36102479
  misc_feature 1..75: note = hyper
  source 1..75: mol_type = genomic DNA

SEQ ID NO: 22484 - DNA, 280 bp, Homo sapiens; identical to SEQ ID NO: 12688
  misc_feature 1..280: note = chr17:36102707-36102987
  misc_feature 1..280: note = hyper
  source 1..280: mol_type = genomic DNA

SEQ ID NO: 22485 - DNA, 31 bp, Homo sapiens
  misc_feature 1..31: note = chr17:36103540-36103571
  misc_feature 1..31: note = hyper
  source 1..31: mol_type = genomic DNA
gccaaggctcagccccgaaatcgcggcgctt

SEQ ID NO: 22486 - skipped

SEQ ID NO: 22487 - DNA, 53 bp, Homo sapiens
  misc_feature 1..53: note = chr17:36104779-36104832
  misc_feature 1..53: note = hyper
  source 1..53: mol_type = genomic DNA
ctcctccaaggcctgaaccagcacctccttggtgaccccggagctcagcaggg

SEQ ID NO: 22488 - DNA, 86 bp, Homo sapiens
  misc_feature 1..86: note = chr17:36105137-36105223
  misc_feature 1..86: note = hyper
  source 1..86: mol_type = genomic DNA
ggggagggggaaacccggagagagggagagccggaggggcagacctggagagcagaagacctgggccgggagcggggctttgccag

SEQ ID NO: 22489 - DNA, 116 bp, Homo sapiens
  misc_feature 1..116: note = chr17:36105596-36105712
  misc_feature 1..116: note = hyper
  source 1..116: mol_type = genomic DNA
gcatgccctggagggactccatttatttctacctcggttactacctccaggccccagaacctccctggcctggtctggcggtttgggtttgcagaactgcccgccagagagcgtag

SEQ ID NO: 22490 - DNA, 247 bp, Homo sapiens
  misc_feature 1..247: note = chr17:37366090-37366337
  misc_feature 1..247: note = hyper
  source 1..247: mol_type = genomic DNA
cccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggctt

SEQ ID NO: 22491 - skipped

SEQ ID NO: 22492 - DNA, 267 bp, Homo sapiens
  misc_feature 1..267: note = chr17:37381850-37382117
  misc_feature 1..267: note = hyper
  source 1..267: mol_type = genomic DNA
gttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccg

SEQ ID NO: 22493 - DNA, 59 bp, Homo sapiens; identical to SEQ ID NO: 12702
  misc_feature 1..59: note = chr17:37752878-37752937
  misc_feature 1..59: note = hyper
  source 1..59: mol_type = genomic DNA

SEQ ID NO: 22494 - DNA, 144 bp, Homo sapiens; identical to SEQ ID NO: 12703
  misc_feature 1..144: note = chr17:37753194-37753338
  misc_feature 1..144: note = hyper
  source 1..144: mol_type = genomic DNA

SEQ ID NO: 22495 - DNA, 42 bp, Homo sapiens
  misc_feature 1..42: note = chr17:37760446-37760488
  misc_feature 1..42: note = hyper
  source 1..42: mol_type = genomic DNA
aggggacagaatggccgcggggaggaggagccggcgagctca

SEQ ID NO: 22496 - DNA, 30 bp, Homo sapiens; identical to SEQ ID NO: 12705
  misc_feature 1..30: note = chr17:37761235-37761265
  misc_feature 1..30: note = hyper
  source 1..30: mol_type = genomic DNA

SEQ ID NO: 22497 - DNA, 511 bp, Homo sapiens
  misc_feature 1..511: note = chr17:37761486-37761997
  misc_feature 1..511: note = hyper
  source 1..511: mol_type = genomic DNA
tggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgc

SEQ ID NO: 22498 - DNA, 446 bp, Homo sapiens
  misc_feature 1..446: note = chr17:37762334-37762780
  misc_feature 1..446: note = hyper
  source 1..446: mol_type = genomic DNA
agcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttc

SEQ ID NO: 22499 - DNA, 51 bp, Homo sapiens; identical to SEQ ID NO: 12707
  misc_feature 1..51: note = chr17:37856662-37856713
  misc_feature 1..51: note = hyper
  source 1..51: mol_type = genomic DNA

SEQ ID NO: 22500 - DNA, 42 bp, Homo sapiens; identical to SEQ ID NO: 12708
  misc_feature 1..42: note = chr17:38478791-38478833
  misc_feature 1..42: note = hyper
  source 1..42: mol_type = genomic DNA

SEQ ID NO: 22501 - DNA, 52 bp, Homo sapiens; identical to SEQ ID NO: 12709
  misc_feature 1..52: note = chr17:40332871-40332923
  misc_feature 1..52: note = hyper
  source 1..52: mol_type = genomic DNA

SEQ ID NO: 22502 - DNA, 88 bp, Homo sapiens
  misc_feature 1..88: note = chr17:40464190-40464278
  misc_feature 1..88: note = hyper
  source 1..88: mol_type = genomic DNA
aaaaagcaggggactcgaggtttggggaaatgatggagatgggcgcgggtgggcagaactctgacccaggcttctccttagcagctgc

SEQ ID NO: 22503 - DNA, 61 bp, Homo sapiens
  misc_feature 1..61: note = chr17:40464317-40464378
  misc_feature 1..61: note = hyper
  source 1..61: mol_type = genomic DNA
cgccaagatgcttctcaaccctcggggccaggggcagtcccagagccgcaacaaccgtccc

SEQ ID NO: 22504 - DNA, 49 bp, Homo sapiens; identical to SEQ ID NO: 12711
  misc_feature 1..49: note = chr17:40912947-40912996
  misc_feature 1..49: note = hyper
  source 1..49: mol_type = genomic DNA

SEQ ID NO: 22505 - DNA, 49 bp, Homo sapiens; identical to SEQ ID NO: 12712
  misc_feature 1..49: note = chr17:40932774-40932823
  misc_feature 1..49: note = hyper
  source 1..49: mol_type = genomic DNA

SEQ ID NO: 22506 - DNA, 59 bp, Homo sapiens; identical to SEQ ID NO: 12713
  misc_feature 1..59: note = chr17:40932843-40932902
  misc_feature 1..59: note = hyper
  source 1..59: mol_type = genomic DNA

SEQ ID NO: 22507 - DNA, 30 bp, Homo sapiens; identical to SEQ ID NO: 12714
  misc_feature 1..30: note = chr17:41984002-41984032
  misc_feature 1..30: note = hyper
  source 1..30: mol_type = genomic DNA

SEQ ID NO: 22508 - DNA, 70 bp, Homo sapiens; identical to SEQ ID NO: 12715
  misc_feature 1..70: note = chr17:41984440-41984510
  misc_feature 1..70: note = hyper
  source 1..70: mol_type = genomic DNA

SEQ ID NO: 22509 - DNA, 65 bp, Homo sapiens; identical to SEQ ID NO: 12718
  misc_feature 1..65: note = chr17:42061257-42061322
  misc_feature 1..65: note = hyper
  source 1..65: mol_type = genomic DNA

SEQ ID NO: 22510 - DNA, 130 bp, Homo sapiens; identical to SEQ ID NO: 12720
  misc_feature 1..130: note = chr17:42083143-42083273
  misc_feature 1..130: note = hyper
  source 1..130: mol_type = genomic DNA

SEQ ID NO: 22511 - DNA, 79 bp, Homo sapiens; identical to SEQ ID NO: 12721
  misc_feature 1..79: note = chr17:42083525-42083604
  misc_feature 1..79: note = hyper
  source 1..79: mol_type = genomic DNA

SEQ ID NO: 22512 - DNA, 30 bp, Homo sapiens; identical to SEQ ID NO: 12722
  misc_feature 1..30: note = chr17:42393545-42393575
  misc_feature 1..30: note = hyper
  source 1..30: mol_type = genomic DNA

SEQ ID NO: 22513 - DNA, 82 bp, Homo sapiens
  misc_feature 1..82: note = chr17:42394024-42394106
  misc_feature 1..82: note = hyper
  source 1..82: mol_type = genomic DNA
ccagtctgagctcggactcccagcgcctgggagagggcacgcgggacgaggagccctggggtcccatcggtgagctccccca

SEQ ID NO: 22514 - skipped

SEQ ID NO: 22515 - DNA, 155 bp, Homo sapiens
  misc_feature 1..155: note = chr17:42733556-42733711
  misc_feature 1..155: note = hyper
  source 1..155: mol_type = genomic DNA
cacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggagggg

SEQ ID NO: 22516 - DNA, 15 bp, Homo sapiens
  misc_feature 1..15: note = chr17:42733884-42733899
  misc_feature 1..15: note = hyper
  source 1..15: mol_type = genomic DNA
cggggtgcgggctga

SEQ ID NO: 22517 - DNA, 30 bp, Homo sapiens; identical to SEQ ID NO: 12726
  misc_feature 1..30: note = chr17:42906618-42906648
  misc_feature 1..30: note = hyper
  source 1..30: mol_type = genomic DNA

SEQ ID NO: 22518 - DNA, 123 bp, Homo sapiens; identical to SEQ ID NO: 12727
  misc_feature 1..123: note = chr17:42907014-42907137
  misc_feature 1..123: note = hyper
  source 1..123: mol_type = genomic DNA

SEQ ID NO: 22519 - DNA, 200 bp, Homo sapiens
  misc_feature 1..200: note = chr17:42907951-42908151
  misc_feature 1..200: note = hyper
  source 1..200: mol_type = genomic DNA
agccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 22520 - DNA, 80 bp, Homo sapiens; identical to SEQ ID NO: 12729
  misc_feature 1..80: note = chr17:42988684-42988764
  misc_feature 1..80: note = hyper
  source 1..80: mol_type = genomic DNA

SEQ ID NO: 22521 - DNA, 150 bp, Homo sapiens
  misc_feature 1..150: note = chr17:43045116-43045266
  misc_feature 1..150: note = hyper
  source 1..150: mol_type = genomic DNA
acccttctcccccggcggccccacagggccgggaggacctgggtccccgggaggccccggagggccgggcttgccggtgcggcccggcttcccctgggggccctgcaccagcgtggaaggcgggggcgcgccgctctgctcgctcagggc

SEQ ID NO: 22522 - DNA, 133 bp, Homo sapiens; identical to SEQ ID NO: 12731
  misc_feature 1..133: note = chr17:43045371-43045504
  misc_feature 1..133: note = hyper
  source 1..133: mol_type = genomic DNA

SEQ ID NO: 22523 - DNA, 96 bp, Homo sapiens; identical to SEQ ID NO: 1294
  misc_feature 1..96: note = chr17:43047752-43047848
  misc_feature 1..96: note = hyper
  source 1..96: mol_type = genomic DNA

SEQ ID NO: 22524 - DNA, 25 bp, Homo sapiens
  misc_feature 1..25: note = chr17:43974231-43974256
  misc_feature 1..25: note = hyper
  source 1..25: mol_type = genomic DNA
gtgatgaacctggtacgcacggttt

SEQ ID NO: 22525 - DNA, 56 bp, Homo sapiens; identical to SEQ ID NO: 12736
  misc_feature 1..56: note = chr17:44919159-44919215
  misc_feature 1..56: note = hyper
  source 1..56: mol_type = genomic DNA

SEQ ID NO: 22526 - DNA, 35 bp, Homo sapiens; identical to SEQ ID NO: 12737
  misc_feature 1..35: note = chr17:44928630-44928665
  misc_feature 1..35: note = hyper
  source 1..35: mol_type = genomic DNA

SEQ ID NO: 22527 - DNA, 30 bp, Homo sapiens; identical to SEQ ID NO: 12738
  misc_feature 1..30: note = chr17:44929262-44929292
  misc_feature 1..30: note = hyper
  source 1..30: mol_type = genomic DNA

SEQ ID NO: 22528 - DNA, 100 bp, Homo sapiens; identical to SEQ ID NO: 12739
  misc_feature 1..100: note = chr17:44929573-44929673
  misc_feature 1..100: note = hyper
  source 1..100: mol_type = genomic DNA

SEQ ID NO: 22529 - DNA, 34 bp, Homo sapiens; identical to SEQ ID NO: 12740
  misc_feature 1..34: note = chr17:45055871-45055905
  misc_feature 1..34: note = hyper
  source 1..34: mol_type = genomic DNA

SEQ ID NO: 22530 - DNA, 49 bp, Homo sapiens; identical to SEQ ID NO: 12741
  misc_feature 1..49: note = chr17:45056144-45056193
  misc_feature 1..49: note = hyper
  source 1..49: mol_type = genomic DNA

SEQ ID NO: 22531 - DNA, 78 bp, Homo sapiens
  misc_feature 1..78: note = chr17:45810772-45810850
  misc_feature 1..78: note = hyper
  source 1..78: mol_type = genomic DNA
ggaggggcgggtcctcgacggctacgggaaggtgccagcccgccccggatgggcatcgtggagccgggttgcggagac

SEQ ID NO: 22532 - DNA, 114 bp, Homo sapiens; identical to SEQ ID NO: 12743
  misc_feature 1..114: note = chr17:45867029-45867143
  misc_feature 1..114: note = hyper
  source 1..114: mol_type = genomic DNA

SEQ ID NO: 22533 - DNA, 24 bp, Homo sapiens
  misc_feature 1..24: note = chr17:45867460-45867484
  misc_feature 1..24: note = hyper
  source 1..24: mol_type = genomic DNA
ctcaaagaccgccagctctggggg

SEQ ID NO: 22534 - DNA, 259 bp, Homo sapiens
  misc_feature 1..259: note = chr17:46621094-46621353
  misc_feature 1..259: note = hyper
  source 1..259: mol_type = genomic DNA
gcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggag

SEQ ID NO: 22535 - DNA, 102 bp, Homo sapiens
  misc_feature 1..102: note = chr17:46621909-46622011
  misc_feature 1..102: note = hyper
  source 1..102: mol_type = genomic DNA
gaacggcggaggcggccggagaaggagacgtggcggattggctgggtttcttggcggatttcttctctttcatccaagggaactcgggggccgggggggcag

SEQ ID NO: 22536 - DNA, 78 bp, Homo sapiens
  misc_feature 1..78: note = chr17:46655070-46655148
  misc_feature 1..78: note = hyper
  source 1..78: mol_type = genomic DNA
ctgaaaacaggcgaccgtaaatctccggcaatggcgagtttatagcggggacaattggcttccccagctcaacccccc

SEQ ID NO: 22537 - DNA, 216 bp, Homo sapiens
  misc_feature 1..216: note = chr17:46655178-46655394
  misc_feature 1..216: note = hyper
  source 1..216: mol_type = genomic DNA
gtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggc

SEQ ID NO: 22538 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 22539 - DNA, 50 bp, Homo sapiens
  misc_feature 1..50: note = chr17:46659859-46659909
  misc_feature 1..50: note = hyper
  source 1..50: mol_type = genomic DNA
ctttggcagtctttgttaaacagctaggcgcgtcacgaggctctcaaaca

SEQ ID NO: 22540 - DNA, 75 bp, Homo sapiens; identical to SEQ ID NO: 12753
  misc_feature 1..75: note = chr17:46663552-46663627
  misc_feature 1..75: note = hyper
  source 1..75: mol_type = genomic DNA

SEQ ID NO: 22541 - DNA, 198 bp, Homo sapiens; identical to SEQ ID NO: 12754
  misc_feature 1..198: note = chr17:46670978-46671176
  misc_feature 1..198: note = hyper
  source 1..198: mol_type = genomic DNA

SEQ ID NO: 22542 - DNA, 45 bp, Homo sapiens; identical to SEQ ID NO: 12755
  misc_feature 1..45: note = chr17:46671384-46671429
  misc_feature 1..45: note = hyper
  source 1..45: mol_type = genomic DNA

SEQ ID NO: 22543 - DNA, 297 bp, Homo sapiens; identical to SEQ ID NO: 12758
  misc_feature 1..297: note = chr17:46687941-46688238
  misc_feature 1..297: note = hyper
  source 1..297: mol_type = genomic DNA

SEQ ID NO: 22544 - DNA, 40 bp, Homo sapiens; identical to SEQ ID NO: 12759
  misc_feature 1..40: note = chr17:46688577-46688617
  misc_feature 1..40: note = hyper
  source 1..40: mol_type = genomic DNA

SEQ ID NO: 22545 - DNA, 225 bp, Homo sapiens; identical to SEQ ID NO: 12760
  misc_feature 1..225: note = chr17:46689986-46690211
  misc_feature 1..225: note = hyper
  source 1..225: mol_type = genomic DNA

SEQ ID NO: 22546 - DNA, 41 bp, Homo sapiens
  misc_feature 1..41: note = chr17:46690664-46690705
  misc_feature 1..41: note = hyper
  source 1..41: mol_type = genomic DNA
ggaacttgtctttgttgttctcttttttccacttcatcctc

SEQ ID NO: 22547 - DNA, 28 bp, Homo sapiens
  misc_feature 1..28: note = chr17:46690852-46690880
  misc_feature 1..28: note = hyper
  source 1..28: mol_type = genomic DNA
cgcctgcgtccggcggctgctgggaatg

SEQ ID NO: 22548 - DNA, 255 bp, Homo sapiens
  misc_feature 1..255: note = chr17:46692110-46692365
  misc_feature 1..255: note = hyper
  source 1..255: mol_type = genomic DNA
ggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccacc

SEQ ID NO: 22549 - DNA, 58 bp, Homo sapiens
  misc_feature 1..58: note = chr17:46714072-46714130
  misc_feature 1..58: note = hyper
  source 1..58: mol_type = genomic DNA
gttcctgcaggcgctcggggctcggcctggagctggcggccggcacgtcgcctttggc

SEQ ID NO: 22550 - DNA, 154 bp, Homo sapiens; identical to SEQ ID NO: 12768
  misc_feature 1..154: note = chr17:46714131-46714285
  misc_feature 1..154: note = hyper
  source 1..154: mol_type = genomic DNA

SEQ ID NO: 22551 - DNA, 205 bp, Homo sapiens
  misc_feature 1..205: note = chr17:46795436-46795641
  misc_feature 1..205: note = hyper
  source 1..205: mol_type = genomic DNA
ctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagca

SEQ ID NO: 22552 - DNA, 147 bp, Homo sapiens
  misc_feature 1..147: note = chr17:46797582-46797729
  misc_feature 1..147: note = hyper
  source 1..147: mol_type = genomic DNA
tgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 22553 - DNA, 32 bp, Homo sapiens; identical to SEQ ID NO: 12775
  misc_feature 1..32: note = chr17:46799421-46799453
  misc_feature 1..32: note = hyper
  source 1..32: mol_type = genomic DNA

SEQ ID NO: 22554 - DNA, 83 bp, Homo sapiens
  misc_feature 1..83: note = chr17:46800518-46800601
  misc_feature 1..83: note = hyper
  source 1..83: mol_type = genomic DNA
tttgggctagaggcccggggccgctcccgagctttctcccctcttccctggagagcgactgttcgggagggtgagaatggtat

SEQ ID NO: 22555 - DNA, 47 bp, Homo sapiens
  misc_feature 1..47: note = chr17:46800668-46800715
  misc_feature 1..47: note = hyper
  source 1..47: mol_type = genomic DNA
gtttacggtaacgagttcatctatttaattcgcggttgcagctcggg

SEQ ID NO: 22556 - DNA, 153 bp, Homo sapiens
  misc_feature 1..153: note = chr17:46802306-46802459
  misc_feature 1..153: note = hyper
  source 1..153: mol_type = genomic DNA
tccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcag

SEQ ID NO: 22557 - DNA, 315 bp, Homo sapiens; identical to SEQ ID NO: 12783
  misc_feature 1..315: note = chr17:46805609-46805924
  misc_feature 1..315: note = hyper
  source 1..315: mol_type = genomic DNA

SEQ ID NO: 22558 - DNA, 48 bp, Homo sapiens
  misc_feature 1..48: note = chr17:46810368-46810416
  misc_feature 1..48: note = hyper
  source 1..48: mol_type = genomic DNA
tcctggcagaccctccgggagcccggagcctcccccagctttctttac

SEQ ID NO: 22559 - DNA, 138 bp, Homo sapiens
  misc_feature 1..138: note = chr17:46810958-46811096
  misc_feature 1..138: note = hyper
  source 1..138: mol_type = genomic DNA
ggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 22560 - DNA, 53 bp, Homo sapiens; identical to SEQ ID NO: 12786
  misc_feature 1..53: note = chr17:46815930-46815983
  misc_feature 1..53: note = hyper
  source 1..53: mol_type = genomic DNA

SEQ ID NO: 22561 - DNA, 230 bp, Homo sapiens
  misc_feature 1..230: note = chr17:46825054-46825284
  misc_feature 1..230: note = hyper
  source 1..230: mol_type = genomic DNA
ggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcc

SEQ ID NO: 22562 - DNA, 26 bp, Homo sapiens
  misc_feature 1..26: note = chr17:46830110-46830136
  misc_feature 1..26: note = hyper
  source 1..26: mol_type = genomic DNA
cccagggccccctccgggttctccca

SEQ ID NO: 22563 - DNA, 100 bp, Homo sapiens
  misc_feature 1..100: note = chr17:47072705-47072805
  misc_feature 1..100: note = hyper
  source 1..100: mol_type = genomic DNA
ctgggtagaacaaaacgctcattggggagggtgggctctaaggtggtggaggatatagagaaaccgagttggaagccctcccccgcccctaagtcccagc

SEQ ID NO: 22564 - DNA, 71 bp, Homo sapiens
  misc_feature 1..71: note = chr17:47073465-47073536
  misc_feature 1..71: note = hyper
  source 1..71: mol_type = genomic DNA
cgggtccttccctcgggctccgggagccggaggatccggaatgagttggtcaaagccgagggaagggaccc

SEQ ID NO: 22565 - DNA, 181 bp, Homo sapiens
  misc_feature 1..181: note = chr17:47074228-47074409
  misc_feature 1..181: note = hyper
  source 1..181: mol_type = genomic DNA
gaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 22566 - DNA, 54 bp, Homo sapiens
  misc_feature 1..54: note = chr17:47074895-47074949
  misc_feature 1..54: note = hyper
  source 1..54: mol_type = genomic DNA
tctcctgggctctccccgaactctcccgcgacctctgcgcgccctcaggccgcc

SEQ ID NO: 22567 - DNA, 38 bp, Homo sapiens
  misc_feature 1..38: note = chr17:47075364-47075402
  misc_feature 1..38: note = hyper
  source 1..38: mol_type = genomic DNA
caactcctctcttcccgggcctgcggggtttggcctcc

SEQ ID NO: 22568 - DNA, 15 bp, Homo sapiens
  misc_feature 1..15: note = chr17:47075700-47075715
  misc_feature 1..15: note = hyper
  source 1..15: mol_type = genomic DNA
ttaggcctttccagg

SEQ ID NO: 22569 - DNA, 68 bp, Homo sapiens; identical to SEQ ID NO: 12804
  misc_feature 1..68: note = chr17:47081200-47081268
  misc_feature 1..68: note = hyper
  source 1..68: mol_type = genomic DNA

SEQ ID NO: 22570 - DNA, 184 bp, Homo sapiens; identical to SEQ ID NO: 12805
  misc_feature 1..184: note = chr17:47210040-47210224
  misc_feature 1..184: note = hyper
  source 1..184: mol_type = genomic DNA

SEQ ID NO: 22571 - DNA, 292 bp, Homo sapiens; identical to SEQ ID NO: 12806
  misc_feature 1..292: note = chr17:47573694-47573986
  misc_feature 1..292: note = hyper
  source 1..292: mol_type = genomic DNA

SEQ ID NO: 22572 - DNA, 985 bp, Homo sapiens; identical to SEQ ID NO: 12807
  misc_feature 1..985: note = chr17:47574269-47575254
  misc_feature 1..985: note = hyper
  source 1..985: mol_type = genomic DNA

SEQ ID NO: 22573 - DNA, 116 bp, Homo sapiens; identical to SEQ ID NO: 12808
  misc_feature 1..116: note = chr17:47928213-47928329
  misc_feature 1..116: note = hyper
  source 1..116: mol_type = genomic DNA

SEQ ID NO: 22574 - DNA, 311 bp, Homo sapiens
  misc_feature 1..311: note = chr17:47987619-47987930
  misc_feature 1..311: note = hyper
  source 1..311: mol_type = genomic DNA
aggaggcagggccaggctgggcgctgaggaggccgccccggtggcgctcccacgacccgggcaaggcagtctgggcgccgtctccggtctcggggcctgcggtcggggcaccgcggtgccgcgtttgagccggtcagctccctgcggaaattacaggggcgctcggcgctgcggtcgcgccccccggggcagcgcccgctggttggaggcgtttaaattgaaagcagctttggggagagggggcggacgcgggccgccgagcaaggggagggggcggcccggcacagcgaccccattgtctgtgcccgccg

SEQ ID NO: 22575 - DNA, 72 bp, Homo sapiens
  misc_feature 1..72: note = chr17:48042069-48042141
  misc_feature 1..72: note = hyper
  source 1..72: mol_type = genomic DNA
tgaggtgagcgcaaatggaagcacaaggccgggctggccgtgggctcagtaaccagtcggctgcccggcttg

SEQ ID NO: 22576 - DNA, 26 bp, Homo sapiens
  misc_feature 1..26: note = chr17:48042409-48042435
  misc_feature 1..26: note = hyper
  source 1..26: mol_type = genomic DNA
aactgaaaatcactgcgaatgacaat

SEQ ID NO: 22577 - DNA, 188 bp, Homo sapiens
  misc_feature 1..188: note = chr17:48049059-48049247
  misc_feature 1..188: note = hyper
  source 1..188: mol_type = genomic DNA
ctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgacc

SEQ ID NO: 22578 - DNA, 222 bp, Homo sapiens; identical to SEQ ID NO: 12817
  misc_feature 1..222: note = chr17:48070683-48070905
  misc_feature 1..222: note = hyper
  source 1..222: mol_type = genomic DNA

SEQ ID NO: 22579 - DNA, 34 bp, Homo sapiens; identical to SEQ ID NO: 12819
  misc_feature 1..34: note = chr17:48619216-48619250
  misc_feature 1..34: note = hyper
  source 1..34: mol_type = genomic DNA

SEQ ID NO: 22580 - DNA, 99 bp, Homo sapiens
  misc_feature 1..99: note = chr17:48637136-48637235
  misc_feature 1..99: note = hyper
  source 1..99: mol_type = genomic DNA
ttccttcttaggggtcctcgctctgctccgcagcccctcctggggatccgggctctgcggtccagcgcgacctgcctggggccacgtgttcaagcacga

SEQ ID NO: 22581 - DNA, 97 bp, Homo sapiens
  misc_feature 1..97: note = chr17:50235952-50236049
  misc_feature 1..97: note = hyper
  source 1..97: mol_type = genomic DNA
gactctccaggtcgcgcgcgcccttcctgctcctctgctattttcctgaactccccagaacccccagttgcctggcttccatcgcccgcaactagcg

SEQ ID NO: 22582 - DNA, 25 bp, Homo sapiens
  misc_feature 1..25: note = chr17:53341227-53341252
  misc_feature 1..25: note = hyper
  source 1..25: mol_type = genomic DNA
cgtcccactgaaaaacggttttctt

SEQ ID NO: 22583 - DNA, 37 bp, Homo sapiens; identical to SEQ ID NO: 12824
  misc_feature 1..37: note = chr17:53343353-53343390
  misc_feature 1..37: note = hyper
  source 1..37: mol_type = genomic DNA

SEQ ID NO: 22584 - DNA, 204 bp, Homo sapiens
  misc_feature 1..204: note = chr17:53922790-53922994
  misc_feature 1..204: note = hyper
  source 1..204: mol_type = genomic DNA
cccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcgg

SEQ ID NO: 22585 - DNA, 30 bp, Homo sapiens; identical to SEQ ID NO: 12826
  misc_feature 1..30: note = chr17:54674012-54674042
  misc_feature 1..30: note = hyper
  source 1..30: mol_type = genomic DNA

SEQ ID NO: 22586 - skipped

SEQ ID NO: 22587 - DNA, 20 bp, Homo sapiens
  misc_feature 1..20: note = chr17:56326929-56326949
  misc_feature 1..20: note = hyper
  source 1..20: mol_type = genomic DNA
gaagcctgcgctgggcgccg

SEQ ID NO: 22588 - DNA, 181 bp, Homo sapiens
  misc_feature 1..181: note = chr17:56832946-56833127
  misc_feature 1..181: note = hyper
  source 1..181: mol_type = genomic DNA
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaa

SEQ ID NO: 22589 - DNA, 188 bp, Homo sapiens
  misc_feature 1..188: note = chr17:56833221-56833409
  misc_feature 1..188: note = hyper
  source 1..188: mol_type = genomic DNA
ggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagcta

SEQ ID NO: 22590 - DNA, 425 bp, Homo sapiens; identical to SEQ ID NO: 12832
  misc_feature 1..425: note = chr17:58212827-58213252
  misc_feature 1..425: note = hyper
  source 1..425: mol_type = genomic DNA

SEQ ID NO: 22591 - DNA, 23 bp, Homo sapiens
  misc_feature 1..23: note = chr17:58216590-58216613
  misc_feature 1..23: note = hyper
  source 1..23: mol_type = genomic DNA
gcagaaccctggattcgagtccc

SEQ ID NO: 22592 - DNA, 54 bp, Homo sapiens
  misc_feature 1..54: note = chr17:58217551-58217605
  misc_feature 1..54: note = hyper
  source 1..54: mol_type = genomic DNA
tgttcagtcccaggcagtgcgggacaggtgggcgaagctcgaaccccatgctct

SEQ ID NO: 22593 - DNA, 91 bp, Homo sapiens
  misc_feature 1..91: note = chr17:58218674-58218765
  misc_feature 1..91: note = hyper
  source 1..91: mol_type = genomic DNA
cgcgctcgggctggacgtcgcgctcagcgcgcagggcccccatggacgtcgcgccgctgacctagctgtcagacatcgccacgaggagttg

SEQ ID NO: 22594 - DNA, 64 bp, Homo sapiens
  misc_feature 1..64: note = chr17:58218993-58219057
  misc_feature 1..64: note = hyper
  source 1..64: mol_type = genomic DNA
actggccctgctctggggaacagcgccctgcttctttgtgcgacgatcacgcttgactcattgg

SEQ ID NO: 22595 - DNA, 270 bp, Homo sapiens
  misc_feature 1..270: note = chr17:58227104-58227374
  misc_feature 1..270: note = hyper
  source 1..270: mol_type = genomic DNA
gctgagtggagaggacgcggagtgggtgagggggccttgcgcacagggcaagaggtggccaggcagggcgggggaccggggagagcggaggatttcagatgagggacaggggaaggtggagaggggagggcaggccccgccagggggaggagccgcctcccgcgtccagctgtcggggctccctcccgtcgcggctccgctataaaacccaggccggcaggatcgctgcacccgcggcggcctcctcggtgcgcgacccccggctcagag

SEQ ID NO: 22596 - DNA, 19 bp, Homo sapiens
  misc_feature 1..19: note = chr17:58499314-58499333
  misc_feature 1..19: note = hyper
  source 1..19: mol_type = genomic DNA
agcccgtaggcactggcgg

SEQ ID NO: 22597 - DNA, 30 bp, Homo sapiens; identical to SEQ ID NO: 12840
  misc_feature 1..30: note = chr17:59467481-59467511
  misc_feature 1..30: note = hyper
  source 1..30: mol_type = genomic DNA

SEQ ID NO: 22598 - DNA, 92 bp, Homo sapiens
  misc_feature 1..92: note = chr17:59474741-59474833
  misc_feature 1..92: note = hyper
  source 1..92: mol_type = genomic DNA
cgccaggggagggggttcctgggaagggggagggggccggcctaggtgggggaggggcccagcggaggcctcacggcgccgctccagggcct

SEQ ID NO: 22599 - DNA, 44 bp, Homo sapiens
  misc_feature 1..44: note = chr17:59475100-59475144
  misc_feature 1..44: note = hyper
  source 1..44: mol_type = genomic DNA
ggcctgagtgtttcaaactcttcaggcctcggacccctggacca

SEQ ID NO: 22600 - DNA, 156 bp, Homo sapiens
  misc_feature 1..156: note = chr17:59476254-59476410
  misc_feature 1..156: note = hyper
  source 1..156: mol_type = genomic DNA
gcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccg

SEQ ID NO: 22601 - DNA, 30 bp, Homo sapiens
  misc_feature 1..30: note = chr17:59476635-59476665
  misc_feature 1..30: note = hyper
  source 1..30: mol_type = genomic DNA
gccgcccgagcctcccgactcgcccgccca

SEQ ID NO: 22602 - DNA, 30 bp, Homo sapiens; identical to SEQ ID NO: 12845
  misc_feature 1..30: note = chr17:59476876-59476906
  misc_feature 1..30: note = hyper
  source 1..30: mol_type = genomic DNA

SEQ ID NO: 22603 - DNA, 32 bp, Homo sapiens; identical to SEQ ID NO: 12846
  misc_feature 1..32: note = chr17:59477323-59477355
  misc_feature 1..32: note = hyper
  source 1..32: mol_type = genomic DNA

SEQ ID NO: 22604 - DNA, 14 bp, Homo sapiens
  misc_feature 1..14: note = chr17:59478133-59478147
  misc_feature 1..14: note = hyper
  source 1..14: mol_type = genomic DNA
aacgctaaaatcct

SEQ ID NO: 22605 - DNA, 195 bp, Homo sapiens
  misc_feature 1..195: note = chr17:59534556-59534751
  misc_feature 1..195: note = hyper
  source 1..195: mol_type = genomic DNA
cgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaa

SEQ ID NO: 22606 - DNA, 48 bp, Homo sapiens
  misc_feature 1..48: note = chr17:59535219-59535267
  misc_feature 1..48: note = hyper
  source 1..48: mol_type = genomic DNA
cgctatgcaaatgaatccaaacagggatcgcgacgctcaaaagtccca

SEQ ID NO: 22607 - DNA, 21 bp, Homo sapiens
  misc_feature 1..21: note = chr17:59539215-59539236
  misc_feature 1..21: note = hyper
  source 1..21: mol_type = genomic DNA
gtccccagggacctccgagaa

SEQ ID NO: 22608 - DNA, 76 bp, Homo sapiens
  misc_feature 1..76: note = chr17:59539601-59539677
  misc_feature 1..76: note = hyper
  source 1..76: mol_type = genomic DNA
cctgtttcatgatcagaggagaagccccgggctttcatctcctcccgggccggcgagcaggcggcttgtttattcc

SEQ ID NO: 22609 - DNA, 153 bp, Homo sapiens; identical to SEQ ID NO: 12859
  misc_feature 1..153: note = chr17:60705777-60705930
  misc_feature 1..153: note = hyper
  source 1..153: mol_type = genomic DNA

SEQ ID NO: 22610 - DNA, 21 bp, Homo sapiens
  misc_feature 1..21: note = chr17:61778053-61778074
  misc_feature 1..21: note = hyper
  source 1..21: mol_type = genomic DNA
cccgccgccaggggccgcccc

SEQ ID NO: 22611 - DNA, 129 bp, Homo sapiens; identical to SEQ ID NO: 12864
  misc_feature 1..129: note = chr17:62777021-62777150
  misc_feature 1..129: note = hyper
  source 1..129: mol_type = genomic DNA

SEQ ID NO: 22612 - DNA, 45 bp, Homo sapiens; identical to SEQ ID NO: 12865
  misc_feature 1..45: note = chr17:64961987-64962032
  misc_feature 1..45: note = hyper
  source 1..45: mol_type = genomic DNA

SEQ ID NO: 22613 - DNA, 169 bp, Homo sapiens
  misc_feature 1..169: note = chr17:66596302-66596471
  misc_feature 1..169: note = hyper
  source 1..169: mol_type = genomic DNA
gctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctc

SEQ ID NO: 22614 - DNA, 165 bp, Homo sapiens; identical to SEQ ID NO: 12867
  misc_feature 1..165: note = chr17:66596728-66596893
  misc_feature 1..165: note = hyper
  source 1..165: mol_type = genomic DNA

SEQ ID NO: 22615 - DNA, 30 bp, Homo sapiens; identical to SEQ ID NO: 12868
  misc_feature 1..30: note = chr17:66597456-66597486
  misc_feature 1..30: note = hyper
  source 1..30: mol_type = genomic DNA

SEQ ID NO: 22616 - DNA, 74 bp, Homo sapiens
  misc_feature 1..74: note = chr17:70112842-70112916
  misc_feature 1..74: note = hyper
  source 1..74: mol_type = genomic DNA
tgagttgagggaagccgcatgacgcgcggctccccggtgccacagctaaggacagatattttcgcaaaacccag

SEQ ID NO: 22617 - DNA, 16 bp, Homo sapiens
  misc_feature 1..16: note = chr17:70215667-70215683
  misc_feature 1..16: note = hyper
  source 1..16: mol_type = genomic DNA
ccagggcagcagacac

SEQ ID NO: 22618 - DNA, 136 bp, Homo sapiens; identical to SEQ ID NO: 12875
  misc_feature 1..136: note = chr17:71161797-71161933
  misc_feature 1..136: note = hyper
  source 1..136: mol_type = genomic DNA

SEQ ID NO: 22619 - DNA, 41 bp, Homo sapiens; identical to SEQ ID NO: 12876
  misc_feature 1..41: note = chr17:71641056-71641097
  misc_feature 1..41: note = hyper
  source 1..41: mol_type = genomic DNA

SEQ ID NO: 22620 - DNA, 47 bp, Homo sapiens
  misc_feature 1..47: note = chr17:71641497-71641544
  misc_feature 1..47: note = hyper
  source 1..47: mol_type = genomic DNA
agccaggcccgggagcgagccccgcagaaatacaatccgactgcgcg

SEQ ID NO: 22621 - DNA, 57 bp, Homo sapiens; identical to SEQ ID NO: 12878
  misc_feature 1..57: note = chr17:71897984-71898041
  misc_feature 1..57: note = hyper
  source 1..57: mol_type = genomic DNA

SEQ ID NO: 22622 - DNA, 49 bp, Homo sapiens
  misc_feature 1..49: note = chr17:71948390-71948439
  misc_feature 1..49: note = hyper
  source 1..49: mol_type = genomic DNA
actccattcatctcccggttcctcgcattcatcccccaccgaacccacc

SEQ ID NO: 22623 - DNA, 52 bp, Homo sapiens
  misc_feature 1..52: note = chr17:71948863-71948915
  misc_feature 1..52: note = hyper
  source 1..52: mol_type = genomic DNA
ggcgctccccgcccgccaacctccaacctccaacctccgccctccaccctcc

SEQ ID NO: 22624 - DNA, 62 bp, Homo sapiens; identical to SEQ ID NO: 12880
  misc_feature 1..62: note = chr17:71949206-71949268
  misc_feature 1..62: note = hyper
  source 1..62: mol_type = genomic DNA

SEQ ID NO: 22625 - DNA, 30 bp, Homo sapiens; identical to SEQ ID NO: 12881
  misc_feature 1..30: note = chr17:72208638-72208668
  misc_feature 1..30: note = hyper
  source 1..30: mol_type = genomic DNA

SEQ ID NO: 22626 - DNA, 32 bp, Homo sapiens
  misc_feature 1..32: note = chr17:72270415-72270447
  misc_feature 1..32: note = hyper
  source 1..32: mol_type = genomic DNA
agcaccggagccgcgaccgtggattgaacgct

SEQ ID NO: 22627 - DNA, 15 bp, Homo sapiens
  misc_feature 1..15: note = chr17:72322348-72322363
  misc_feature 1..15: note = hyper
  source 1..15: mol_type = genomic DNA
gcgcgttgttggttt

SEQ ID NO: 22628 - DNA, 15 bp, Homo sapiens
  misc_feature 1..15: note = chr17:72322611-72322626
  misc_feature 1..15: note = hyper
  source 1..15: mol_type = genomic DNA
cgccaccccactgag

SEQ ID NO: 22629 - DNA, 97 bp, Homo sapiens
  misc_feature 1..97: note = chr17:72856941-72857038
  misc_feature 1..97: note = hyper
  source 1..97: mol_type = genomic DNA
tggaaggggaagaagcgggactcgcggcgggggaaggggtctgggcgccgaggcgagtgcgcagcaggtgcccagcagacctagggaaactggggca

SEQ ID NO: 22630 - DNA, 127 bp, Homo sapiens; identical to SEQ ID NO: 12886
  misc_feature 1..127: note = chr17:72889569-72889696
  misc_feature 1..127: note = hyper
  source 1..127: mol_type = genomic DNA

SEQ ID NO: 22631 - DNA, 19 bp, Homo sapiens
  misc_feature 1..19: note = chr17:72921032-72921051
  misc_feature 1..19: note = hyper
  source 1..19: mol_type = genomic DNA
gctccgaggtgccagggga

SEQ ID NO: 22632 - DNA, 59 bp, Homo sapiens; identical to SEQ ID NO: 12888
  misc_feature 1..59: note = chr17:72932027-72932086
  misc_feature 1..59: note = hyper
  source 1..59: mol_type = genomic DNA

SEQ ID NO: 22633 - DNA, 173 bp, Homo sapiens; identical to SEQ ID NO: 12889
  misc_feature 1..173: note = chr17:72932356-72932529
  misc_feature 1..173: note = hyper
  source 1..173: mol_type = genomic DNA

SEQ ID NO: 22634 - DNA, 87 bp, Homo sapiens; identical to SEQ ID NO: 12890
  misc_feature 1..87: note = chr17:73073597-73073684
  misc_feature 1..87: note = hyper
  source 1..87: mol_type = genomic DNA

SEQ ID NO: 22635 - DNA, 66 bp, Homo sapiens; identical to SEQ ID NO: 12892
  misc_feature 1..66: note = chr17:74072483-74072549
  misc_feature 1..66: note = hyper
  source 1..66: mol_type = genomic DNA

SEQ ID NO: 22636 - DNA, 23 bp, Homo sapiens
  misc_feature 1..23: note = chr17:74073246-74073269
  misc_feature 1..23: note = hyper
  source 1..23: mol_type = genomic DNA
gcaaaggcttccgcacgatctgc

SEQ ID NO: 22637 - DNA, 63 bp, Homo sapiens; identical to SEQ ID NO: 12895
  misc_feature 1..63: note = chr17:74136379-74136442
  misc_feature 1..63: note = hyper
  source 1..63: mol_type = genomic DNA

SEQ ID NO: 22638 - DNA, 130 bp, Homo sapiens; identical to SEQ ID NO: 12896
  misc_feature 1..130: note = chr17:74136570-74136700
  misc_feature 1..130: note = hyper
  source 1..130: mol_type = genomic DNA

SEQ ID NO: 22639 - DNA, 53 bp, Homo sapiens
  misc_feature 1..53: note = chr17:74534310-74534363
  misc_feature 1..53: note = hyper
  source 1..53: mol_type = genomic DNA
gctcccctcgcccgggcctctccccgcgcccccgagccagccgctgggggccg

SEQ ID NO: 22640 - DNA, 15 bp, Homo sapiens
  misc_feature 1..15: note = chr17:74534387-74534402
  misc_feature 1..15: note = hyper
  source 1..15: mol_type = genomic DNA
cgcccaggctctggg

SEQ ID NO: 22641 - DNA, 80 bp, Homo sapiens
  misc_feature 1..80: note = chr17:74581221-74581301
  misc_feature 1..80: note = hyper
  source 1..80: mol_type = genomic DNA
tatccagacacggcgagcggaagccggggagaagggagcgggcgcggggcggacagagaccgcagcgggcgggaaaggcg

SEQ ID NO: 22642 - DNA, 293 bp, Homo sapiens; identical to SEQ ID NO: 12900
  misc_feature 1..293: note = chr17:74864739-74865032
  misc_feature 1..293: note = hyper
  source 1..293: mol_type = genomic DNA

SEQ ID NO: 22643 - DNA, 107 bp, Homo sapiens
  misc_feature 1..107: note = chr17:74865591-74865698
  misc_feature 1..107: note = hyper
  source 1..107: mol_type = genomic DNA
ccctcccgtcccgcccgtctgcccctaggtcggctaccccccaacccctccgcctgtgccaccctctccccagcctttggtggcactgctctcctccccgcggggct

SEQ ID NO: 22644 - DNA, 76 bp, Homo sapiens
  misc_feature 1..76: note = chr17:76227773-76227849
  misc_feature 1..76: note = hyper
  source 1..76: mol_type = genomic DNA
agggaaattaaggaacgtgcccagggacccggggccagcccgtggggacgctgggattggagcccaagccccaggt

SEQ ID NO: 22645 - DNA, 18 bp, Homo sapiens
  misc_feature 1..18: note = chr17:76254836-76254854
  misc_feature 1..18: note = hyper
  source 1..18: mol_type = genomic DNA
cgccggggaggctgctgc

SEQ ID NO: 22646 - DNA, 102 bp, Homo sapiens; identical to SEQ ID NO: 4505
  misc_feature 1..102: note = chr17:77178962-77179064
  misc_feature 1..102: note = hyper
  source 1..102: mol_type = genomic DNA

SEQ ID NO: 22647 - DNA, 32 bp, Homo sapiens
  misc_feature 1..32: note = chr17:77179081-77179113
  misc_feature 1..32: note = hyper
  source 1..32: mol_type = genomic DNA
cgcgccttcggaaaagttgcgagcgacgcccc

SEQ ID NO: 22648 - DNA, 52 bp, Homo sapiens
  misc_feature 1..52: note = chr17:77179278-77179330
  misc_feature 1..52: note = hyper
  source 1..52: mol_type = genomic DNA
cgtgggcggcagcgcggggcgcacgtgcgccgggccgggggccggggccggg

SEQ ID NO: 22649 - DNA, 75 bp, Homo sapiens; identical to SEQ ID NO: 4507
  misc_feature 1..75: note = chr17:77179380-77179455
  misc_feature 1..75: note = hyper
  source 1..75: mol_type = genomic DNA

SEQ ID NO: 22650 - DNA, 27 bp, Homo sapiens
  misc_feature 1..27: note = chr17:77179456-77179483
  misc_feature 1..27: note = hyper
  source 1..27: mol_type = genomic DNA
gcaggggggcgcccggcggcggctctg

SEQ ID NO: 22651 - DNA, 13 bp, Homo sapiens
  misc_feature 1..13: note = chr17:77179617-77179630
  misc_feature 1..13: note = hyper
  source 1..13: mol_type = genomic DNA
cgcgcctctgccc

SEQ ID NO: 22652 - DNA, 265 bp, Homo sapiens; identical to SEQ ID NO: 12919
  misc_feature 1..265: note = chr17:77179951-77180216
  misc_feature 1..265: note = hyper
  source 1..265: mol_type = genomic DNA

SEQ ID NO: 22653 - DNA, 36 bp, Homo sapiens; identical to SEQ ID NO: 12920
  misc_feature 1..36: note = chr17:77772754-77772790
  misc_feature 1..36: note = hyper
  source 1..36: mol_type = genomic DNA

SEQ ID NO: 22654 - DNA, 148 bp, Homo sapiens
  misc_feature 1..148: note = chr17:77776679-77776827
  misc_feature 1..148: note = hyper
  source 1..148: mol_type = genomic DNA
gccgcgggccggccccatttccgccccccccccacgcgcccccccatcacacgcacacccaatccccggactgctcgctggtgctgcttgtgagacccattcctaggagccccaggcgcccttggggagcagaaagaggcggtccaga

SEQ ID NO: 22655 - DNA, 42 bp, Homo sapiens; identical to SEQ ID NO: 12922
  misc_feature 1..42: note = chr17:77777233-77777275
  misc_feature 1..42: note = hyper
  source 1..42: mol_type = genomic DNA

SEQ ID NO: 22656 - DNA, 804 bp, Homo sapiens; identical to SEQ ID NO: 12927
  misc_feature 1..804: note = chr17:78450039-78450843
  misc_feature 1..804: note = hyper
  source 1..804: mol_type = genomic DNA

SEQ ID NO: 22657 - DNA, 95 bp, Homo sapiens; identical to SEQ ID NO: 12928
  misc_feature 1..95: note = chr17:78451477-78451572
  misc_feature 1..95: note = hyper
  source 1..95: mol_type = genomic DNA

SEQ ID NO: 22658 - DNA, 59 bp, Homo sapiens; identical to SEQ ID NO: 12929
  misc_feature 1..59: note = chr17:78451801-78451860
  misc_feature 1..59: note = hyper
  source 1..59: mol_type = genomic DNA

SEQ ID NO: 22659 - DNA, 188 bp, Homo sapiens
  misc_feature 1..188: note = chr17:78452108-78452296
  misc_feature 1..188: note = hyper
  source 1..188: mol_type = genomic DNA
cggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggcccca

SEQ ID NO: 22660 - DNA, 92 bp, Homo sapiens
  misc_feature 1..92: note = chr17:78452833-78452925
  misc_feature 1..92: note = hyper
  source 1..92: mol_type = genomic DNA
ctcggcctccccagtgttctgaaagtatctgagagggagggagcaggaaaacgaagggccgccctgcccaaactcatcggggtgtctggtta

SEQ ID NO: 22661 - DNA, 39 bp, Homo sapiens; identical to SEQ ID NO: 12932
  misc_feature 1..39: note = chr17:79316974-79317013
  misc_feature 1..39: note = hyper
  source 1..39: mol_type = genomic DNA

SEQ ID NO: 22662 - DNA, 121 bp, Homo sapiens; identical to SEQ ID NO: 12933
  misc_feature 1..121: note = chr17:79761692-79761813
  misc_feature 1..121: note = hyper
  source 1..121: mol_type = genomic DNA

SEQ ID NO: 22663 - DNA, 329 bp, Homo sapiens; identical to SEQ ID NO: 12934
  misc_feature 1..329: note = chr17:79761833-79762162
  misc_feature 1..329: note = hyper
  source 1..329: mol_type = genomic DNA

SEQ ID NO: 22664 - DNA, 75 bp, Homo sapiens; identical to SEQ ID NO: 12935
  misc_feature 1..75: note = chr17:79860521-79860596
  misc_feature 1..75: note = hyper
  source 1..75: mol_type = genomic DNA

SEQ ID NO: 22665 - DNA, 30 bp, Homo sapiens; identical to SEQ ID NO: 12936
  misc_feature 1..30: note = chr17:80329291-80329321
  misc_feature 1..30: note = hyper
  source 1..30: mol_type = genomic DNA

SEQ ID NO: 22666 - DNA, 78 bp, Homo sapiens; identical to SEQ ID NO: 12938
  misc_feature 1..78: note = chr17:80333151-80333229
  misc_feature 1..78: note = hyper
  source 1..78: mol_type = genomic DNA

SEQ ID NO: 22667 - DNA, 525 bp, Homo sapiens
  misc_feature 1..525: note = chr18:500738-501263
  misc_feature 1..525: note = hyper
  source 1..525: mol_type = genomic DNA
agcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattag

SEQ ID NO: 22668 - DNA, 30 bp, Homo sapiens; identical to SEQ ID NO: 12941
  misc_feature 1..30: note = chr18:903814-903844
  misc_feature 1..30: note = hyper
  source 1..30: mol_type = genomic DNA

SEQ ID NO: 22669 - DNA, 28 bp, Homo sapiens
  misc_feature 1..28: note = chr18:904648-904676
  misc_feature 1..28: note = hyper
  source 1..28: mol_type = genomic DNA
cgggctagccgcccgccctctcccttgc

SEQ ID NO: 22670 - DNA, 55 bp, Homo sapiens; identical to SEQ ID NO: 12943
  misc_feature 1..55: note = chr18:905713-905768
  misc_feature 1..55: note = hyper
  source 1..55: mol_type = genomic DNA

SEQ ID NO: 22671 - DNA, 232 bp, Homo sapiens; identical to SEQ ID NO: 12944
  misc_feature 1..232: note = chr18:906208-906440
  misc_feature 1..232: note = hyper
  source 1..232: mol_type = genomic DNA

SEQ ID NO: 22672 - DNA, 135 bp, Homo sapiens
  misc_feature 1..135: note = chr18:906736-906871
  misc_feature 1..135: note = hyper
  source 1..135: mol_type = genomic DNA
tccaggggtccaaagcgagagggatttgttttaacccatctctacccgtcctgtgtcaagaacggaggctgtagagggcgactgcgaagtcgccaggcactcgctggatctcggtccccctcctcgtgctctggg

SEQ ID NO: 22673 - DNA, 158 bp, Homo sapiens
  misc_feature 1..158: note = chr18:907314-907472
  misc_feature 1..158: note = hyper
  source 1..158: mol_type = genomic DNA
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggta

SEQ ID NO: 22674 - DNA, 25 bp, Homo sapiens
  misc_feature 1..25: note = chr18:907594-907619
  misc_feature 1..25: note = hyper
  source 1..25: mol_type = genomic DNA
ggatcctcgccgagctggggaggaa

SEQ ID NO: 22675 - DNA, 22 bp, Homo sapiens
  misc_feature 1..22: note = chr18:908432-908454
  misc_feature 1..22: note = hyper
  source 1..22: mol_type = genomic DNA
gcggcggtgggtgcccgtgggg

SEQ ID NO: 22676 - DNA, 106 bp, Homo sapiens; identical to SEQ ID NO: 12949
  misc_feature 1..106: note = chr18:909183-909289
  misc_feature 1..106: note = hyper
  source 1..106: mol_type = genomic DNA

SEQ ID NO: 22677 - DNA, 169 bp, Homo sapiens
  misc_feature 1..169: note = chr18:909318-909487
  misc_feature 1..169: note = hyper
  source 1..169: mol_type = genomic DNA
cggtgggcagtgcgagccccgggccctccccgaaggctcccgcgtggggtggggcccgcctgctccccgcggcgattgaacctgtgtctcccgccccgccaccctcttcccgacccctttgcttgcagtgggagcctcggcggcggcgcgggggacgacgcggagccgc

SEQ ID NO: 22678 - DNA, 145 bp, Homo sapiens
  misc_feature 1..145: note = chr18:909587-909732
  misc_feature 1..145: note = hyper
  source 1..145: mol_type = genomic DNA
gtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatcca

SEQ ID NO: 22679 - DNA, 30 bp, Homo sapiens; identical to SEQ ID NO: 12951
  misc_feature 1..30: note = chr18:961954-961984
  misc_feature 1..30: note = hyper
  source 1..30: mol_type = genomic DNA

SEQ ID NO: 22680 - DNA, 134 bp, Homo sapiens; identical to SEQ ID NO: 12952
  misc_feature 1..134: note = chr18:2847537-2847671
  misc_feature 1..134: note = hyper
  source 1..134: mol_type = genomic DNA

SEQ ID NO: 22681 - DNA, 60 bp, Homo sapiens; identical to SEQ ID NO: 12953
  misc_feature 1..60: note = chr18:2848078-2848138
  misc_feature 1..60: note = hyper
  source 1..60: mol_type = genomic DNA

SEQ ID NO: 22682 - DNA, 15 bp, Homo sapiens
  misc_feature 1..15: note = chr18:5196244-5196259
  misc_feature 1..15: note = hyper
  source 1..15: mol_type = genomic DNA
gtcggacgttcacaa

SEQ ID NO: 22683 - DNA, 412 bp, Homo sapiens
  misc_feature 1..412: note = chr18:5197347-5197759
  misc_feature 1..412: note = hyper
  source 1..412: mol_type = genomic DNA
agggagcaaagcacttccaccgctttcacgcgacgaaggtcggaagagcaagagagagaaaggtaaacttcccggcaggggacagtgaattgcttttaattacctgctgtggctcgtcgccgtggatattggactgacatttaagatagatttgtcaaaaaaaaaaaactctaagagctttctttactctcgaggatgactctgagttctccgagttgggctggctcgaatagaggggcgggtctgtcaagttaataggtcctggaggtccgtgagtcctctctcgcgagtcccagtcctctgctaacgtcaggaagagagcaagaggaaggacacagtgactatggagcgctcgaggagggcgctactatcaggttccgctcccaggtggcaaatccggctctgaaagctc

SEQ ID NO: 22684 - DNA, 173 bp, Homo sapiens; identical to SEQ ID NO: 12960
  misc_feature 1..173: note = chr18:5542985-5543158
  misc_feature 1..173: note = hyper
  source 1..173: mol_type = genomic DNA

SEQ ID NO: 22685 - DNA, 30 bp, Homo sapiens; identical to SEQ ID NO: 12961
  misc_feature 1..30: note = chr18:5544135-5544165
  misc_feature 1..30: note = hyper
  source 1..30: mol_type = genomic DNA

SEQ ID NO: 22686 - DNA, 33 bp, Homo sapiens
  misc_feature 1..33: note = chr18:5628134-5628167
  misc_feature 1..33: note = hyper
  source 1..33: mol_type = genomic DNA
gaggggcaagtcttgcggggcccgtcggtaact

SEQ ID NO: 22687 - DNA, 522 bp, Homo sapiens; identical to SEQ ID NO: 12963
  misc_feature 1..522: note = chr18:5628849-5629371
  misc_feature 1..522: note = hyper
  source 1..522: mol_type = genomic DNA

SEQ ID NO: 22688 - DNA, 40 bp, Homo sapiens; identical to SEQ ID NO: 12964
  misc_feature 1..40: note = chr18:5629372-5629412
  misc_feature 1..40: note = hyper
  source 1..40: mol_type = genomic DNA

SEQ ID NO: 22689 - DNA, 50 bp, Homo sapiens
  misc_feature 1..50: note = chr18:5630262-5630312
  misc_feature 1..50: note = hyper
  source 1..50: mol_type = genomic DNA
ctcccccatcgacctcgagccaagggcaggcggcccgcacccgcgcccct

SEQ ID NO: 22690 - DNA, 271 bp, Homo sapiens
  misc_feature 1..271: note = chr18:5630362-5630633
  misc_feature 1..271: note = hyper
  source 1..271: mol_type = genomic DNA
gaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagtt

SEQ ID NO: 22691 - skipped

SEQ ID NO: 22692 - DNA, 298 bp, Homo sapiens
  misc_feature 1..298: note = chr18:5895205-5895503
  misc_feature 1..298: note = hyper
  source 1..298: mol_type = genomic DNA
gtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacaca

SEQ ID NO: 22693 - DNA, 41 bp, Homo sapiens; identical to SEQ ID NO: 12969
  misc_feature 1..41: note = chr18:6730009-6730050
  misc_feature 1..41: note = hyper
  source 1..41: mol_type = genomic DNA

SEQ ID NO: 22694 - DNA, 115 bp, Homo sapiens; identical to SEQ ID NO: 12970
  misc_feature 1..115: note = chr18:7117059-7117174
  misc_feature 1..115: note = hyper
  source 1..115: mol_type = genomic DNA

SEQ ID NO: 22695 - skipped

SEQ ID NO: 22696 - DNA, 149 bp, Homo sapiens; identical to SEQ ID NO: 12972
  misc_feature 1..149: note = chr18:7117942-7118091
  misc_feature 1..149: note = hyper
  source 1..149: mol_type = genomic DNA

SEQ ID NO: 22697 - DNA, 46 bp, Homo sapiens; identical to SEQ ID NO: 12973
  misc_feature 1..46: note = chr18:7118131-7118177
  misc_feature 1..46: note = hyper
  source 1..46: mol_type = genomic DNA

SEQ ID NO: 22698 - DNA, 46 bp, Homo sapiens; identical to SEQ ID NO: 12974
  misc_feature 1..46: note = chr18:7566590-7566636
  misc_feature 1..46: note = hyper
  source 1..46: mol_type = genomic DNA

SEQ ID NO: 22699 - DNA, 29 bp, Homo sapiens
  misc_feature 1..29: note = chr18:7567754-7567783
  misc_feature 1..29: note = hyper
  source 1..29: mol_type = genomic DNA
ccctccgccctcgcgcgcccacccaccgc

SEQ ID NO: 22700 - DNA, 110 bp, Homo sapiens; identical to SEQ ID NO: 12976
  misc_feature 1..110: note = chr18:7568429-7568539
  misc_feature 1..110: note = hyper
  source 1..110: mol_type = genomic DNA

SEQ ID NO: 22701 - DNA, 75 bp, Homo sapiens; identical to SEQ ID NO: 12977
  misc_feature 1..75: note = chr18:7568540-7568615
  misc_feature 1..75: note = hyper
  source 1..75: mol_type = genomic DNA

SEQ ID NO: 22702 - DNA, 14 bp, Homo sapiens
  misc_feature 1..14: note = chr18:8608968-8608982
  misc_feature 1..14: note = hyper
  source 1..14: mol_type = genomic DNA
gaaaacatgtgcat

SEQ ID NO: 22703 - DNA, 255 bp, Homo sapiens; identical to SEQ ID NO: 12979
  misc_feature 1..255: note = chr18:9709069-9709324
  misc_feature 1..255: note = hyper
  source 1..255: mol_type = genomic DNA

SEQ ID NO: 22704 - DNA, 16 bp, Homo sapiens
  misc_feature 1..16: note = chr18:9771753-9771769
  misc_feature 1..16: note = hyper
  source 1..16: mol_type = genomic DNA
tcgatggtggtgttct

SEQ ID NO: 22705 - DNA, 114 bp, Homo sapiens; identical to SEQ ID NO: 12981
  misc_feature 1..114: note = chr18:10455030-10455144
  misc_feature 1..114: note = hyper
  source 1..114: mol_type = genomic DNA

SEQ ID NO: 22706 - DNA, 209 bp, Homo sapiens
  misc_feature 1..209: note = chr18:11148760-11148969
  misc_feature 1..209: note = hyper
  source 1..209: mol_type = genomic DNA
ctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaa

SEQ ID NO: 22707 - DNA, 49 bp, Homo sapiens
  misc_feature 1..49: note = chr18:11149045-11149094
  misc_feature 1..49: note = hyper
  source 1..49: mol_type = genomic DNA
ttggaagcccctctgaagccaccgcgtctcctttgcccggcctcgtctc

SEQ ID NO: 22708 - DNA, 128 bp, Homo sapiens; identical to SEQ ID NO: 12983
  misc_feature 1..128: note = chr18:11149115-11149243
  misc_feature 1..128: note = hyper
  source 1..128: mol_type = genomic DNA

SEQ ID NO: 22709 - DNA, 63 bp, Homo sapiens; identical to SEQ ID NO: 12986
  misc_feature 1..63: note = chr18:11751569-11751632
  misc_feature 1..63: note = hyper
  source 1..63: mol_type = genomic DNA

SEQ ID NO: 22710 - skipped

SEQ ID NO: 22711 - DNA, 60 bp, Homo sapiens
  misc_feature 1..60: note = chr18:11752640-11752700
  misc_feature 1..60: note = hyper
  source 1..60: mol_type = genomic DNA
cgccaggctgggcgggcagggccgggcgagggtcgcgcgcacctctgggccgcggagccc

SEQ ID NO: 22712 - DNA, 123 bp, Homo sapiens; identical to SEQ ID NO: 12990
  misc_feature 1..123: note = chr18:11947268-11947391
  misc_feature 1..123: note = hyper
  source 1..123: mol_type = genomic DNA

SEQ ID NO: 22713 - DNA, 35 bp, Homo sapiens; identical to SEQ ID NO: 12991
  misc_feature 1..35: note = chr18:12253812-12253847
  misc_feature 1..35: note = hyper
  source 1..35: mol_type = genomic DNA

SEQ ID NO: 22714 - DNA, 43 bp, Homo sapiens; identical to SEQ ID NO: 12992
  misc_feature 1..43: note = chr18:12254104-12254147
  misc_feature 1..43: note = hyper
  source 1..43: mol_type = genomic DNA

SEQ ID NO: 22715 - skipped

SEQ ID NO: 22716 - DNA, 175 bp, Homo sapiens
  misc_feature 1..175: note = chr18:12307751-12307926
  misc_feature 1..175: note = hyper
  source 1..175: mol_type = genomic DNA
gaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcgg

SEQ ID NO: 22717 - DNA, 143 bp, Homo sapiens
  misc_feature 1..143: note = chr18:13868570-13868713
  misc_feature 1..143: note = hyper
  source 1..143: mol_type = genomic DNA
gtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggc

SEQ ID NO: 22718 - DNA, 76 bp, Homo sapiens; identical to SEQ ID NO: 12996
  misc_feature 1..76: note = chr18:13869161-13869237
  misc_feature 1..76: note = hyper
  source 1..76: mol_type = genomic DNA

SEQ ID NO: 22719 - DNA, 25 bp, Homo sapiens
  misc_feature 1..25: note = chr18:15198059-15198084
  misc_feature 1..25: note = hyper
  source 1..25: mol_type = genomic DNA
tagggggcgaaaagacgcaaaaagc

SEQ ID NO: 22720 - DNA, 57 bp, Homo sapiens; identical to SEQ ID NO: 12999
  misc_feature 1..57: note = chr18:18821835-18821892
  misc_feature 1..57: note = hyper
  source 1..57: mol_type = genomic DNA

SEQ ID NO: 22721 - DNA, 285 bp, Homo sapiens
  misc_feature 1..285: note = chr18:18822107-18822392
  misc_feature 1..285: note = hyper
  source 1..285: mol_type = genomic DNA
agcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggagg

SEQ ID NO: 22722 - DNA, 83 bp, Homo sapiens
  misc_feature 1..83: note = chr18:18823274-18823357
  misc_feature 1..83: note = hyper
  source 1..83: mol_type = genomic DNA
gccgctgcctctaaccgaggctgcgggtcctggagaaactcctcagtcttgcccctttctccggtgaacgtgacggttccaag

SEQ ID NO: 22723 - DNA, 51 bp, Homo sapiens; identical to SEQ ID NO: 13003
  misc_feature 1..51: note = chr18:22928965-22929016
  misc_feature 1..51: note = hyper
  source 1..51: mol_type = genomic DNA

SEQ ID NO: 22724 - DNA, 231 bp, Homo sapiens
  misc_feature 1..231: note = chr18:22930559-22930790
  misc_feature 1..231: note = hyper
  source 1..231: mol_type = genomic DNA
tcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcg

SEQ ID NO: 22725 - DNA, 49 bp, Homo sapiens
  misc_feature 1..49: note = chr18:24128030-24128079
  misc_feature 1..49: note = hyper
  source 1..49: mol_type = genomic DNA
gggtccagctcggagccgtccccgggcggcccaccgcgggcccggggcg

SEQ ID NO: 22726 - DNA, 30 bp, Homo sapiens; identical to SEQ ID NO: 13010
  misc_feature 1..30: note = chr18:24764644-24764674
  misc_feature 1..30: note = hyper
  source 1..30: mol_type = genomic DNA

SEQ ID NO: 22727 - DNA, 53 bp, Homo sapiens; identical to SEQ ID NO: 13011
  misc_feature 1..53: note = chr18:25755399-25755452
  misc_feature 1..53: note = hyper
  source 1..53: mol_type = genomic DNA

SEQ ID NO: 22728 - DNA, 257 bp, Homo sapiens
  misc_feature 1..257: note = chr18:25756729-25756986
  misc_feature 1..257: note = hyper
  source 1..257: mol_type = genomic DNA
ccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 22729 - DNA, 335 bp, Homo sapiens
  misc_feature 1..335: note = chr18:25757452-25757787
  misc_feature 1..335: note = hyper
  source 1..335: mol_type = genomic DNA
ccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgca

SEQ ID NO: 22730 - DNA, 148 bp, Homo sapiens
  misc_feature 1..148: note = chr18:25757824-25757972
  misc_feature 1..148: note = hyper
  source 1..148: mol_type = genomic DNA
actcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgc

SEQ ID NO: 22731 - DNA, 110 bp, Homo sapiens; identical to SEQ ID NO: 13016
  misc_feature 1..110: note = chr18:25758377-25758487
  misc_feature 1..110: note = hyper
  source 1..110: mol_type = genomic DNA

SEQ ID NO: 22732 - DNA, 68 bp, Homo sapiens
  misc_feature 1..68: note = chr18:28620831-28620899
  misc_feature 1..68: note = hyper
  source 1..68: mol_type = genomic DNA
gttaatttacccatccggtccgaaattgcaagtgtttgtaaactgacaattgcagatgaaatagtcat

SEQ ID NO: 22733 - DNA, 71 bp, Homo sapiens
  misc_feature 1..71: note = chr18:28621097-28621168
  misc_feature 1..71: note = hyper
  source 1..71: mol_type = genomic DNA
tcttccatggcctctgggagcctcgagcgaatgcgagaaattctgagagcagcacccgtagtttcgttccc

SEQ ID NO: 22734 - DNA, 56 bp, Homo sapiens
  misc_feature 1..56: note = chr18:28621932-28621988
  misc_feature 1..56: note = hyper
  source 1..56: mol_type = genomic DNA
ttcgcgcccccggcacatcccgcccccagctgggtggctggcgggggtggaccgct

SEQ ID NO: 22735 - DNA, 229 bp, Homo sapiens
  misc_feature 1..229: note = chr18:28622488-28622717
  misc_feature 1..229: note = hyper
  source 1..229: mol_type = genomic DNA
tccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttc

SEQ ID NO: 22736 - DNA, 155 bp, Homo sapiens; identical to SEQ ID NO: 13022
  misc_feature 1..155: note = chr18:30350080-30350235
  misc_feature 1..155: note = hyper
  source 1..155: mol_type = genomic DNA

SEQ ID NO: 22737 - DNA, 47 bp, Homo sapiens
  misc_feature 1..47: note = chr18:31020448-31020495
  misc_feature 1..47: note = hyper
  source 1..47: mol_type = genomic DNA
gggtgaagaactagtcgactctaactccctcagggtggccagggaat

SEQ ID NO: 22738 - DNA, 173 bp, Homo sapiens
  misc_feature 1..173: note = chr18:31739469-31739642
  misc_feature 1..173: note = hyper
  source 1..173: mol_type = genomic DNA
tgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 22739 - DNA, 41 bp, Homo sapiens; identical to SEQ ID NO: 13025
  misc_feature 1..41: note = chr18:31802052-31802093
  misc_feature 1..41: note = hyper
  source 1..41: mol_type = genomic DNA

SEQ ID NO: 22740 - DNA, 107 bp, Homo sapiens
  misc_feature 1..107: note = chr18:31802831-31802938
  misc_feature 1..107: note = hyper
  source 1..107: mol_type = genomic DNA
aaggtagggggcacacgagccaacggcggctcacggctccccctctctcccgcctctctccttcctccctccccgccgggctgctccggcagacaaataacagagga

SEQ ID NO: 22741 - DNA, 120 bp, Homo sapiens
  misc_feature 1..120: note = chr18:31802968-31803088
  misc_feature 1..120: note = hyper
  source 1..120: mol_type = genomic DNA
cacgtagagcacttgcttggcgccgccgcctcccccgcggacctcgtccggctggcccagctggaagcccttcgatttgacccagaatttaaatttggcgttgtccgtggagctcgactc

SEQ ID NO: 22742 - DNA, 69 bp, Homo sapiens
  misc_feature 1..69: note = chr18:31803369-31803438
  misc_feature 1..69: note = hyper
  source 1..69: mol_type = genomic DNA
gaggggaggagggtccggttgggcaccagcaatcaatgccccgtgctaccaagtctggtccattcgtaa

SEQ ID NO: 22743 - DNA, 24 bp, Homo sapiens
  misc_feature 1..24: note = chr18:31803472-31803496
  misc_feature 1..24: note = hyper
  source 1..24: mol_type = genomic DNA
cttagcggtcggtctctttaatat

SEQ ID NO: 22744 - DNA, 76 bp, Homo sapiens; identical to SEQ ID NO: 13028
  misc_feature 1..76: note = chr18:32073450-32073526
  misc_feature 1..76: note = hyper
  source 1..76: mol_type = genomic DNA

SEQ ID NO: 22745 - DNA, 79 bp, Homo sapiens; identical to SEQ ID NO: 13029
  misc_feature 1..79: note = chr18:32073746-32073825
  misc_feature 1..79: note = hyper
  source 1..79: mol_type = genomic DNA

SEQ ID NO: 22746 - DNA, 205 bp, Homo sapiens; identical to SEQ ID NO: 13030
  misc_feature 1..205: note = chr18:34834309-34834514
  misc_feature 1..205: note = hyper
  source 1..205: mol_type = genomic DNA

SEQ ID NO: 22747 - DNA, 48 bp, Homo sapiens
  misc_feature 1..48: note = chr18:35065024-35065072
  misc_feature 1..48: note = hyper
  source 1..48: mol_type = genomic DNA
gctataaaccagggccgaggcgcgatagtttatcaaagacgagggctg

SEQ ID NO: 22748 - DNA, 135 bp, Homo sapiens; identical to SEQ ID NO: 4536
  misc_feature 1..135: note = chr18:35065516-35065651
  misc_feature 1..135: note = hyper
  source 1..135: mol_type = genomic DNA

SEQ ID NO: 22749 - DNA, 44 bp, Homo sapiens; identical to SEQ ID NO: 13033
  misc_feature 1..44: note = chr18:35104934-35104978
  misc_feature 1..44: note = hyper
  source 1..44: mol_type = genomic DNA

SEQ ID NO: 22750 - DNA, 25 bp, Homo sapiens
  misc_feature 1..25: note = chr18:35144820-35144845
  misc_feature 1..25: note = hyper
  source 1..25: mol_type = genomic DNA
tctctcccttttagacggctgcgct

SEQ ID NO: 22751 - DNA, 40 bp, Homo sapiens; identical to SEQ ID NO: 13036
  misc_feature 1..40: note = chr18:35145558-35145598
  misc_feature 1..40: note = hyper
  source 1..40: mol_type = genomic DNA

SEQ ID NO: 22752 - DNA, 55 bp, Homo sapiens; identical to SEQ ID NO: 13038
  misc_feature 1..55: note = chr18:35146710-35146765
  misc_feature 1..55: note = hyper
  source 1..55: mol_type = genomic DNA

SEQ ID NO: 22753 - skipped

SEQ ID NO: 22754 - DNA, 30 bp, Homo sapiens; identical to SEQ ID NO: 13040
  misc_feature 1..30: note = chr18:35147131-35147161
  misc_feature 1..30: note = hyper
  source 1..30: mol_type = genomic DNA

SEQ ID NO: 22755 - DNA, 53 bp, Homo sapiens; identical to SEQ ID NO: 13041
  misc_feature 1..53: note = chr18:43913567-43913620
  misc_feature 1..53: note = hyper
  source 1..53: mol_type = genomic DNA

SEQ ID NO: 22756 - DNA, 228 bp, Homo sapiens; identical to SEQ ID NO: 13042
  misc_feature 1..228: note = chr18:43914398-43914626
  misc_feature 1..228: note = hyper
  source 1..228: mol_type = genomic DNA

SEQ ID NO: 22757 - DNA, 162 bp, Homo sapiens
  misc_feature 1..162: note = chr18:44337012-44337174
  misc_feature 1..162: note = hyper
  source 1..162: mol_type = genomic DNA
cgatagggacggggggagggggcgtacaaaacacccgcgcagtctggctaatgataggcgggccgtggggagggggaggggcggagcgcaaaacgccgggtttgaatcttggaattaaaaagagggcaggggctgggcgcggtggctcactcctgtaatccc

SEQ ID NO: 22758 - DNA, 83 bp, Homo sapiens
  misc_feature 1..83: note = chr18:44772977-44773060
  misc_feature 1..83: note = hyper
  source 1..83: mol_type = genomic DNA
gtgaactgggctgcccgggctgctgctgccgccgccactcgccttctggggggccaggggcggcggcgggggcgggggcaggt

SEQ ID NO: 22759 - DNA, 126 bp, Homo sapiens
  misc_feature 1..126: note = chr18:44773466-44773592
  misc_feature 1..126: note = hyper
  source 1..126: mol_type = genomic DNA
cggcggggccgggtggtggcgctcggaacccggctcgtcgggctgcgggggcagcagcagaagcggcgacggcggctgcggggggtggtggtggtggtggtggtggtgagggtggtgatggtggtg

SEQ ID NO: 22760 - DNA, 21 bp, Homo sapiens
  misc_feature 1..21: note = chr18:44775554-44775575
  misc_feature 1..21: note = hyper
  source 1..21: mol_type = genomic DNA
ctccgccgcagaaccccgggc

SEQ ID NO: 22761 - DNA, 51 bp, Homo sapiens; identical to SEQ ID NO: 13053
  misc_feature 1..51: note = chr18:44780673-44780724
  misc_feature 1..51: note = hyper
  source 1..51: mol_type = genomic DNA

SEQ ID NO: 22762 - DNA, 179 bp, Homo sapiens; identical to SEQ ID NO: 13055
  misc_feature 1..179: note = chr18:44786934-44787113
  misc_feature 1..179: note = hyper
  source 1..179: mol_type = genomic DNA

SEQ ID NO: 22763 - DNA, 35 bp, Homo sapiens
  misc_feature 1..35: note = chr18:44787746-44787781
  misc_feature 1..35: note = hyper
  source 1..35: mol_type = genomic DNA
tagcttgctcagatccgcacccccccactccccac

SEQ ID NO: 22764 - skipped

SEQ ID NO: 22765 - DNA, 26 bp, Homo sapiens
  misc_feature 1..26: note = chr18:44789937-44789963
  misc_feature 1..26: note = hyper
  source 1..26: mol_type = genomic DNA
ctaggacatgccgggggctgtttgct

SEQ ID NO: 22766 - DNA, 30 bp, Homo sapiens; identical to SEQ ID NO: 13059
  misc_feature 1..30: note = chr18:45663049-45663079
  misc_feature 1..30: note = hyper
  source 1..30: mol_type = genomic DNA

SEQ ID NO: 22767 - DNA, 30 bp, Homo sapiens; identical to SEQ ID NO: 13060
  misc_feature 1..30: note = chr18:47088076-47088106
  misc_feature 1..30: note = hyper
  source 1..30: mol_type = genomic DNA

SEQ ID NO: 22768 - DNA, 42 bp, Homo sapiens; identical to SEQ ID NO: 13061
  misc_feature 1..42: note = chr18:47339612-47339654
  misc_feature 1..42: note = hyper
  source 1..42: mol_type = genomic DNA

SEQ ID NO: 22769 - DNA, 39 bp, Homo sapiens
  misc_feature 1..39: note = chr18:52989220-52989259
  misc_feature 1..39: note = hyper
  source 1..39: mol_type = genomic DNA
tacgcgagatcgattcaacttttccgaggggtttttatt

SEQ ID NO: 22770 - DNA, 64 bp, Homo sapiens
  misc_feature 1..64: note = chr18:52989882-52989946
  misc_feature 1..64: note = hyper
  source 1..64: mol_type = genomic DNA
catgggcccagagcctacggaggggctggggcgctgctcccctcgctggcgctgggcgccccaa

SEQ ID NO: 22771 - DNA, 30 bp, Homo sapiens; identical to SEQ ID NO: 13065
  misc_feature 1..30: note = chr18:53254709-53254739
  misc_feature 1..30: note = hyper
  source 1..30: mol_type = genomic DNA

SEQ ID NO: 22772 - DNA, 874 bp, Homo sapiens; identical to SEQ ID NO: 13066
  misc_feature 1..874: note = chr18:53255143-53256017
  misc_feature 1..874: note = hyper
  source 1..874: mol_type = genomic DNA

SEQ ID NO: 22773 - DNA, 195 bp, Homo sapiens
  misc_feature 1..195: note = chr18:53256942-53257137
  misc_feature 1..195: note = hyper
  source 1..195: mol_type = genomic DNA
caccatggactcccccgtggagtcacattgataataataggtttccctgaaagatacattgtaatccattcacatccgggaactgcgggcttataaagagaaggagctgcggccgcggctgctcctccagacaatgactgggaaggggcggggcgggagcaggcgaccatagagtggtaaacagagcgcctagag

SEQ ID NO: 22774 - DNA, 99 bp, Homo sapiens
  misc_feature 1..99: note = chr18:53257204-53257303
  misc_feature 1..99: note = hyper
  source 1..99: mol_type = genomic DNA
gggtaggcgtcgcgcgtggggcggcactgtgggagttcccgaggccgaggtcgttcgcaggccccatttccctgcgctcttattcgtgttgccgcttct

SEQ ID NO: 22775 - DNA, 104 bp, Homo sapiens
  misc_feature 1..104: note = chr18:53446866-53446970
  misc_feature 1..104: note = hyper
  source 1..104: mol_type = genomic DNA
aaatgccaggagccccgggggtgtgatgtttccggtggataatgtctcccgttccctgccccggggcccagacagttggtgcttaagcgtctacaatgtagagt

SEQ ID NO: 22776 - DNA, 39 bp, Homo sapiens
  misc_feature 1..39: note = chr18:53447816-53447855
  misc_feature 1..39: note = hyper
  source 1..39: mol_type = genomic DNA
ccccgcagcttccctgcggctcagcggcctcccacccag

SEQ ID NO: 22777 - DNA, 15 bp, Homo sapiens
  misc_feature 1..15: note = chr18:54789055-54789070
  misc_feature 1..15: note = hyper
  source 1..15: mol_type = genomic DNA
agcgtggcctgagcc

SEQ ID NO: 22778 - DNA, 58 bp, Homo sapiens
  misc_feature 1..58: note = chr18:55020597-55020655
  misc_feature 1..58: note = hyper
  source 1..58: mol_type = genomic DNA
gcagagatggacaggcgtgaggggagcgccctccccgcgccctgtccgcagactccgc

SEQ ID NO: 22779 - DNA, 141 bp, Homo sapiens; identical to SEQ ID NO: 4552
  misc_feature 1..141: note = chr18:55020804-55020945
  misc_feature 1..141: note = hyper
  source 1..141: mol_type = genomic DNA

SEQ ID NO: 22780 - DNA, 113 bp, Homo sapiens
  misc_feature 1..113: note = chr18:55020965-55021078
  misc_feature 1..113: note = hyper
  source 1..113: mol_type = genomic DNA
cgagagcccccgccccgctctgtgaccccgggaactctcccagcagggcctcctgacgggcaggtggcaactacaaagtgccacctgtggtccaagctgggaccgaggcgagg

SEQ ID NO: 22781 - DNA, 32 bp, Homo sapiens; identical to SEQ ID NO: 13074
  misc_feature 1..32: note = chr18:55105140-55105172
  misc_feature 1..32: note = hyper
  source 1..32: mol_type = genomic DNA

SEQ ID NO: 22782 - DNA, 30 bp, Homo sapiens; identical to SEQ ID NO: 13076
  misc_feature 1..30: note = chr18:55106031-55106061
  misc_feature 1..30: note = hyper
  source 1..30: mol_type = genomic DNA

SEQ ID NO: 22783 - DNA, 46 bp, Homo sapiens; identical to SEQ ID NO: 13078
  misc_feature 1..46: note = chr18:56887753-56887799
  misc_feature 1..46: note = hyper
  source 1..46: mol_type = genomic DNA

SEQ ID NO: 22784 - DNA, 30 bp, Homo sapiens; identical to SEQ ID NO: 13079
  misc_feature 1..30: note = chr18:56888148-56888178
  misc_feature 1..30: note = hyper
  source 1..30: mol_type = genomic DNA

SEQ ID NO: 22785 - DNA, 64 bp, Homo sapiens
  misc_feature 1..64: note = chr18:56888490-56888554
  misc_feature 1..64: note = hyper
  source 1..64: mol_type = genomic DNA
cccctagaacccaggcggagaggacggccgcgctgcgggtgcggagggcgcctgcgggtggggt

SEQ ID NO: 22786 - DNA, 50 bp, Homo sapiens
  misc_feature 1..50: note = chr18:56931583-56931633
  misc_feature 1..50: note = hyper
  source 1..50: mol_type = genomic DNA
ggtgccctcaccgtacgccgaccgtgtggggaacacgctctctggaagct

SEQ ID NO: 22787 - DNA, 30 bp, Homo sapiens; identical to SEQ ID NO: 13082
  misc_feature 1..30: note = chr18:56933063-56933093
  misc_feature 1..30: note = hyper
  source 1..30: mol_type = genomic DNA

SEQ ID NO: 22788 - DNA, 54 bp, Homo sapiens
  misc_feature 1..54: note = chr18:56934956-56935010
  misc_feature 1..54: note = hyper
  source 1..54: mol_type = genomic DNA
gctcaggcgggagtccgggactctccttcttcagagagtctcaggagattgtga

SEQ ID NO: 22789 - DNA, 317 bp, Homo sapiens; identical to SEQ ID NO: 13084
  misc_feature 1..317: note = chr18:56936333-56936650
  misc_feature 1..317: note = hyper
  source 1..317: mol_type = genomic DNA

SEQ ID NO: 22790 - DNA, 233 bp, Homo sapiens
  misc_feature 1..233: note = chr18:56940722-56940955
  misc_feature 1..233: note = hyper
  source 1..233: mol_type = genomic DNA
cccttctctcggcccctccctccacagaggggcgtgtcctcacccggcccagccacagggtcctctagtggccacccctgggccggcactaggaatattccccttccacctcttgatccgttttaagctttacaaacacactccggggatccgcggcgggatgcctgatgggctcgggaacctggtcgcggcgcacccctagtcctgcctcagtggggccgacgcccttgggc

SEQ ID NO: 22791 - skipped

SEQ ID NO: 22792 - DNA, 210 bp, Homo sapiens
  misc_feature 1..210: note = chr18:57364448-57364658
  misc_feature 1..210: note = hyper
  source 1..210: mol_type = genomic DNA
gccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccct

SEQ ID NO: 22793 - DNA, 236 bp, Homo sapiens
  misc_feature 1..236: note = chr18:57364691-57364927
  misc_feature 1..236: note = hyper
  source 1..236: mol_type = genomic DNA
tttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctc

SEQ ID NO: 22794 - DNA, 159 bp, Homo sapiens
  misc_feature 1..159: note = chr18:59000829-59000988
  misc_feature 1..159: note = hyper
  source 1..159: mol_type = genomic DNA
ccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggca

SEQ ID NO: 22795 - DNA, 279 bp, Homo sapiens
  misc_feature 1..279: note = chr18:59001022-59001301
  misc_feature 1..279: note = hyper
  source 1..279: mol_type = genomic DNA
aggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaa

SEQ ID NO: 22796 - DNA, 58 bp, Homo sapiens
  misc_feature 1..58: note = chr18:67067500-67067558
  misc_feature 1..58: note = hyper
  source 1..58: mol_type = genomic DNA
cctagttaacgaaaacgcatgcataaatcaaccactcgggtcggtcggtcttctccac

SEQ ID NO: 22797 - DNA, 30 bp, Homo sapiens; identical to SEQ ID NO: 13096
  misc_feature 1..30: note = chr18:67067914-67067944
  misc_feature 1..30: note = hyper
  source 1..30: mol_type = genomic DNA

SEQ ID NO: 22798 - DNA, 181 bp, Homo sapiens
  misc_feature 1..181: note = chr18:70209205-70209386
  misc_feature 1..181: note = hyper
  source 1..181: mol_type = genomic DNA
acttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccggg

SEQ ID NO: 22799 - DNA, 72 bp, Homo sapiens; identical to SEQ ID NO: 13099
  misc_feature 1..72: note = chr18:70209493-70209565
  misc_feature 1..72: note = hyper
  source 1..72: mol_type = genomic DNA

SEQ ID NO: 22800 - DNA, 30 bp, Homo sapiens; identical to SEQ ID NO: 13100
  misc_feature 1..30: note = chr18:70209822-70209852
  misc_feature 1..30: note = hyper
  source 1..30: mol_type = genomic DNA

SEQ ID NO: 22801 - DNA, 50 bp, Homo sapiens; identical to SEQ ID NO: 13101
  misc_feature 1..50: note = chr18:70211036-70211086
  misc_feature 1..50: note = hyper
  source 1..50: mol_type = genomic DNA

SEQ ID NO: 22802 - DNA, 73 bp, Homo sapiens
  misc_feature 1..73: note = chr18:70535582-70535655
  misc_feature 1..73: note = hyper
  source 1..73: mol_type = genomic DNA
agaggatgcagccgcaaatcccgagccggatcctcgtgccggacggaaggcgtggaagcgggaggggccttcg

SEQ ID NO: 22803 - DNA, 39 bp, Homo sapiens
  misc_feature 1..39: note = chr18:70535971-70536010
  misc_feature 1..39: note = hyper
  source 1..39: mol_type = genomic DNA
accccaaggcacacacggacccccgttcccccgcgccac

SEQ ID NO: 22804 - DNA, 229 bp, Homo sapiens
  misc_feature 1..229: note = chr18:70536604-70536833
  misc_feature 1..229: note = hyper
  source 1..229: mol_type = genomic DNA
cgttgggtgctcgtcgcagtcctgcccacgcctagcgcagcggctgtgagtgggtggaggtctcctgccagtaagttgggatgagggacgatgaggtgacccccaagtctggaagggattcagagtctcacacgcgcccccaagcctcctaccaccacaccaaagtgctggttcctcgatttccagggtggggtaaagtgaccgagcaaaggggatggtgtgtttgtgt

SEQ ID NO: 22805 - DNA, 154 bp, Homo sapiens
  misc_feature 1..154: note = chr18:70536871-70537025
  misc_feature 1..154: note = hyper
  source 1..154: mol_type = genomic DNA
tgtaatgaaagttgggtcatgggtcaacccgggagtagagcgagatggagacctaaagagagaaagctgagagaagggggaagacatggacagggtaagagagagagaaaggagagagagaagaaagggaaaagaggagcggggagagaaaaga

SEQ ID NO: 22806 - DNA, 33 bp, Homo sapiens; identical to SEQ ID NO: 13107
  misc_feature 1..33: note = chr18:70537332-70537365
  misc_feature 1..33: note = hyper
  source 1..33: mol_type = genomic DNA

SEQ ID NO: 22807 - DNA, 349 bp, Homo sapiens; identical to SEQ ID NO: 13108
  misc_feature 1..349: note = chr18:72123440-72123789
  misc_feature 1..349: note = hyper
  source 1..349: mol_type = genomic DNA

SEQ ID NO: 22808 - DNA, 48 bp, Homo sapiens; identical to SEQ ID NO: 13109
  misc_feature 1..48: note = chr18:72124237-72124285
  misc_feature 1..48: note = hyper
  source 1..48: mol_type = genomic DNA

SEQ ID NO: 22809 - DNA, 47 bp, Homo sapiens; identical to SEQ ID NO: 13112
  misc_feature 1..47: note = chr18:73628494-73628541
  misc_feature 1..47: note = hyper
  source 1..47: mol_type = genomic DNA

SEQ ID NO: 22810 - DNA, 106 bp, Homo sapiens; identical to SEQ ID NO: 13115
  misc_feature 1..106: note = chr18:74962836-74962942
  misc_feature 1..106: note = hyper
  source 1..106: mol_type = genomic DNA

SEQ ID NO: 22811 - DNA, 46 bp, Homo sapiens
  misc_feature 1..46: note = chr18:75362885-75362931
  misc_feature 1..46: note = hyper
  source 1..46: mol_type = genomic DNA
tgccggccatgccctcggctcctctcccgacacgcgccagcactgc

SEQ ID NO: 22812 - DNA, 43 bp, Homo sapiens
  misc_feature 1..43: note = chr18:75362985-75363028
  misc_feature 1..43: note = hyper
  source 1..43: mol_type = genomic DNA
gaagaagccgggaccgcgagcagctggacgctttctccctggg

SEQ ID NO: 22813 - DNA, 39 bp, Homo sapiens
  misc_feature 1..39: note = chr18:75612186-75612225
  misc_feature 1..39: note = hyper
  source 1..39: mol_type = genomic DNA
ctgcaggagccccggcggcctgcaggggcggtggcgcgg

SEQ ID NO: 22814 - DNA, 145 bp, Homo sapiens
  misc_feature 1..145: note = chr18:75612286-75612431
  misc_feature 1..145: note = hyper
  source 1..145: mol_type = genomic DNA
cgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgc

SEQ ID NO: 22815 - DNA, 235 bp, Homo sapiens; identical to SEQ ID NO: 13118
  misc_feature 1..235: note = chr18:77153209-77153444
  misc_feature 1..235: note = hyper
  source 1..235: mol_type = genomic DNA

SEQ ID NO: 22816 - DNA, 119 bp, Homo sapiens; identical to SEQ ID NO: 13119
  misc_feature 1..119: note = chr18:77159847-77159966
  misc_feature 1..119: note = hyper
  source 1..119: mol_type = genomic DNA

SEQ ID NO: 22817 - DNA, 78 bp, Homo sapiens; identical to SEQ ID NO: 1346
  misc_feature 1..78: note = chr18:77547970-77548048
  misc_feature 1..78: note = hyper
  source 1..78: mol_type = genomic DNA

SEQ ID NO: 22818 - DNA, 100 bp, Homo sapiens
  misc_feature 1..100: note = chr18:77557982-77558082
  misc_feature 1..100: note = hyper
  source 1..100: mol_type = genomic DNA
ggagcccggagctcgcggagtctggaccgcaggtaaagttgagcgcgccgtggggccgggggtggggggtccgcggcgaaggagccggggccgcagtggg

SEQ ID NO: 22819 - DNA, 39 bp, Homo sapiens
  misc_feature 1..39: note = chr18:77558358-77558397
  misc_feature 1..39: note = hyper
  source 1..39: mol_type = genomic DNA
ccgtctattcgcgctggtcctgcgggagcccgggtgagc

SEQ ID NO: 22820 - DNA, 415 bp, Homo sapiens
  misc_feature 1..415: note = chr18:77558416-77558831
  misc_feature 1..415: note = hyper
  source 1..415: mol_type = genomic DNA
cgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtg

SEQ ID NO: 22821 - DNA, 212 bp, Homo sapiens
  misc_feature 1..212: note = chr18:77558930-77559142
  misc_feature 1..212: note = hyper
  source 1..212: mol_type = genomic DNA
ccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaa

SEQ ID NO: 22822 - DNA, 40 bp, Homo sapiens; identical to SEQ ID NO: 13124
  misc_feature 1..40: note = chr19:591461-591501
  misc_feature 1..40: note = hyper
  source 1..40: mol_type = genomic DNA

SEQ ID NO: 22823-22824 - skipped (2 entries)

SEQ ID NO: 22825 - DNA, 132 bp, Homo sapiens
  misc_feature 1..132: note = chr19:1450187-1450319
  misc_feature 1..132: note = hyper
  source 1..132: mol_type = genomic DNA
cccggagcccctgcccgcgccgcggagaccccggagcccgcgcgctccgaggccaccccgggccgggatttccggtggggcccgcggagccgcgcagagggaggaggccccagacccaggcgccccgccagc

SEQ ID NO: 22826 - DNA, 42 bp, Homo sapiens
  misc_feature 1..42: note = chr19:1450390-1450432
  misc_feature 1..42: note = hyper
  source 1..42: mol_type = genomic DNA
tttccatccctggctctcagcattgcccgtcagcacagactc

SEQ ID NO: 22827 - DNA, 34 bp, Homo sapiens; identical to SEQ ID NO: 13127
  misc_feature 1..34: note = chr19:1523753-1523787
  misc_feature 1..34: note = hyper
  source 1..34: mol_type = genomic DNA

SEQ ID NO: 22828 - DNA, 67 bp, Homo sapiens
  misc_feature 1..67: note = chr19:1524447-1524514
  misc_feature 1..67: note = hyper
  source 1..67: mol_type = genomic DNA
ccgtgggttgcgtgtccggggtgtgggcgtgcggctcggcctcgggatgcgacgctgtgttgcccct

SEQ ID NO: 22829 - DNA, 30 bp, Homo sapiens; identical to SEQ ID NO: 13129
  misc_feature 1..30: note = chr19:1719137-1719167
  misc_feature 1..30: note = hyper
  source 1..30: mol_type = genomic DNA

SEQ ID NO: 22830 - DNA, 39 bp, Homo sapiens; identical to SEQ ID NO: 13130
  misc_feature 1..39: note = chr19:1725654-1725693
  misc_feature 1..39: note = hyper
  source 1..39: mol_type = genomic DNA

SEQ ID NO: 22831 - DNA, 30 bp, Homo sapiens; identical to SEQ ID NO: 13131
  misc_feature 1..30: note = chr19:1750146-1750176
  misc_feature 1..30: note = hyper
  source 1..30: mol_type = genomic DNA

SEQ ID NO: 22832 - DNA, 113 bp, Homo sapiens; identical to SEQ ID NO: 13132
  misc_feature 1..113: note = chr19:1753693-1753806
  misc_feature 1..113: note = hyper
  source 1..113: mol_type = genomic DNA

SEQ ID NO: 22833 - DNA, 426 bp, Homo sapiens
  misc_feature 1..426: note = chr19:1754313-1754739
  misc_feature 1..426: note = hyper
  source 1..426: mol_type = genomic DNA
cgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgc

SEQ ID NO: 22834 - DNA, 71 bp, Homo sapiens
  misc_feature 1..71: note = chr19:1754804-1754875
  misc_feature 1..71: note = hyper
  source 1..71: mol_type = genomic DNA
tggctgcaggagccagagttccagcgcatgtcggcgctgcgcttggcaggtaggagcgtggcgcgcagggc

SEQ ID NO: 22835 - DNA, 40 bp, Homo sapiens
  misc_feature 1..40: note = chr19:1757376-1757416
  misc_feature 1..40: note = hyper
  source 1..40: mol_type = genomic DNA
gtctgggtttcctgtcgaggaagggagagttagaacagtc

SEQ ID NO: 22836 - DNA, 11 bp, Homo sapiens
  misc_feature 1..11: note = chr19:1757615-1757626
  misc_feature 1..11: note = hyper
  source 1..11: mol_type = genomic DNA
cctgtcgcgtc

SEQ ID NO: 22837 - DNA, 74 bp, Homo sapiens; identical to SEQ ID NO: 13135
  misc_feature 1..74: note = chr19:1757980-1758054
  misc_feature 1..74: note = hyper
  source 1..74: mol_type = genomic DNA

SEQ ID NO: 22838 - DNA, 66 bp, Homo sapiens; identical to SEQ ID NO: 13136
  misc_feature 1..66: note = chr19:1762172-1762238
  misc_feature 1..66: note = hyper
  source 1..66: mol_type = genomic DNA

SEQ ID NO: 22839 - DNA, 169 bp, Homo sapiens; identical to SEQ ID NO: 13138
  misc_feature 1..169: note = chr19:1762627-1762796
  misc_feature 1..169: note = hyper
  source 1..169: mol_type = genomic DNA

SEQ ID NO: 22840 - DNA, 30 bp, Homo sapiens; identical to SEQ ID NO: 13139
  misc_feature 1..30: note = chr19:1765699-1765729
  misc_feature 1..30: note = hyper
  source 1..30: mol_type = genomic DNA

SEQ ID NO: 22841 - DNA, 39 bp, Homo sapiens; identical to SEQ ID NO: 13140
  misc_feature 1..39: note = chr19:1769737-1769776
  misc_feature 1..39: note = hyper
  source 1..39: mol_type = genomic DNA

SEQ ID NO: 22842 - DNA, 117 bp, Homo sapiens
  misc_feature 1..117: note = chr19:1776259-1776376
  misc_feature 1..117: note = hyper
  source 1..117: mol_type = genomic DNA
acctttaggcaccttcgtggagcgcaaggaaggacgcagctccggacacgggagaccacgcccaggctcccaggagaaggggacccggccggagaaggcgccgctggggccgcccgg

SEQ ID NO: 22843 - DNA, 345 bp, Homo sapiens; identical to SEQ ID NO: 13142
  misc_feature 1..345: note = chr19:1856999-1857344
  misc_feature 1..345: note = hyper
  source 1..345: mol_type = genomic DNA

SEQ ID NO: 22844 - DNA, 326 bp, Homo sapiens
  misc_feature 1..326: note = chr19:2252658-2252984
  misc_feature 1..326: note = hyper
  source 1..326: mol_type = genomic DNA
gcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctg

SEQ ID NO: 22845 - DNA, 247 bp, Homo sapiens
  misc_feature 1..247: note = chr19:2290006-2290253
  misc_feature 1..247: note = hyper
  source 1..247: mol_type = genomic DNA
ttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgc

SEQ ID NO: 22846 - DNA, 21 bp, Homo sapiens
  misc_feature 1..21: note = chr19:2302772-2302793
  misc_feature 1..21: note = hyper
  source 1..21: mol_type = genomic DNA
gcaggggggccgggccggcgg

SEQ ID NO: 22847 - DNA, 15 bp, Homo sapiens
  misc_feature 1..15: note = chr19:3585992-3586007
  misc_feature 1..15: note = hyper
  source 1..15: mol_type = genomic DNA
ggggccccctttgca

SEQ ID NO: 22848 - DNA, 12 bp, Homo sapiens
  misc_feature 1..12: note = chr19:3785637-3785649
  misc_feature 1..12: note = hyper
  source 1..12: mol_type = genomic DNA
gaaacacacagg

SEQ ID NO: 22849 - DNA, 16 bp, Homo sapiens
  misc_feature 1..16: note = chr19:3786583-3786599
  misc_feature 1..16: note = hyper
  source 1..16: mol_type = genomic DNA
gcgcggcggggaccgg

SEQ ID NO: 22850 - DNA, 48 bp, Homo sapiens; identical to SEQ ID NO: 13153
  misc_feature 1..48: note = chr19:3822204-3822252
  misc_feature 1..48: note = hyper
  source 1..48: mol_type = genomic DNA

SEQ ID NO: 22851 - DNA, 48 bp, Homo sapiens; identical to SEQ ID NO: 13154
  misc_feature 1..48: note = chr19:3868851-3868899
  misc_feature 1..48: note = hyper
  source 1..48: mol_type = genomic DNA

SEQ ID NO: 22852 - DNA, 226 bp, Homo sapiens; identical to SEQ ID NO: 13155
  misc_feature 1..226: note = chr19:3880562-3880788
  misc_feature 1..226: note = hyper
  source 1..226: mol_type = genomic DNA

SEQ ID NO: 22853 - DNA, 30 bp, Homo sapiens; identical to SEQ ID NO: 13156
  misc_feature 1..30: note = chr19:3881573-3881603
  misc_feature 1..30: note = hyper
  source 1..30: mol_type = genomic DNA

SEQ ID NO: 22854 - DNA, 167 bp, Homo sapiens; identical to SEQ ID NO: 13157
  misc_feature 1..167: note = chr19:3933513-3933680
  misc_feature 1..167: note = hyper
  source 1..167: mol_type = genomic DNA

SEQ ID NO: 22855 - DNA, 138 bp, Homo sapiens; identical to SEQ ID NO: 13158
  misc_feature 1..138: note = chr19:4198030-4198168
  misc_feature 1..138: note = hyper
  source 1..138: mol_type = genomic DNA

SEQ ID NO: 22856 - DNA, 70 bp, Homo sapiens; identical to SEQ ID NO: 13159
  misc_feature 1..70: note = chr19:4304487-4304557
  misc_feature 1..70: note = hyper
  source 1..70: mol_type = genomic DNA

SEQ ID NO: 22857 - DNA, 48 bp, Homo sapiens; identical to SEQ ID NO: 13160
  misc_feature 1..48: note = chr19:5292738-5292786
  misc_feature 1..48: note = hyper
  source 1..48: mol_type = genomic DNA

SEQ ID NO: 22858 - DNA, 71 bp, Homo sapiens; identical to SEQ ID NO: 13161
  misc_feature 1..71: note = chr19:5293067-5293138
  misc_feature 1..71: note = hyper
  source 1..71: mol_type = genomic DNA

SEQ ID NO: 22859 - DNA, 27 bp, Homo sapiens
  misc_feature 1..27: note = chr19:5293155-5293182
  misc_feature 1..27: note = hyper
  source 1..27: mol_type = genomic DNA
cggctcggagatcgggcccaggccccg

SEQ ID NO: 22860 - DNA, 48 bp, Homo sapiens; identical to SEQ ID NO: 13163
  misc_feature 1..48: note = chr19:5294020-5294068
  misc_feature 1..48: note = hyper
  source 1..48: mol_type = genomic DNA

SEQ ID NO: 22861 - DNA, 30 bp, Homo sapiens; identical to SEQ ID NO: 13164
  misc_feature 1..30: note = chr19:5338746-5338776
  misc_feature 1..30: note = hyper
  source 1..30: mol_type = genomic DNA

SEQ ID NO: 22862 - DNA, 94 bp, Homo sapiens; identical to SEQ ID NO: 13166
  misc_feature 1..94: note = chr19:5340523-5340617
  misc_feature 1..94: note = hyper
  source 1..94: mol_type = genomic DNA

SEQ ID NO: 22863 - DNA, 214 bp, Homo sapiens; identical to SEQ ID NO: 13167
  misc_feature 1..214: note = chr19:5437029-5437243
  misc_feature 1..214: note = hyper
  source 1..214: mol_type = genomic DNA

SEQ ID NO: 22864 - DNA, 33 bp, Homo sapiens; identical to SEQ ID NO: 13168
  misc_feature 1..33: note = chr19:5567596-5567629
  misc_feature 1..33: note = hyper
  source 1..33: mol_type = genomic DNA

SEQ ID NO: 22865 - DNA, 225 bp, Homo sapiens; identical to SEQ ID NO: 13169
  misc_feature 1..225: note = chr19:5828090-5828315
  misc_feature 1..225: note = hyper
  source 1..225: mol_type = genomic DNA

SEQ ID NO: 22866 - DNA, 33 bp, Homo sapiens
  misc_feature 1..33: note = chr19:6590478-6590511
  misc_feature 1..33: note = hyper
  source 1..33: mol_type = genomic DNA
cccctcccccacccggagcgagtggctggggcc

SEQ ID NO: 22867 - DNA, 38 bp, Homo sapiens; identical to SEQ ID NO: 13171
  misc_feature 1..38: note = chr19:6590785-6590823
  misc_feature 1..38: note = hyper
  source 1..38: mol_type = genomic DNA

SEQ ID NO: 22868 - DNA, 103 bp, Homo sapiens
  misc_feature 1..103: note = chr19:7794909-7795012
  misc_feature 1..103: note = hyper
  source 1..103: mol_type = genomic DNA
catccaggcccccaacgatcaccaggtgcgcgctggcatctgcgcagtgatcctgcgccgccgcccacgtcgtctttggcacagagaaaaagtagcaggagcc

SEQ ID NO: 22869 - DNA, 127 bp, Homo sapiens; identical to SEQ ID NO: 13173
  misc_feature 1..127: note = chr19:7795565-7795692
  misc_feature 1..127: note = hyper
  source 1..127: mol_type = genomic DNA

SEQ ID NO: 22870 - skipped

SEQ ID NO: 22871 - DNA, 31 bp, Homo sapiens
  misc_feature 1..31: note = chr19:7852997-7853028
  misc_feature 1..31: note = hyper
  source 1..31: mol_type = genomic DNA
ggccgtttgcagtcacgcgtgtgcacatggc

SEQ ID NO: 22872 - DNA, 11 bp, Homo sapiens
  misc_feature 1..11: note = chr19:7853460-7853471
  misc_feature 1..11: note = hyper
  source 1..11: mol_type = genomic DNA
gcagacggcgg

SEQ ID NO: 22873 - DNA, 60 bp, Homo sapiens; identical to SEQ ID NO: 13177
  misc_feature 1..60: note = chr19:7853543-7853603
  misc_feature 1..60: note = hyper
  source 1..60: mol_type = genomic DNA

SEQ ID NO: 22874 - DNA, 42 bp, Homo sapiens; identical to SEQ ID NO: 13178
  misc_feature 1..42: note = chr19:7927482-7927524
  misc_feature 1..42: note = hyper
  source 1..42: mol_type = genomic DNA

SEQ ID NO: 22875 - DNA, 218 bp, Homo sapiens
  misc_feature 1..218: note = chr19:8115276-8115494
  misc_feature 1..218: note = hyper
  source 1..218: mol_type = genomic DNA
gaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctct

SEQ ID NO: 22876 - DNA, 20 bp, Homo sapiens
  misc_feature 1..20: note = chr19:9517771-9517791
  misc_feature 1..20: note = hyper
  source 1..20: mol_type = genomic DNA
gtttccaggcatgagggcaa

SEQ ID NO: 22877 - DNA, 244 bp, Homo sapiens
  misc_feature 1..244: note = chr19:9903669-9903913
  misc_feature 1..244: note = hyper
  source 1..244: mol_type = genomic DNA
gtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatgg

SEQ ID NO: 22878 - DNA, 52 bp, Homo sapiens
  misc_feature 1..52: note = chr19:10398157-10398209
  misc_feature 1..52: note = hyper
  source 1..52: mol_type = genomic DNA
tcgctctatagggagcgcccgcggacctcactcagaggctcccccttgcctt

SEQ ID NO: 22879 - DNA, 167 bp, Homo sapiens
  misc_feature 1..167: note = chr19:10398285-10398452
  misc_feature 1..167: note = hyper
  source 1..167: mol_type = genomic DNA
caggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgc

SEQ ID NO: 22880 - DNA, 30 bp, Homo sapiens; identical to SEQ ID NO: 13186
  misc_feature 1..30: note = chr19:10400448-10400478
  misc_feature 1..30: note = hyper
  source 1..30: mol_type = genomic DNA

SEQ ID NO: 22881 - DNA, 62 bp, Homo sapiens
  misc_feature 1..62: note = chr19:10406349-10406411
  misc_feature 1..62: note = hyper
  source 1..62: mol_type = genomic DNA
ggggcggccggccccgcctgcctccctctcggtcccggtagactagacggaagtgggacaga

SEQ ID NO: 22882 - DNA, 153 bp, Homo sapiens; identical to SEQ ID NO: 13191
  misc_feature 1..153: note = chr19:10531548-10531701
  misc_feature 1..153: note = hyper
  source 1..153: mol_type = genomic DNA

SEQ ID NO: 22883 - DNA, 203 bp, Homo sapiens; identical to SEQ ID NO: 13192
  misc_feature 1..203: note = chr19:10616329-10616532
  misc_feature 1..203: note = hyper
  source 1..203: mol_type = genomic DNA

SEQ ID NO: 22884 - DNA, 30 bp, Homo sapiens; identical to SEQ ID NO: 13195
  misc_feature 1..30: note = chr19:10629493-10629523
  misc_feature 1..30: note = hyper
  source 1..30: mol_type = genomic DNA

SEQ ID NO: 22885 - DNA, 72 bp, Homo sapiens; identical to SEQ ID NO: 13196
  misc_feature 1..72: note = chr19:10691925-10691997
  misc_feature 1..72: note = hyper
  source 1..72: mol_type = genomic DNA

SEQ ID NO: 22886 - DNA, 118 bp, Homo sapiens; identical to SEQ ID NO: 13197
  misc_feature 1..118: note = chr19:11529773-11529891
  misc_feature 1..118: note = hyper
  source 1..118: mol_type = genomic DNA

SEQ ID NO: 22887 - DNA, 100 bp, Homo sapiens; identical to SEQ ID NO: 13198
  misc_feature 1..100: note = chr19:11531503-11531603
  misc_feature 1..100: note = hyper
  source 1..100: mol_type = genomic DNA

SEQ ID NO: 22888 - DNA, 17 bp, Homo sapiens
  misc_feature 1..17: note = chr19:11532425-11532442
  misc_feature 1..17: note = hyper
  source 1..17: mol_type = genomic DNA
cacgaggcccagcaggt

SEQ ID NO: 22889 - DNA, 272 bp, Homo sapiens
  misc_feature 1..272: note = chr19:11592750-11593022
  misc_feature 1..272: note = hyper
  source 1..272: mol_type = genomic DNA
actggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcac

SEQ ID NO: 22890 - DNA, 136 bp, Homo sapiens
  misc_feature 1..136: note = chr19:11593159-11593295
  misc_feature 1..136: note = hyper
  source 1..136: mol_type = genomic DNA
gcgatggtctgttccccaccccgtgttcctcccggtttccgtcatcggaaactgagctaggaggggggctgctcctgggcgcgcggaccccgctgcggttcccatggaaacctgccggctccggcagtgcggggag

SEQ ID NO: 22891 - DNA, 58 bp, Homo sapiens
  misc_feature 1..58: note = chr19:11689402-11689460
  misc_feature 1..58: note = hyper
  source 1..58: mol_type = genomic DNA
cctgcctgcctcctccgtgctgggcgccgccgcgacacgtcccgcggacattcaggag

SEQ ID NO: 22892 - DNA, 45 bp, Homo sapiens; identical to SEQ ID NO: 13203
  misc_feature 1..45: note = chr19:11909467-11909512
  misc_feature 1..45: note = hyper
  source 1..45: mol_type = genomic DNA

SEQ ID NO: 22893 - DNA, 30 bp, Homo sapiens; identical to SEQ ID NO: 13204
  misc_feature 1..30: note = chr19:11909854-11909884
  misc_feature 1..30: note = hyper
  source 1..30: mol_type = genomic DNA

SEQ ID NO: 22894 - DNA, 30 bp, Homo sapiens; identical to SEQ ID NO: 13205
  misc_feature 1..30: note = chr19:11959427-11959457
  misc_feature 1..30: note = hyper
  source 1..30: mol_type = genomic DNA

SEQ ID NO: 22895 - DNA, 97 bp, Homo sapiens; identical to SEQ ID NO: 4587
  misc_feature 1..97: note = chr19:11959663-11959760
  misc_feature 1..97: note = hyper
  source 1..97: mol_type = genomic DNA

SEQ ID NO: 22896 - DNA, 151 bp, Homo sapiens
  misc_feature 1..151: note = chr19:11959761-11959912
  misc_feature 1..151: note = hyper
  source 1..151: mol_type = genomic DNA
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggact

SEQ ID NO: 22897 - DNA, 314 bp, Homo sapiens; identical to SEQ ID NO: 13208
  misc_feature 1..314: note = chr19:11998761-11999075
  misc_feature 1..314: note = hyper
  source 1..314: mol_type = genomic DNA

SEQ ID NO: 22898 - DNA, 62 bp, Homo sapiens; identical to SEQ ID NO: 13209
  misc_feature 1..62: note = chr19:12075756-12075818
  misc_feature 1..62: note = hyper
  source 1..62: mol_type = genomic DNA

SEQ ID NO: 22899 - DNA, 117 bp, Homo sapiens; identical to SEQ ID NO: 13210
  misc_feature 1..117: note = chr19:12076262-12076379
  misc_feature 1..117: note = hyper
  source 1..117: mol_type = genomic DNA

SEQ ID NO: 22900 - DNA, 160 bp, Homo sapiens; identical to SEQ ID NO: 13211
  misc_feature 1..160: note = chr19:12146813-12146973
  misc_feature 1..160: note = hyper
  source 1..160: mol_type = genomic DNA

SEQ ID NO: 22901 - DNA, 16 bp, Homo sapiens
  misc_feature 1..16: note = chr19:12163328-12163344
  misc_feature 1..16: note = hyper
  source 1..16: mol_type = genomic DNA
cacaatctggggagac

SEQ ID NO: 22902 - DNA, 310 bp, Homo sapiens
  misc_feature 1..310: note = chr19:12175504-12175814
  misc_feature 1..310: note = hyper
  source 1..310: mol_type = genomic DNA
cggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctgggg

SEQ ID NO: 22903 - DNA, 15 bp, Homo sapiens
  misc_feature 1..15: note = chr19:12203013-12203028
  misc_feature 1..15: note = hyper
  source 1..15: mol_type = genomic DNA
tcagggctctgaagg

SEQ ID NO: 22904 - DNA, 121 bp, Homo sapiens
  misc_feature 1..121: note = chr19:12750866-12750987
  misc_feature 1..121: note = hyper
  source 1..121: mol_type = genomic DNA
tactccgctcacctgcgacggcagcagccagtccccacgggcggaggggacctcatgcgacattcagcccgcgagattctcagagactgctcgcccgcaacacgcagtaacgatctcagga

SEQ ID NO: 22905 - DNA, 54 bp, Homo sapiens
  misc_feature 1..54: note = chr19:12751056-12751110
  misc_feature 1..54: note = hyper
  source 1..54: mol_type = genomic DNA
ctctcttgcggtttgcagccagatcacttcccatacacgcggcagccaagctca

SEQ ID NO: 22906 - DNA, 147 bp, Homo sapiens; identical to SEQ ID NO: 13220
  misc_feature 1..147: note = chr19:12936457-12936604
  misc_feature 1..147: note = hyper
  source 1..147: mol_type = genomic DNA

SEQ ID NO: 22907 - DNA, 209 bp, Homo sapiens
  misc_feature 1..209: note = chr19:13617256-13617465
  misc_feature 1..209: note = hyper
  source 1..209: mol_type = genomic DNA
atagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaa

SEQ ID NO: 22908 - DNA, 29 bp, Homo sapiens
  misc_feature 1..29: note = chr19:13617489-13617518
  misc_feature 1..29: note = hyper
  source 1..29: mol_type = genomic DNA
cggtttgcaaaggacgccccccccgggac

SEQ ID NO: 22909 - DNA, 30 bp, Homo sapiens; identical to SEQ ID NO: 13226
  misc_feature 1..30: note = chr19:13617846-13617876
  misc_feature 1..30: note = hyper
  source 1..30: mol_type = genomic DNA

SEQ ID NO: 22910 - DNA, 29 bp, Homo sapiens
  misc_feature 1..29: note = chr19:13618381-13618410
  misc_feature 1..29: note = hyper
  source 1..29: mol_type = genomic DNA
agagaggggagcgtcgcatggttgggagg

SEQ ID NO: 22911 - DNA, 340 bp, Homo sapiens; identical to SEQ ID NO: 13228
  misc_feature 1..340: note = chr19:14320312-14320652
  misc_feature 1..340: note = hyper
  source 1..340: mol_type = genomic DNA

SEQ ID NO: 22912 - DNA, 135 bp, Homo sapiens; identical to SEQ ID NO: 13229
  misc_feature 1..135: note = chr19:14583381-14583516
  misc_feature 1..135: note = hyper
  source 1..135: mol_type = genomic DNA

SEQ ID NO: 22913 - DNA, 107 bp, Homo sapiens; identical to SEQ ID NO: 13230
  misc_feature 1..107: note = chr19:14583613-14583720
  misc_feature 1..107: note = hyper
  source 1..107: mol_type = genomic DNA

SEQ ID NO: 22914 - DNA, 15 bp, Homo sapiens
  misc_feature 1..15: note = chr19:14886822-14886837
  misc_feature 1..15: note = hyper
  source 1..15: mol_type = genomic DNA
cgggcgcccctccca

SEQ ID NO: 22915 - DNA, 97 bp, Homo sapiens
  misc_feature 1..97: note = chr19:15090075-15090172
  misc_feature 1..97: note = hyper
  source 1..97: mol_type = genomic DNA
acgggcagggagacccggggataactaaggggataggaaactcaccagaacgaccaggagaaaagcggtggcaacggctctaaggggcaagcaggag

SEQ ID NO: 22916 - DNA, 53 bp, Homo sapiens
  misc_feature 1..53: note = chr19:15090499-15090552
  misc_feature 1..53: note = hyper
  source 1..53: mol_type = genomic DNA
ctatgctgcgggagggatccgggccggccctgcgctcacgtgggtgtgggggc

SEQ ID NO: 22917 - DNA, 66 bp, Homo sapiens; identical to SEQ ID NO: 13235
  misc_feature 1..66: note = chr19:15090784-15090850
  misc_feature 1..66: note = hyper
  source 1..66: mol_type = genomic DNA

SEQ ID NO: 22918 - DNA, 27 bp, Homo sapiens
  misc_feature 1..27: note = chr19:15288856-15288883
  misc_feature 1..27: note = hyper
  source 1..27: mol_type = genomic DNA
ccggcaggagcgcgccacccgctcgca

SEQ ID NO: 22919 - DNA, 72 bp, Homo sapiens; identical to SEQ ID NO: 13238
  misc_feature 1..72: note = chr19:15333743-15333815
  misc_feature 1..72: note = hyper
  source 1..72: mol_type = genomic DNA

SEQ ID NO: 22920 - DNA, 34 bp, Homo sapiens; identical to SEQ ID NO: 13239
  misc_feature 1..34: note = chr19:15334731-15334765
  misc_feature 1..34: note = hyper
  source 1..34: mol_type = genomic DNA

SEQ ID NO: 22921 - DNA, 147 bp, Homo sapiens
  misc_feature 1..147: note = chr19:15342587-15342734
  misc_feature 1..147: note = hyper
  source 1..147: mol_type = genomic DNA
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcg

SEQ ID NO: 22922 - DNA, 127 bp, Homo sapiens
  misc_feature 1..127: note = chr19:15343980-15344107
  misc_feature 1..127: note = hyper
  source 1..127: mol_type = genomic DNA
caatgggcaatgagacggagggcggggccgggacctaatatggcgggtcaggagggtctggaagacgaagaagagggacaggcaatgccaggtctaggactaggagggaggcgcgggcggtattagc

SEQ ID NO: 22923 - DNA, 208 bp, Homo sapiens; identical to SEQ ID NO: 13242
  misc_feature 1..208: note = chr19:15619208-15619416
  misc_feature 1..208: note = hyper
  source 1..208: mol_type = genomic DNA

SEQ ID NO: 22924 - DNA, 237 bp, Homo sapiens; identical to SEQ ID NO: 13243
  misc_feature 1..237: note = chr19:15695292-15695529
  misc_feature 1..237: note = hyper
  source 1..237: mol_type = genomic DNA

SEQ ID NO: 22925 - DNA, 131 bp, Homo sapiens
  misc_feature 1..131: note = chr19:17007662-17007793
  misc_feature 1..131: note = hyper
  source 1..131: mol_type = genomic DNA
aatacttacaaaaacagaaacagacttttaaaaagcggttgtaggagagaaaggagacagggcgtcctgtctgggccgccctgcaacaacagccccgtcccctgccgcgcctcctccgcactgaccacacc

SEQ ID NO: 22926 - DNA, 44 bp, Homo sapiens; identical to SEQ ID NO: 4602
  misc_feature 1..44: note = chr19:17008475-17008519
  misc_feature 1..44: note = hyper
  source 1..44: mol_type = genomic DNA

SEQ ID NO: 22927 - DNA, 276 bp, Homo sapiens; identical to SEQ ID NO: 13248
  misc_feature 1..276: note = chr19:17137083-17137359
  misc_feature 1..276: note = hyper
  source 1..276: mol_type = genomic DNA

SEQ ID NO: 22928 - DNA, 18 bp, Homo sapiens
  misc_feature 1..18: note = chr19:17137395-17137413
  misc_feature 1..18: note = hyper
  source 1..18: mol_type = genomic DNA
cgccgacagcagcaggag

SEQ ID NO: 22929 - DNA, 169 bp, Homo sapiens; identical to SEQ ID NO: 13250
  misc_feature 1..169: note = chr19:17392904-17393073
  misc_feature 1..169: note = hyper
  source 1..169: mol_type = genomic DNA

SEQ ID NO: 22930 - DNA, 398 bp, Homo sapiens; identical to SEQ ID NO: 4604
  misc_feature 1..398: note = chr19:17501241-17501639
  misc_feature 1..398: note = hyper
  source 1..398: mol_type = genomic DNA

SEQ ID NO: 22931 - DNA, 131 bp, Homo sapiens; identical to SEQ ID NO: 13252
  misc_feature 1..131: note = chr19:17717050-17717181
  misc_feature 1..131: note = hyper
  source 1..131: mol_type = genomic DNA

SEQ ID NO: 22932 - DNA, 104 bp, Homo sapiens; identical to SEQ ID NO: 13253
  misc_feature 1..104: note = chr19:17717404-17717508
  misc_feature 1..104: note = hyper
  source 1..104: mol_type = genomic DNA

SEQ ID NO: 22933 - DNA, 149 bp, Homo sapiens; identical to SEQ ID NO: 13255
  misc_feature 1..149: note = chr19:17983002-17983151
  misc_feature 1..149: note = hyper
  source 1..149: mol_type = genomic DNA

SEQ ID NO: 22934 - DNA, 63 bp, Homo sapiens
  misc_feature 1..63: note = chr19:17983474-17983537
  misc_feature 1..63: note = hyper
  source 1..63: mol_type = genomic DNA
gcacctacgaggtaccggacagaggcccgggggtaggacctgccccactggcagtgctgggac

SEQ ID NO: 22935 - DNA, 41 bp, Homo sapiens; identical to SEQ ID NO: 13257
  misc_feature 1..41: note = chr19:18077737-18077778
  misc_feature 1..41: note = hyper
  source 1..41: mol_type = genomic DNA

SEQ ID NO: 22936 - DNA, 39 bp, Homo sapiens; identical to SEQ ID NO: 13258
  misc_feature 1..39: note = chr19:18078233-18078272
  misc_feature 1..39: note = hyper
  source 1..39: mol_type = genomic DNA

SEQ ID NO: 22937 - DNA, 241 bp, Homo sapiens
  misc_feature 1..241: note = chr19:18343569-18343810
  misc_feature 1..241: note = hyper
  source 1..241: mol_type = genomic DNA
acaagccatgatgacaccagcaccctcagctccacccctacgtagaaatagctttttccttccaggcgccagcctcaaccaagcagcagagacccccgccccctggagaagcaaggaccctcccccactcccgccaggccccgcgcgcccctcccccgcgctgcaggaggcccctgccccggccacctaccgcctgcaggaggaaacgggccaggagagccgcgacttcctgagctccggc

SEQ ID NO: 22938 - DNA, 42 bp, Homo sapiens
  misc_feature 1..42: note = chr19:18343879-18343921
  misc_feature 1..42: note = hyper
  source 1..42: mol_type = genomic DNA
cggatggggcgccggggttgccgccacaggtgcttcggggct

SEQ ID NO: 22939 - DNA, 11 bp, Homo sapiens
  misc_feature 1..11: note = chr19:18715071-18715082
  misc_feature 1..11: note = hyper
  source 1..11: mol_type = genomic DNA
gcgggggacac

SEQ ID NO: 22940 - skipped

SEQ ID NO: 22941 - DNA, 112 bp, Homo sapiens; identical to SEQ ID NO: 13264
  misc_feature 1..112: note = chr19:18899103-18899215
  misc_feature 1..112: note = hyper
  source 1..112: mol_type = genomic DNA

SEQ ID NO: 22942 - DNA, 30 bp, Homo sapiens; identical to SEQ ID NO: 13265
  misc_feature 1..30: note = chr19:18900810-18900840
  misc_feature 1..30: note = hyper
  source 1..30: mol_type = genomic DNA

SEQ ID NO: 22943 - DNA, 225 bp, Homo sapiens
  misc_feature 1..225: note = chr19:18901603-18901828
  misc_feature 1..225: note = hyper
  source 1..225: mol_type = genomic DNA
actgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacct

SEQ ID NO: 22944 - DNA, 114 bp, Homo sapiens
  misc_feature 1..114: note = chr19:18902095-18902209
  misc_feature 1..114: note = hyper
  source 1..114: mol_type = genomic DNA
gggtggctgctcgctttctaccgcccacgaggcccgcggggcctatttatccccaaggcacggccggccccagggacggcccaccacagccctgcccaacgtccagcctcaagg

SEQ ID NO: 22945 - DNA, 30 bp, Homo sapiens; identical to SEQ ID NO: 13267
  misc_feature 1..30: note = chr19:19006120-19006150
  misc_feature 1..30: note = hyper
  source 1..30: mol_type = genomic DNA

SEQ ID NO: 22946 - DNA, 131 bp, Homo sapiens; identical to SEQ ID NO: 13268
  misc_feature 1..131: note = chr19:19006691-19006822
  misc_feature 1..131: note = hyper
  source 1..131: mol_type = genomic DNA

SEQ ID NO: 22947 - DNA, 50 bp, Homo sapiens; identical to SEQ ID NO: 13269
  misc_feature 1..50: note = chr19:19322879-19322929
  misc_feature 1..50: note = hyper
  source 1..50: mol_type = genomic DNA

SEQ ID NO: 22948 - DNA, 54 bp, Homo sapiens; identical to SEQ ID NO: 13270
  misc_feature 1..54: note = chr19:19649100-19649154
  misc_feature 1..54: note = hyper
  source 1..54: mol_type = genomic DNA

SEQ ID NO: 22949 - DNA, 336 bp, Homo sapiens; identical to SEQ ID NO: 4606
  misc_feature 1..336: note = chr19:19651512-19651848
  misc_feature 1..336: note = hyper
  source 1..336: mol_type = genomic DNA

SEQ ID NO: 22950 - DNA, 30 bp, Homo sapiens; identical to SEQ ID NO: 13273
  misc_feature 1..30: note = chr19:19932203-19932233
  misc_feature 1..30: note = hyper
  source 1..30: mol_type = genomic DNA

SEQ ID NO: 22951 - DNA, 29 bp, Homo sapiens
  misc_feature 1..29: note = chr19:19932565-19932594
  misc_feature 1..29: note = hyper
  source 1..29: mol_type = genomic DNA
gccaaagccggaagccggaaaccgtcctg

SEQ ID NO: 22952 - skipped

SEQ ID NO: 22953 - DNA, 408 bp, Homo sapiens; identical to SEQ ID NO: 13276
  misc_feature 1..408: note = chr19:20149780-20150188
  misc_feature 1..408: note = hyper
  source 1..408: mol_type = genomic DNA

SEQ ID NO: 22954 - DNA, 148 bp, Homo sapiens; identical to SEQ ID NO: 13277
  misc_feature 1..148: note = chr19:20162757-20162905
  misc_feature 1..148: note = hyper
  source 1..148: mol_type = genomic DNA

SEQ ID NO: 22955 - DNA, 388 bp, Homo sapiens; identical to SEQ ID NO: 13278
  misc_feature 1..388: note = chr19:20162906-20163294
  misc_feature 1..388: note = hyper
  source 1..388: mol_type = genomic DNA

SEQ ID NO: 22956 - DNA, 30 bp, Homo sapiens; identical to SEQ ID NO: 13279
  misc_feature 1..30: note = chr19:20188913-20188943
  misc_feature 1..30: note = hyper
  source 1..30: mol_type = genomic DNA

SEQ ID NO: 22957 - DNA, 103 bp, Homo sapiens
  misc_feature 1..103: note = chr19:22018420-22018523
  misc_feature 1..103: note = hyper
  source 1..103: mol_type = genomic DNA
tgctgggattaaaggcgtgacccaccgcgcccggccgactctcctgtttctaatagaccaaaagagggactagaaatgccacggaccaaagctcttcctattc

SEQ ID NO: 22958 - DNA, 58 bp, Homo sapiens; identical to SEQ ID NO: 4609
  misc_feature 1..58: note = chr19:22018900-22018958
  misc_feature 1..58: note = hyper
  source 1..58: mol_type = genomic DNA

SEQ ID NO: 22959 - DNA, 61 bp, Homo sapiens; identical to SEQ ID NO: 4610
  misc_feature 1..61: note = chr19:22018959-22019020
  misc_feature 1..61: note = hyper
  source 1..61: mol_type = genomic DNA

SEQ ID NO: 22960 - DNA, 28 bp, Homo sapiens
  misc_feature 1..28: note = chr19:22019080-22019108
  misc_feature 1..28: note = hyper
  source 1..28: mol_type = genomic DNA
aaggtcctgcccccgcaaaccctgaatg

SEQ ID NO: 22961 - DNA, 225 bp, Homo sapiens
  misc_feature 1..225: note = chr19:22034813-22035038
  misc_feature 1..225: note = hyper
  source 1..225: mol_type = genomic DNA
tggagaacgcggaaaagcagaggcgggtcccaaggtctagcgggagctggagacaaaggccccgccaaaagccggaagccacggccccctctccaactgcgcgtctgattgggtggttcccacgccagcgccactgattggataaagctccaggacccaccctccctagcgtttgcgcattttatggacagggaaacaggctcaagtaggcggggcacatgccca

SEQ ID NO: 22962 - DNA, 167 bp, Homo sapiens
  misc_feature 1..167: note = chr19:22715443-22715610
  misc_feature 1..167: note = hyper
  source 1..167: mol_type = genomic DNA
tgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagag

SEQ ID NO: 22963 - skipped

SEQ ID NO: 22964 - DNA, 31 bp, Homo sapiens
  misc_feature 1..31: note = chr19:23254158-23254189
  misc_feature 1..31: note = hyper
  source 1..31: mol_type = genomic DNA
ttcagctgaaggctgcgggccttcccgagct

SEQ ID NO: 22965 - skipped

SEQ ID NO: 22966 - DNA, 37 bp, Homo sapiens
  misc_feature 1..37: note = chr19:23258694-23258731
  misc_feature 1..37: note = hyper
  source 1..37: mol_type = genomic DNA
attaatttataagaaatgcattcgagttgggttttag

SEQ ID NO: 22967 - DNA, 36 bp, Homo sapiens
  misc_feature 1..36: note = chr19:23299712-23299748
  misc_feature 1..36: note = hyper
  source 1..36: mol_type = genomic DNA
cagggcctgagggggcggggccttaaacgttatcca

SEQ ID NO: 22968 - DNA, 16 bp, Homo sapiens
  misc_feature 1..16: note = chr19:23300338-23300354
  misc_feature 1..16: note = hyper
  source 1..16: mol_type = genomic DNA
gcgttcccaattcctc

SEQ ID NO: 22969 - DNA, 30 bp, Homo sapiens; identical to SEQ ID NO: 13295
  misc_feature 1..30: note = chr19:23386702-23386732
  misc_feature 1..30: note = hyper
  source 1..30: mol_type = genomic DNA

SEQ ID NO: 22970 - DNA, 38 bp, Homo sapiens; identical to SEQ ID NO: 13296
  misc_feature 1..38: note = chr19:23598448-23598486
  misc_feature 1..38: note = hyper
  source 1..38: mol_type = genomic DNA

SEQ ID NO: 22971 - DNA, 30 bp, Homo sapiens; identical to SEQ ID NO: 13297
  misc_feature 1..30: note = chr19:23598726-23598756
  misc_feature 1..30: note = hyper
  source 1..30: mol_type = genomic DNA

SEQ ID NO: 22972 - DNA, 86 bp, Homo sapiens; identical to SEQ ID NO: 13298
  misc_feature 1..86: note = chr19:23654103-23654189
  misc_feature 1..86: note = hyper
  source 1..86: mol_type = genomic DNA

SEQ ID NO: 22973 - DNA, 362 bp, Homo sapiens
  misc_feature 1..362: note = chr19:30015572-30015934
  misc_feature 1..362: note = hyper
  source 1..362: mol_type = genomic DNA
ctcctgggccatagacgaggaaactgaaaggcaggcactggaggcaagaagggctggccccgggcacccgctggcgaggacagccttggagagggcctgcagctcctcccctctgagctgtgctgcgctggccgcctggaccagggtggctgctggagagtgttttccctctgggtttccttctccttggctcccagggaatcctctggcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagat

SEQ ID NO: 22974 - DNA, 36 bp, Homo sapiens
  misc_feature 1..36: note = chr19:30016712-30016748
  misc_feature 1..36: note = hyper
  source 1..36: mol_type = genomic DNA
gctgtactccaaccagaaagacggtggtccctccga

SEQ ID NO: 22975 - DNA, 124 bp, Homo sapiens
  misc_feature 1..124: note = chr19:30018608-30018732
  misc_feature 1..124: note = hyper
  source 1..124: mol_type = genomic DNA
tgctgggtagtgaaggaagcccccttggtcccatcaggctctccccgccctctgccactttgaggaccccagggctcccacggctgcgttccagaggccaccagaaaaccgagtaccggaaagc

SEQ ID NO: 22976 - DNA, 32 bp, Homo sapiens
  misc_feature 1..32: note = chr19:30019113-30019145
  misc_feature 1..32: note = hyper
  source 1..32: mol_type = genomic DNA
accagggcagccacccgttggtcaggcaccat

SEQ ID NO: 22977 - DNA, 74 bp, Homo sapiens
  misc_feature 1..74: note = chr19:30019838-30019912
  misc_feature 1..74: note = hyper
  source 1..74: mol_type = genomic DNA
ggtgttgcaggcttgcaggggacggggtagggggtggttgtgccaggctgcgaggggcccgggtcatggggttg

SEQ ID NO: 22978 - DNA, 103 bp, Homo sapiens; identical to SEQ ID NO: 13308
  misc_feature 1..103: note = chr19:30021252-30021355
  misc_feature 1..103: note = hyper
  source 1..103: mol_type = genomic DNA

SEQ ID NO: 22979 - DNA, 339 bp, Homo sapiens; identical to SEQ ID NO: 13309
  misc_feature 1..339: note = chr19:30215072-30215411
  misc_feature 1..339: note = hyper
  source 1..339: mol_type = genomic DNA

SEQ ID NO: 22980 - DNA, 22 bp, Homo sapiens
  misc_feature 1..22: note = chr19:30713458-30713480
  misc_feature 1..22: note = hyper
  source 1..22: mol_type = genomic DNA
gaggcatgcagagggcgtcggc

SEQ ID NO: 22981 - DNA, 102 bp, Homo sapiens
  misc_feature 1..102: note = chr19:30713706-30713808
  misc_feature 1..102: note = hyper
  source 1..102: mol_type = genomic DNA
cctccaggcctggaaggggctcccctggcctggaggccatgggcccggcccagaccggccagacaccgccagggacccccagaacgacgccaggacgcgcgc

SEQ ID NO: 22982 - skipped

SEQ ID NO: 22983 - DNA, 103 bp, Homo sapiens
  misc_feature 1..103: note = chr19:30715766-30715869
  misc_feature 1..103: note = hyper
  source 1..103: mol_type = genomic DNA
ttttttttttttttcctcccagaaaagaaacagactttaaatagtttcaggagcaggtaagaattacgctttttcctcgccccttctccgtctctctctcctc

SEQ ID NO: 22984 - DNA, 194 bp, Homo sapiens
  misc_feature 1..194: note = chr19:30716576-30716770
  misc_feature 1..194: note = hyper
  source 1..194: mol_type = genomic DNA
ggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 22985 - DNA, 626 bp, Homo sapiens
  misc_feature 1..626: note = chr19:30718149-30718775
  misc_feature 1..626: note = hyper
  source 1..626: mol_type = genomic DNA
tggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcg

SEQ ID NO: 22986 - DNA, 166 bp, Homo sapiens
  misc_feature 1..166: note = chr19:30719283-30719449
  misc_feature 1..166: note = hyper
  source 1..166: mol_type = genomic DNA
tagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatc

SEQ ID NO: 22987 - DNA, 18 bp, Homo sapiens
  misc_feature 1..18: note = chr19:30865695-30865713
  misc_feature 1..18: note = hyper
  source 1..18: mol_type = genomic DNA
gaggccacccccagccgg

SEQ ID NO: 22988 - DNA, 55 bp, Homo sapiens
  misc_feature 1..55: note = chr19:31839873-31839928
  misc_feature 1..55: note = hyper
  source 1..55: mol_type = genomic DNA
gtgcgagagggaagagggcagagcgcggcggggcgtccggggggcgcccggtacc

SEQ ID NO: 22989 - DNA, 102 bp, Homo sapiens; identical to SEQ ID NO: 13319
  misc_feature 1..102: note = chr19:31839941-31840043
  misc_feature 1..102: note = hyper
  source 1..102: mol_type = genomic DNA

SEQ ID NO: 22990 - DNA, 30 bp, Homo sapiens; identical to SEQ ID NO: 13320
  misc_feature 1..30: note = chr19:31840866-31840896
  misc_feature 1..30: note = hyper
  source 1..30: mol_type = genomic DNA

SEQ ID NO: 22991 - DNA, 37 bp, Homo sapiens; identical to SEQ ID NO: 13321
  misc_feature 1..37: note = chr19:31841109-31841146
  misc_feature 1..37: note = hyper
  source 1..37: mol_type = genomic DNA

SEQ ID NO: 22992 - DNA, 30 bp, Homo sapiens; identical to SEQ ID NO: 13322
  misc_feature 1..30: note = chr19:31841471-31841501
  misc_feature 1..30: note = hyper
  source 1..30: mol_type = genomic DNA

SEQ ID NO: 22993 - DNA, 92 bp, Homo sapiens
  misc_feature 1..92: note = chr19:31842389-31842481
  misc_feature 1..92: note = hyper
  source 1..92: mol_type = genomic DNA
cggggctctcgggctggcggactcgggggctgaggcgccgtgcgcgttgggtgcccgcggccgcagaggccagaaccgctactcctccaggc

SEQ ID NO: 22994 - DNA, 78 bp, Homo sapiens
  misc_feature 1..78: note = chr19:32715595-32715673
  misc_feature 1..78: note = hyper
  source 1..78: mol_type = genomic DNA
taaatatgttcattccgctcttgcgatcggtgataaaccggaggcggccgaggccgacagaggtcagcaggccgctcg

SEQ ID NO: 22995 - DNA, 128 bp, Homo sapiens
  misc_feature 1..128: note = chr19:33166988-33167116
  misc_feature 1..128: note = hyper
  source 1..128: mol_type = genomic DNA
cgcacgtcgagggtcccgggcgggctccgtggacgttggcggtagcgccgagcgagtcacggaccatgaagagcgttcgtgccgcgcggcccaaggccgggatgggggttagccacatcctgccgcgc

SEQ ID NO: 22996 - DNA, 90 bp, Homo sapiens
  misc_feature 1..90: note = chr19:34112434-34112524
  misc_feature 1..90: note = hyper
  source 1..90: mol_type = genomic DNA
gctgtggtcaaggcccgccccggtgacgcctggtccttttcccgggttggcgccgcgtgcgacccaccgaggcagtggcagcactggccg

SEQ ID NO: 22997 - DNA, 15 bp, Homo sapiens
  misc_feature 1..15: note = chr19:34113288-34113303
  misc_feature 1..15: note = hyper
  source 1..15: mol_type = genomic DNA
ggccccggactgcac

SEQ ID NO: 22998 - DNA, 33 bp, Homo sapiens; identical to SEQ ID NO: 13328
  misc_feature 1..33: note = chr19:34113879-34113912
  misc_feature 1..33: note = hyper
  source 1..33: mol_type = genomic DNA

SEQ ID NO: 22999 - DNA, 66 bp, Homo sapiens; identical to SEQ ID NO: 13329
  misc_feature 1..66: note = chr19:34288609-34288675
  misc_feature 1..66: note = hyper
  source 1..66: mol_type = genomic DNA

SEQ ID NO: 23000 - DNA, 30 bp, Homo sapiens; identical to SEQ ID NO: 13331
  misc_feature 1..30: note = chr19:35068705-35068735
  misc_feature 1..30: note = hyper
  source 1..30: mol_type = genomic DNA

SEQ ID NO: 23001 - DNA, 151 bp, Homo sapiens; identical to SEQ ID NO: 13332
  misc_feature 1..151: note = chr19:35263633-35263784
  misc_feature 1..151: note = hyper
  source 1..151: mol_type = genomic DNA

SEQ ID NO: 23002 - DNA, 71 bp, Homo sapiens
  misc_feature 1..71: note = chr19:35396370-35396441
  misc_feature 1..71: note = hyper
  source 1..71: mol_type = genomic DNA
cctagctagacaagtgcttctcacgatccagcgcgtttaccgctcggtttcgtcgccgctaaggggtggtg

SEQ ID NO: 23003 - DNA, 126 bp, Homo sapiens; identical to SEQ ID NO: 13334
  misc_feature 1..126: note = chr19:35531737-35531863
  misc_feature 1..126: note = hyper
  source 1..126: mol_type = genomic DNA

SEQ ID NO: 23004 - DNA, 15 bp, Homo sapiens
  misc_feature 1..15: note = chr19:36048580-36048595
  misc_feature 1..15: note = hyper
  source 1..15: mol_type = genomic DNA
ccaggctgaggtagg

SEQ ID NO: 23005 - DNA, 316 bp, Homo sapiens
  misc_feature 1..316: note = chr19:36048771-36049087
  misc_feature 1..316: note = hyper
  source 1..316: mol_type = genomic DNA
aggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtg

SEQ ID NO: 23006 - DNA, 57 bp, Homo sapiens
  misc_feature 1..57: note = chr19:36335147-36335204
  misc_feature 1..57: note = hyper
  source 1..57: mol_type = genomic DNA
ggggaaggccagaataagggacctggcaggacctcccatccccgggacccctcccca

SEQ ID NO: 23007 - DNA, 53 bp, Homo sapiens; identical to SEQ ID NO: 13337
  misc_feature 1..53: note = chr19:36337032-36337085
  misc_feature 1..53: note = hyper
  source 1..53: mol_type = genomic DNA

SEQ ID NO: 23008 - DNA, 30 bp, Homo sapiens; identical to SEQ ID NO: 13338
  misc_feature 1..30: note = chr19:36347846-36347876
  misc_feature 1..30: note = hyper
  source 1..30: mol_type = genomic DNA

SEQ ID NO: 23009 - DNA, 43 bp, Homo sapiens; identical to SEQ ID NO: 13339
  misc_feature 1..43: note = chr19:36351905-36351948
  misc_feature 1..43: note = hyper
  source 1..43: mol_type = genomic DNA

SEQ ID NO: 23010 - DNA, 30 bp, Homo sapiens; identical to SEQ ID NO: 13340
  misc_feature 1..30: note = chr19:36361080-36361110
  misc_feature 1..30: note = hyper
  source 1..30: mol_type = genomic DNA

SEQ ID NO: 23011 - DNA, 15 bp, Homo sapiens
  misc_feature 1..15: note = chr19:36450544-36450559
  misc_feature 1..15: note = hyper
  source 1..15: mol_type = genomic DNA
cgccccagggtcgct

SEQ ID NO: 23012 - DNA, 93 bp, Homo sapiens; identical to SEQ ID NO: 13344
  misc_feature 1..93: note = chr19:36523623-36523716
  misc_feature 1..93: note = hyper
  source 1..93: mol_type = genomic DNA

SEQ ID NO: 23013 - DNA, 82 bp, Homo sapiens
  misc_feature 1..82: note = chr19:36822242-36822324
  misc_feature 1..82: note = hyper
  source 1..82: mol_type = genomic DNA
ataaacctcaacctgcgggtcactccctcccaggcgtgcaacaaaacacctgcctagaaatcaaaaggcgttttacccgagt

SEQ ID NO: 23014 - DNA, 15 bp, Homo sapiens
  misc_feature 1..15: note = chr19:36912335-36912350
  misc_feature 1..15: note = hyper
  source 1..15: mol_type = genomic DNA
ggcaccaggggacgc

SEQ ID NO: 23015 - DNA, 15 bp, Homo sapiens
  misc_feature 1..15: note = chr19:36912480-36912495
  misc_feature 1..15: note = hyper
  source 1..15: mol_type = genomic DNA
cgagacaagccggtg

SEQ ID NO: 23016 - DNA, 560 bp, Homo sapiens; identical to SEQ ID NO: 13353
  misc_feature 1..560: note = chr19:37157617-37158177
  misc_feature 1..560: note = hyper
  source 1..560: mol_type = genomic DNA

SEQ ID NO: 23017 - DNA, 66 bp, Homo sapiens; identical to SEQ ID NO: 13354
  misc_feature 1..66: note = chr19:37263373-37263439
  misc_feature 1..66: note = hyper
  source 1..66: mol_type = genomic DNA

SEQ ID NO: 23018 - DNA, 37 bp, Homo sapiens; identical to SEQ ID NO: 13355
  misc_feature 1..37: note = chr19:37263751-37263788
  misc_feature 1..37: note = hyper
  source 1..37: mol_type = genomic DNA

SEQ ID NO: 23019 - DNA, 25 bp, Homo sapiens
  misc_feature 1..25: note = chr19:37287936-37287961
  misc_feature 1..25: note = hyper
  source 1..25: mol_type = genomic DNA
tttgttttttgaaaccgagtttcgc

SEQ ID NO: 23020 - DNA, 112 bp, Homo sapiens; identical to SEQ ID NO: 13361
  misc_feature 1..112: note = chr19:37329256-37329368
  misc_feature 1..112: note = hyper
  source 1..112: mol_type = genomic DNA

SEQ ID NO: 23021 - DNA, 32 bp, Homo sapiens; identical to SEQ ID NO: 13362
  misc_feature 1..32: note = chr19:37342101-37342133
  misc_feature 1..32: note = hyper
  source 1..32: mol_type = genomic DNA

SEQ ID NO: 23022 - DNA, 108 bp, Homo sapiens; identical to SEQ ID NO: 4652
  misc_feature 1..108: note = chr19:37406765-37406873
  misc_feature 1..108: note = hyper
  source 1..108: mol_type = genomic DNA

SEQ ID NO: 23023 - DNA, 46 bp, Homo sapiens
  misc_feature 1..46: note = chr19:37407081-37407127
  misc_feature 1..46: note = hyper
  source 1..46: mol_type = genomic DNA
catccagccgagcctcggagttgcgggtcgccgtagcgctgcgcaa

SEQ ID NO: 23024 - DNA, 31 bp, Homo sapiens
  misc_feature 1..31: note = chr19:37464696-37464727
  misc_feature 1..31: note = hyper
  source 1..31: mol_type = genomic DNA
gaggcctgggagggggcgggacaccctcgct

SEQ ID NO: 23025 - DNA, 809 bp, Homo sapiens; identical to SEQ ID NO: 13369
  misc_feature 1..809: note = chr19:37957671-37958480
  misc_feature 1..809: note = hyper
  source 1..809: mol_type = genomic DNA

SEQ ID NO: 23026 - DNA, 542 bp, Homo sapiens
  misc_feature 1..542: note = chr19:37959963-37960505
  misc_feature 1..542: note = hyper
  source 1..542: mol_type = genomic DNA
acttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccac

SEQ ID NO: 23027 - DNA, 35 bp, Homo sapiens; identical to SEQ ID NO: 13374
  misc_feature 1..35: note = chr19:38146647-38146682
  misc_feature 1..35: note = hyper
  source 1..35: mol_type = genomic DNA

SEQ ID NO: 23028 - DNA, 209 bp, Homo sapiens; identical to SEQ ID NO: 13375
  misc_feature 1..209: note = chr19:38147011-38147220
  misc_feature 1..209: note = hyper
  source 1..209: mol_type = genomic DNA

SEQ ID NO: 23029 - DNA, 53 bp, Homo sapiens
  misc_feature 1..53: note = chr19:38182831-38182884
  misc_feature 1..53: note = hyper
  source 1..53: mol_type = genomic DNA
gcgggcactcactctcgctcacactacaatcagatcctccatgcggctttcat

SEQ ID NO: 23030 - DNA, 34 bp, Homo sapiens; identical to SEQ ID NO: 4659
  misc_feature 1..34: note = chr19:38183440-38183474
  misc_feature 1..34: note = hyper
  source 1..34: mol_type = genomic DNA

SEQ ID NO: 23031 - DNA, 83 bp, Homo sapiens; identical to SEQ ID NO: 13379
  misc_feature 1..83: note = chr19:38210615-38210698
  misc_feature 1..83: note = hyper
  source 1..83: mol_type = genomic DNA

SEQ ID NO: 23032 - DNA, 30 bp, Homo sapiens; identical to SEQ ID NO: 13381
  misc_feature 1..30: note = chr19:38701199-38701229
  misc_feature 1..30: note = hyper
  source 1..30: mol_type = genomic DNA

SEQ ID NO: 23033 - DNA, 500 bp, Homo sapiens; identical to SEQ ID NO: 13382
  misc_feature 1..500: note = chr19:38701550-38702050
  misc_feature 1..500: note = hyper
  source 1..500: mol_type = genomic DNA

SEQ ID NO: 23034 - DNA, 290 bp, Homo sapiens; identical to SEQ ID NO: 13383
  misc_feature 1..290: note = chr19:38746788-38747078
  misc_feature 1..290: note = hyper
  source 1..290: mol_type = genomic DNA

SEQ ID NO: 23035 - DNA, 53 bp, Homo sapiens
  misc_feature 1..53: note = chr19:38747106-38747159
  misc_feature 1..53: note = hyper
  source 1..53: mol_type = genomic DNA
cggccgcctcaggcctcagtttccccgtctgcagtgcgagagtaggccgctgc

SEQ ID NO: 23036 - DNA, 36 bp, Homo sapiens; identical to SEQ ID NO: 13386
  misc_feature 1..36: note = chr19:38877852-38877888
  misc_feature 1..36: note = hyper
  source 1..36: mol_type = genomic DNA

SEQ ID NO: 23037 - DNA, 39 bp, Homo sapiens; identical to SEQ ID NO: 13387
  misc_feature 1..39: note = chr19:38924397-38924436
  misc_feature 1..39: note = hyper
  source 1..39: mol_type = genomic DNA

SEQ ID NO: 23038 - DNA, 95 bp, Homo sapiens; identical to SEQ ID NO: 13388
  misc_feature 1..95: note = chr19:38924437-38924532
  misc_feature 1..95: note = hyper
  source 1..95: mol_type = genomic DNA

SEQ ID NO: 23039 - DNA, 55 bp, Homo sapiens; identical to SEQ ID NO: 13389
  misc_feature 1..55: note = chr19:39282953-39283008
  misc_feature 1..55: note = hyper
  source 1..55: mol_type = genomic DNA

SEQ ID NO: 23040 - DNA, 39 bp, Homo sapiens; identical to SEQ ID NO: 13390
  misc_feature 1..39: note = chr19:39466291-39466330
  misc_feature 1..39: note = hyper
  source 1..39: mol_type = genomic DNA

SEQ ID NO: 23041 - DNA, 42 bp, Homo sapiens; identical to SEQ ID NO: 13391
  misc_feature 1..42: note = chr19:39589777-39589819
  misc_feature 1..42: note = hyper
  source 1..42: mol_type = genomic DNA

SEQ ID NO: 23042 - DNA, 28 bp, Homo sapiens
  misc_feature 1..28: note = chr19:39687619-39687647
  misc_feature 1..28: note = hyper
  source 1..28: mol_type = genomic DNA
gggatggaggaggtgcgtgagggacacg

SEQ ID NO: 23043 - DNA, 115 bp, Homo sapiens
  misc_feature 1..115: note = chr19:39687844-39687959
  misc_feature 1..115: note = hyper
  source 1..115: mol_type = genomic DNA
gaggagtgggggccgctgagcgggggcctggagctgccccagcgcctcacctggaagctgctcctgttgcggcggccgctctaccgcaacctgctgcgctcgcccaaccccgaag

SEQ ID NO: 23044 - DNA, 62 bp, Homo sapiens
  misc_feature 1..62: note = chr19:39755358-39755420
  misc_feature 1..62: note = hyper
  source 1..62: mol_type = genomic DNA
agtcacaaaaggagccctgcagggcggactcggctccaggtcgcgggcgcagggctatgccg

SEQ ID NO: 23045 - DNA, 366 bp, Homo sapiens; identical to SEQ ID NO: 13396
  misc_feature 1..366: note = chr19:39989752-39990118
  misc_feature 1..366: note = hyper
  source 1..366: mol_type = genomic DNA

SEQ ID NO: 23046 - DNA, 43 bp, Homo sapiens
  misc_feature 1..43: note = chr19:39993434-39993477
  misc_feature 1..43: note = hyper
  source 1..43: mol_type = genomic DNA
tcctttgcctgtcctcgcagggcccgcctggagcctgctggcg

SEQ ID NO: 23047 - DNA, 173 bp, Homo sapiens
  misc_feature 1..173: note = chr19:39997813-39997986
  misc_feature 1..173: note = hyper
  source 1..173: mol_type = genomic DNA
gcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttccca

SEQ ID NO: 23048 - DNA, 54 bp, Homo sapiens; identical to SEQ ID NO: 13400
  misc_feature 1..54: note = chr19:40005850-40005904
  misc_feature 1..54: note = hyper
  source 1..54: mol_type = genomic DNA

SEQ ID NO: 23049 - DNA, 16 bp, Homo sapiens
  misc_feature 1..16: note = chr19:40724263-40724279
  misc_feature 1..16: note = hyper
  source 1..16: mol_type = genomic DNA
ccggggacagcgcgcc

SEQ ID NO: 23050 - DNA, 160 bp, Homo sapiens
  misc_feature 1..160: note = chr19:41025379-41025539
  misc_feature 1..160: note = hyper
  source 1..160: mol_type = genomic DNA
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggca

SEQ ID NO: 23051 - DNA, 29 bp, Homo sapiens
  misc_feature 1..29: note = chr19:41025683-41025712
  misc_feature 1..29: note = hyper
  source 1..29: mol_type = genomic DNA
ctacatgacctcgacgctttcctggactg

SEQ ID NO: 23052 - DNA, 18 bp, Homo sapiens
  misc_feature 1..18: note = chr19:41073569-41073587
  misc_feature 1..18: note = hyper
  source 1..18: mol_type = genomic DNA
tcgagaaaatcaaagcgg

SEQ ID NO: 23053 - skipped

SEQ ID NO: 23054 - DNA, 59 bp, Homo sapiens; identical to SEQ ID NO: 13408
  misc_feature 1..59: note = chr19:41354396-41354455
  misc_feature 1..59: note = hyper
  source 1..59: mol_type = genomic DNA

SEQ ID NO: 23055 - DNA, 91 bp, Homo sapiens
  misc_feature 1..91: note = chr19:41354575-41354666
  misc_feature 1..91: note = hyper
  source 1..91: mol_type = genomic DNA
cgatgcctcgcttgcccaccccgaagtcccgcagggtggcgatggagaagcgccggagctgcttggcgcgctccccgttgctgaataccac

SEQ ID NO: 23056 - DNA, 15 bp, Homo sapiens
  misc_feature 1..15: note = chr19:41354722-41354737
  misc_feature 1..15: note = hyper
  source 1..15: mol_type = genomic DNA
cggagcagctccaag

SEQ ID NO: 23057 - DNA, 53 bp, Homo sapiens; identical to SEQ ID NO: 13410
  misc_feature 1..53: note = chr19:41596078-41596131
  misc_feature 1..53: note = hyper
  source 1..53: mol_type = genomic DNA

SEQ ID NO: 23058 - DNA, 105 bp, Homo sapiens
  misc_feature 1..105: note = chr19:41641726-41641831
  misc_feature 1..105: note = hyper
  source 1..105: mol_type = genomic DNA
ggagcccagcaaaggcggggccaatgtgtggatagggcacttggaggtctggtaaggcagcaaaacgaacgaagccggccgcaggagtcggaggccccgaaaggg

SEQ ID NO: 23059 - DNA, 13 bp, Homo sapiens
  misc_feature 1..13: note = chr19:41641886-41641899
  misc_feature 1..13: note = hyper
  source 1..13: mol_type = genomic DNA
cctcctttcccgt

SEQ ID NO: 23060 - DNA, 219 bp, Homo sapiens
  misc_feature 1..219: note = chr19:42028283-42028502
  misc_feature 1..219: note = hyper
  source 1..219: mol_type = genomic DNA
tctaaaacaaaccaacgaggctgccaacctgtgagatagttggtccacttgtacaaaaccccctccatgcttcagagccccacaccgctcatcctcccggcccggcgccggccgcggtgatggggtaggcgcggggcctggggcagcctttcccggcccgcccgggccccctccgccggcacgaagccgctttctgcctgcgcgcgccgcagggacgtg

SEQ ID NO: 23061 - DNA, 193 bp, Homo sapiens
  misc_feature 1..193: note = chr19:42028549-42028742
  misc_feature 1..193: note = hyper
  source 1..193: mol_type = genomic DNA
ccgcgaggcgcgggctcagacatccccgggtaagcctcggcggcggcggccgcgacaacggcaaaaatgcgactgcgaccgcgaccggtctcgtgctcgcgcttccgcggcccggctgctccctccggcgccccggcgctgcctcttcctcgcctgccttccttccccctgggctccccgtttgtttttcgac

SEQ ID NO: 23062 - DNA, 30 bp, Homo sapiens; identical to SEQ ID NO: 13413
  misc_feature 1..30: note = chr19:42574121-42574151
  misc_feature 1..30: note = hyper
  source 1..30: mol_type = genomic DNA

SEQ ID NO: 23063 - DNA, 133 bp, Homo sapiens; identical to SEQ ID NO: 13414
  misc_feature 1..133: note = chr19:42636456-42636589
  misc_feature 1..133: note = hyper
  source 1..133: mol_type = genomic DNA

SEQ ID NO: 23064 - DNA, 19 bp, Homo sapiens
  misc_feature 1..19: note = chr19:42828316-42828335
  misc_feature 1..19: note = hyper
  source 1..19: mol_type = genomic DNA
cgtgcgtccacacctgggg

SEQ ID NO: 23065 - DNA, 68 bp, Homo sapiens; identical to SEQ ID NO: 13416
  misc_feature 1..68: note = chr19:42906129-42906197
  misc_feature 1..68: note = hyper
  source 1..68: mol_type = genomic DNA

SEQ ID NO: 23066 - DNA, 64 bp, Homo sapiens; identical to SEQ ID NO: 13417
  misc_feature 1..64: note = chr19:42928276-42928340
  misc_feature 1..64: note = hyper
  source 1..64: mol_type = genomic DNA

SEQ ID NO: 23067 - DNA, 30 bp, Homo sapiens; identical to SEQ ID NO: 13418
  misc_feature 1..30: note = chr19:44203678-44203708
  misc_feature 1..30: note = hyper
  source 1..30: mol_type = genomic DNA

SEQ ID NO: 23068 - DNA, 41 bp, Homo sapiens; identical to SEQ ID NO: 13419
  misc_feature 1..41: note = chr19:44324840-44324881
  misc_feature 1..41: note = hyper
  source 1..41: mol_type = genomic DNA

SEQ ID NO: 23069 - DNA, 414 bp, Homo sapiens; identical to SEQ ID NO: 13422
  misc_feature 1..414: note = chr19:44711532-44711946
  misc_feature 1..414: note = hyper
  source 1..414: mol_type = genomic DNA

SEQ ID NO: 23070 - DNA, 31 bp, Homo sapiens
  misc_feature 1..31: note = chr19:45656363-45656394
  misc_feature 1..31: note = hyper
  source 1..31: mol_type = genomic DNA
aggaagcacaggaagtcggtgagcagctcca

SEQ ID NO: 23071 - DNA, 43 bp, Homo sapiens
  misc_feature 1..43: note = chr19:45656913-45656956
  misc_feature 1..43: note = hyper
  source 1..43: mol_type = genomic DNA
gcaggaacaccaggtaccacagtagctgcgggacgccccagcc

SEQ ID NO: 23072 - DNA, 35 bp, Homo sapiens
  misc_feature 1..35: note = chr19:45657177-45657212
  misc_feature 1..35: note = hyper
  source 1..35: mol_type = genomic DNA
taaagagctggaagccggtgcagaagcgggggcgt

SEQ ID NO: 23073 - DNA, 30 bp, Homo sapiens; identical to SEQ ID NO: 13431
  misc_feature 1..30: note = chr19:45755404-45755434
  misc_feature 1..30: note = hyper
  source 1..30: mol_type = genomic DNA

SEQ ID NO: 23074 - DNA, 82 bp, Homo sapiens
  misc_feature 1..82: note = chr19:45888864-45888946
  misc_feature 1..82: note = hyper
  source 1..82: mol_type = genomic DNA
cgcacttctcgaaggcggtggcgccgtcgctgagcgtggtggcgaagattgcagcgccgtgctgcaccagcgccatgcagat

SEQ ID NO: 23075 - DNA, 178 bp, Homo sapiens; identical to SEQ ID NO: 13434
  misc_feature 1..178: note = chr19:46001719-46001897
  misc_feature 1..178: note = hyper
  source 1..178: mol_type = genomic DNA

SEQ ID NO: 23076 - DNA, 33 bp, Homo sapiens
  misc_feature 1..33: note = chr19:46002320-46002353
  misc_feature 1..33: note = hyper
  source 1..33: mol_type = genomic DNA
agaggaccaccggccccttcgaccccgggaacg

SEQ ID NO: 23077 - DNA, 54 bp, Homo sapiens; identical to SEQ ID NO: 13436
  misc_feature 1..54: note = chr19:46105244-46105298
  misc_feature 1..54: note = hyper
  source 1..54: mol_type = genomic DNA

SEQ ID NO: 23078 - DNA, 11 bp, Homo sapiens
  misc_feature 1..11: note = chr19:46379903-46379914
  misc_feature 1..11: note = hyper
  source 1..11: mol_type = genomic DNA
gctgcgtgtca

SEQ ID NO: 23079 - DNA, 93 bp, Homo sapiens; identical to SEQ ID NO: 13438
  misc_feature 1..93: note = chr19:46476967-46477060
  misc_feature 1..93: note = hyper
  source 1..93: mol_type = genomic DNA

SEQ ID NO: 23080 - DNA, 110 bp, Homo sapiens; identical to SEQ ID NO: 13439
  misc_feature 1..110: note = chr19:46519300-46519410
  misc_feature 1..110: note = hyper
  source 1..110: mol_type = genomic DNA

SEQ ID NO: 23081 - DNA, 61 bp, Homo sapiens; identical to SEQ ID NO: 13440
  misc_feature 1..61: note = chr19:46907548-46907609
  misc_feature 1..61: note = hyper
  source 1..61: mol_type = genomic DNA

SEQ ID NO: 23082 - DNA, 65 bp, Homo sapiens
  misc_feature 1..65: note = chr19:46930064-46930129
  misc_feature 1..65: note = hyper
  source 1..65: mol_type = genomic DNA
tggtctccatagcaacggtcggacgcgctgctaggttctggctctgactgcgcctgcgcggctgg

SEQ ID NO: 23083 - DNA, 84 bp, Homo sapiens; identical to SEQ ID NO: 13443
  misc_feature 1..84: note = chr19:46932252-46932336
  misc_feature 1..84: note = hyper
  source 1..84: mol_type = genomic DNA

SEQ ID NO: 23084 - DNA, 145 bp, Homo sapiens; identical to SEQ ID NO: 13449
  misc_feature 1..145: note = chr19:47523113-47523258
  misc_feature 1..145: note = hyper
  source 1..145: mol_type = genomic DNA

SEQ ID NO: 23085 - DNA, 37 bp, Homo sapiens; identical to SEQ ID NO: 13450
  misc_feature 1..37: note = chr19:47523631-47523668
  misc_feature 1..37: note = hyper
  source 1..37: mol_type = genomic DNA

SEQ ID NO: 23086 - DNA, 30 bp, Homo sapiens; identical to SEQ ID NO: 13451
  misc_feature 1..30: note = chr19:47921726-47921756
  misc_feature 1..30: note = hyper
  source 1..30: mol_type = genomic DNA

SEQ ID NO: 23087 - DNA, 111 bp, Homo sapiens
  misc_feature 1..111: note = chr19:47933200-47933311
  misc_feature 1..111: note = hyper
  source 1..111: mol_type = genomic DNA
agccaggggagggggcggagaagggaggccgagtcccaggagaggaggccgagtctggggggaaaaggagaccagggtccaagagcaggtgcagccgagtccctagccccg

SEQ ID NO: 23088 - DNA, 28 bp, Homo sapiens
  misc_feature 1..28: note = chr19:47933732-47933760
  misc_feature 1..28: note = hyper
  source 1..28: mol_type = genomic DNA
gagacatacaggtcggaggggctttgcg

SEQ ID NO: 23089 - skipped

SEQ ID NO: 23090 - DNA, 118 bp, Homo sapiens; identical to SEQ ID NO: 13455
  misc_feature 1..118: note = chr19:48076481-48076599
  misc_feature 1..118: note = hyper
  source 1..118: mol_type = genomic DNA

SEQ ID NO: 23091 - DNA, 185 bp, Homo sapiens; identical to SEQ ID NO: 13456
  misc_feature 1..185: note = chr19:48901882-48902067
  misc_feature 1..185: note = hyper
  source 1..185: mol_type = genomic DNA

SEQ ID NO: 23092 - DNA, 30 bp, Homo sapiens; identical to SEQ ID NO: 13458
  misc_feature 1..30: note = chr19:48994837-48994867
  misc_feature 1..30: note = hyper
  source 1..30: mol_type = genomic DNA

SEQ ID NO: 23093 - DNA, 39 bp, Homo sapiens
  misc_feature 1..39: note = chr19:49399310-49399349
  misc_feature 1..39: note = hyper
  source 1..39: mol_type = genomic DNA
ccctagaccccgtctccgcaatcccgggtttggggtggg

SEQ ID NO: 23094 - DNA, 77 bp, Homo sapiens; identical to SEQ ID NO: 13461
  misc_feature 1..77: note = chr19:49924485-49924562
  misc_feature 1..77: note = hyper
  source 1..77: mol_type = genomic DNA

SEQ ID NO: 23095 - DNA, 186 bp, Homo sapiens; identical to SEQ ID NO: 4674
  misc_feature 1..186: note = chr19:49925774-49925960
  misc_feature 1..186: note = hyper
  source 1..186: mol_type = genomic DNA

SEQ ID NO: 23096 - DNA, 11 bp, Homo sapiens
  misc_feature 1..11: note = chr19:49936853-49936864
  misc_feature 1..11: note = hyper
  source 1..11: mol_type = genomic DNA
tagcccctctc

SEQ ID NO: 23097 - DNA, 296 bp, Homo sapiens; identical to SEQ ID NO: 13465
  misc_feature 1..296: note = chr19:50194182-50194478
  misc_feature 1..296: note = hyper
  source 1..296: mol_type = genomic DNA

SEQ ID NO: 23098 - DNA, 37 bp, Homo sapiens; identical to SEQ ID NO: 13466
  misc_feature 1..37: note = chr19:50194774-50194811
  misc_feature 1..37: note = hyper
  source 1..37: mol_type = genomic DNA

SEQ ID NO: 23099 - DNA, 55 bp, Homo sapiens; identical to SEQ ID NO: 13469
  misc_feature 1..55: note = chr19:50815996-50816051
  misc_feature 1..55: note = hyper
  source 1..55: mol_type = genomic DNA

SEQ ID NO: 23100 - DNA, 10 bp, Homo sapiens
  misc_feature 1..10: note = chr19:50816474-50816484
  misc_feature 1..10: note = hyper
  source 1..10: mol_type = genomic DNA
gggaaggggg

SEQ ID NO: 23101 - DNA, 179 bp, Homo sapiens; identical to SEQ ID NO: 13471
  misc_feature 1..179: note = chr19:50818424-50818603
  misc_feature 1..179: note = hyper
  source 1..179: mol_type = genomic DNA

SEQ ID NO: 23102 - DNA, 30 bp, Homo sapiens; identical to SEQ ID NO: 13472
  misc_feature 1..30: note = chr19:50819128-50819158
  misc_feature 1..30: note = hyper
  source 1..30: mol_type = genomic DNA

SEQ ID NO: 23103 - DNA, 35 bp, Homo sapiens; identical to SEQ ID NO: 13473
  misc_feature 1..35: note = chr19:50836356-50836391
  misc_feature 1..35: note = hyper
  source 1..35: mol_type = genomic DNA

SEQ ID NO: 23104 - DNA, 13 bp, Homo sapiens
  misc_feature 1..13: note = chr19:50836392-50836405
  misc_feature 1..13: note = hyper
  source 1..13: mol_type = genomic DNA
ggctgtcttaccg

SEQ ID NO: 23105 - DNA, 51 bp, Homo sapiens; identical to SEQ ID NO: 13475
  misc_feature 1..51: note = chr19:51111640-51111691
  misc_feature 1..51: note = hyper
  source 1..51: mol_type = genomic DNA

SEQ ID NO: 23106 - DNA, 48 bp, Homo sapiens; identical to SEQ ID NO: 13476
  misc_feature 1..48: note = chr19:51142710-51142758
  misc_feature 1..48: note = hyper
  source 1..48: mol_type = genomic DNA

SEQ ID NO: 23107 - DNA, 15 bp, Homo sapiens
  misc_feature 1..15: note = chr19:51142834-51142849
  misc_feature 1..15: note = hyper
  source 1..15: mol_type = genomic DNA
cgaggggtgggatac

SEQ ID NO: 23108 - DNA, 331 bp, Homo sapiens; identical to SEQ ID NO: 13479
  misc_feature 1..331: note = chr19:51161720-51162051
  misc_feature 1..331: note = hyper
  source 1..331: mol_type = genomic DNA

SEQ ID NO: 23109 - DNA, 15 bp, Homo sapiens
  misc_feature 1..15: note = chr19:51170723-51170738
  misc_feature 1..15: note = hyper
  source 1..15: mol_type = genomic DNA
cagttttcaaggaac

SEQ ID NO: 23110 - DNA, 74 bp, Homo sapiens
  misc_feature 1..74: note = chr19:51171145-51171219
  misc_feature 1..74: note = hyper
  source 1..74: mol_type = genomic DNA
cagggccagccccagcggggaggcgggatccagggccttgccggtcagcgggtgcaccaggggtcgcgggggca

SEQ ID NO: 23111 - DNA, 258 bp, Homo sapiens; identical to SEQ ID NO: 13483
  misc_feature 1..258: note = chr19:51197503-51197761
  misc_feature 1..258: note = hyper
  source 1..258: mol_type = genomic DNA

SEQ ID NO: 23112 - DNA, 60 bp, Homo sapiens; identical to SEQ ID NO: 13484
  misc_feature 1..60: note = chr19:51198175-51198235
  misc_feature 1..60: note = hyper
  source 1..60: mol_type = genomic DNA

SEQ ID NO: 23113 - DNA, 355 bp, Homo sapiens; identical to SEQ ID NO: 13485
  misc_feature 1..355: note = chr19:51198793-51199148
  misc_feature 1..355: note = hyper
  source 1..355: mol_type = genomic DNA

SEQ ID NO: 23114 - DNA, 117 bp, Homo sapiens
  misc_feature 1..117: note = chr19:51227602-51227719
  misc_feature 1..117: note = hyper
  source 1..117: mol_type = genomic DNA
ggtcctcaggccccccgctgcatctccaggctccccctccagcatgatccctgtctgtccgcagtgggccgcctggccggcctggacgcaggcctgcaccagctgcacgtccgtctg

SEQ ID NO: 23115 - DNA, 23 bp, Homo sapiens
  misc_feature 1..23: note = chr19:51227785-51227808
  misc_feature 1..23: note = hyper
  source 1..23: mol_type = genomic DNA
gacacccgcgatgccgtgcaagc

SEQ ID NO: 23116 - DNA, 21 bp, Homo sapiens
  misc_feature 1..21: note = chr19:51228248-51228269
  misc_feature 1..21: note = hyper
  source 1..21: mol_type = genomic DNA
gcctccttctctacccggccc

SEQ ID NO: 23117 - DNA, 132 bp, Homo sapiens
  misc_feature 1..132: note = chr19:51228507-51228639
  misc_feature 1..132: note = hyper
  source 1..132: mol_type = genomic DNA
cttcgaaaacggccagcgcgtgtccttcttcgcctggcatcgctcaccccgccccgagctcggcgcccagcccagcgcctcgccgcatccgctcagcccggaccagcccaacggtggcacgctcgagaactg

SEQ ID NO: 23118 - DNA, 91 bp, Homo sapiens; identical to SEQ ID NO: 4680
  misc_feature 1..91: note = chr19:51228702-51228793
  misc_feature 1..91: note = hyper
  source 1..91: mol_type = genomic DNA

SEQ ID NO: 23119 - DNA, 49 bp, Homo sapiens; identical to SEQ ID NO: 13490
  misc_feature 1..49: note = chr19:51412508-51412557
  misc_feature 1..49: note = hyper
  source 1..49: mol_type = genomic DNA

SEQ ID NO: 23120 - DNA, 44 bp, Homo sapiens; identical to SEQ ID NO: 13491
  misc_feature 1..44: note = chr19:51520138-51520182
  misc_feature 1..44: note = hyper
  source 1..44: mol_type = genomic DNA

SEQ ID NO: 23121 - DNA, 232 bp, Homo sapiens
  misc_feature 1..232: note = chr19:51831128-51831360
  misc_feature 1..232: note = hyper
  source 1..232: mol_type = genomic DNA
tgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaa

SEQ ID NO: 23122 - DNA, 30 bp, Homo sapiens; identical to SEQ ID NO: 13494
  misc_feature 1..30: note = chr19:52074302-52074332
  misc_feature 1..30: note = hyper
  source 1..30: mol_type = genomic DNA

SEQ ID NO: 23123 - DNA, 89 bp, Homo sapiens; identical to SEQ ID NO: 13495
  misc_feature 1..89: note = chr19:52207371-52207460
  misc_feature 1..89: note = hyper
  source 1..89: mol_type = genomic DNA

SEQ ID NO: 23124 - DNA, 75 bp, Homo sapiens
  misc_feature 1..75: note = chr19:52222448-52222523
  misc_feature 1..75: note = hyper
  source 1..75: mol_type = genomic DNA
ctctactcacctgcacgtagtccaccgaatctccgagcgccttgaaggctgtgtacatgacctcgcgcttgccgc

SEQ ID NO: 23125 - DNA, 179 bp, Homo sapiens; identical to SEQ ID NO: 13497
  misc_feature 1..179: note = chr19:52531480-52531659
  misc_feature 1..179: note = hyper
  source 1..179: mol_type = genomic DNA

SEQ ID NO: 23126 - DNA, 67 bp, Homo sapiens; identical to SEQ ID NO: 13498
  misc_feature 1..67: note = chr19:52839463-52839530
  misc_feature 1..67: note = hyper
  source 1..67: mol_type = genomic DNA

SEQ ID NO: 23127 - DNA, 30 bp, Homo sapiens; identical to SEQ ID NO: 13499
  misc_feature 1..30: note = chr19:52839996-52840026
  misc_feature 1..30: note = hyper
  source 1..30: mol_type = genomic DNA

SEQ ID NO: 23128 - DNA, 19 bp, Homo sapiens
  misc_feature 1..19: note = chr19:52872905-52872924
  misc_feature 1..19: note = hyper
  source 1..19: mol_type = genomic DNA
cctcagcatccgggtagct

SEQ ID NO: 23129 - DNA, 34 bp, Homo sapiens; identical to SEQ ID NO: 13502
  misc_feature 1..34: note = chr19:52900940-52900974
  misc_feature 1..34: note = hyper
  source 1..34: mol_type = genomic DNA

SEQ ID NO: 23130 - DNA, 27 bp, Homo sapiens
  misc_feature 1..27: note = chr19:52900975-52901002
  misc_feature 1..27: note = hyper
  source 1..27: mol_type = genomic DNA
gaagcgcaggcccggcccaggctttgt

SEQ ID NO: 23131 - DNA, 199 bp, Homo sapiens
  misc_feature 1..199: note = chr19:52956606-52956805
  misc_feature 1..199: note = hyper
  source 1..199: mol_type = genomic DNA
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgc

SEQ ID NO: 23132 - DNA, 10 bp, Homo sapiens
  misc_feature 1..10: note = chr19:52956848-52956858
  misc_feature 1..10: note = hyper
  source 1..10: mol_type = genomic DNA
ttggagcagc

SEQ ID NO: 23133 - DNA, 123 bp, Homo sapiens
  misc_feature 1..123: note = chr19:53073440-53073563
  misc_feature 1..123: note = hyper
  source 1..123: mol_type = genomic DNA
ctccgcctggggccccgcctctacctcgatcaggccccgcccaccttctcgttggctccacccaggcctggctttagtcctgtgcgcacacatccgcgcagaccaggaagcggatcccgtgga

SEQ ID NO: 23134 - DNA, 51 bp, Homo sapiens
  misc_feature 1..51: note = chr19:53073987-53074038
  misc_feature 1..51: note = hyper
  source 1..51: mol_type = genomic DNA
gtgctgggatcttgtggaccccaccgaaggcgtcgtcgcaccccacctccc

SEQ ID NO: 23135 - DNA, 201 bp, Homo sapiens; identical to SEQ ID NO: 13508
  misc_feature 1..201: note = chr19:53141418-53141619
  misc_feature 1..201: note = hyper
  source 1..201: mol_type = genomic DNA

SEQ ID NO: 23136 - DNA, 59 bp, Homo sapiens; identical to SEQ ID NO: 13509
  misc_feature 1..59: note = chr19:53193364-53193423
  misc_feature 1..59: note = hyper
  source 1..59: mol_type = genomic DNA

SEQ ID NO: 23137 - DNA, 264 bp, Homo sapiens; identical to SEQ ID NO: 13511
  misc_feature 1..264: note = chr19:53400445-53400709
  misc_feature 1..264: note = hyper
  source 1..264: mol_type = genomic DNA

SEQ ID NO: 23138 - DNA, 20 bp, Homo sapiens
  misc_feature 1..20: note = chr19:53497275-53497295
  misc_feature 1..20: note = hyper
  source 1..20: mol_type = genomic DNA
ggatgcgggatggagtgctc

SEQ ID NO: 23139 - DNA, 30 bp, Homo sapiens; identical to SEQ ID NO: 13513
  misc_feature 1..30: note = chr19:53561529-53561559
  misc_feature 1..30: note = hyper
  source 1..30: mol_type = genomic DNA

SEQ ID NO: 23140 - DNA, 103 bp, Homo sapiens; identical to SEQ ID NO: 13514
  misc_feature 1..103: note = chr19:53635501-53635604
  misc_feature 1..103: note = hyper
  source 1..103: mol_type = genomic DNA

SEQ ID NO: 23141 - DNA, 46 bp, Homo sapiens
  misc_feature 1..46: note = chr19:53635906-53635952
  misc_feature 1..46: note = hyper
  source 1..46: mol_type = genomic DNA
gaagaagcaaaaggccggggacggggagcagcctcaaagcgacttc

SEQ ID NO: 23142 - DNA, 247 bp, Homo sapiens
  misc_feature 1..247: note = chr19:53696167-53696414
  misc_feature 1..247: note = hyper
  source 1..247: mol_type = genomic DNA
aggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcg

SEQ ID NO: 23143 - DNA, 69 bp, Homo sapiens
  misc_feature 1..69: note = chr19:53696580-53696649
  misc_feature 1..69: note = hyper
  source 1..69: mol_type = genomic DNA
ttcactccaagagatctgcttccgggtttgcaagaaactgcccgcgcagtaggcaaaggggcgggttgc

SEQ ID NO: 23144 - DNA, 13 bp, Homo sapiens
  misc_feature 1..13: note = chr19:53696650-53696663
  misc_feature 1..13: note = hyper
  source 1..13: mol_type = genomic DNA
gtggggaaaggcc

SEQ ID NO: 23145 - DNA, 35 bp, Homo sapiens; identical to SEQ ID NO: 13519
  misc_feature 1..35: note = chr19:53700349-53700384
  misc_feature 1..35: note = hyper
  source 1..35: mol_type = genomic DNA

SEQ ID NO: 23146 - DNA, 30 bp, Homo sapiens; identical to SEQ ID NO: 13521
  misc_feature 1..30: note = chr19:53757742-53757772
  misc_feature 1..30: note = hyper
  source 1..30: mol_type = genomic DNA

SEQ ID NO: 23147 - DNA, 205 bp, Homo sapiens
  misc_feature 1..205: note = chr19:53970763-53970968
  misc_feature 1..205: note = hyper
  source 1..205: mol_type = genomic DNA
aattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggc

SEQ ID NO: 23148 - DNA, 101 bp, Homo sapiens; identical to SEQ ID NO: 13525
  misc_feature 1..101: note = chr19:53971344-53971445
  misc_feature 1..101: note = hyper
  source 1..101: mol_type = genomic DNA

SEQ ID NO: 23149 - DNA, 325 bp, Homo sapiens
  misc_feature 1..325: note = chr19:54024196-54024521
  misc_feature 1..325: note = hyper
  source 1..325: mol_type = genomic DNA
catgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccct

SEQ ID NO: 23150 - DNA, 93 bp, Homo sapiens; identical to SEQ ID NO: 13528
  misc_feature 1..93: note = chr19:54409951-54410044
  misc_feature 1..93: note = hyper
  source 1..93: mol_type = genomic DNA

SEQ ID NO: 23151 - DNA, 101 bp, Homo sapiens; identical to SEQ ID NO: 13529
  misc_feature 1..101: note = chr19:54410263-54410364
  misc_feature 1..101: note = hyper
  source 1..101: mol_type = genomic DNA

SEQ ID NO: 23152 - DNA, 102 bp, Homo sapiens
  misc_feature 1..102: note = chr19:54411454-54411556
  misc_feature 1..102: note = hyper
  source 1..102: mol_type = genomic DNA
gagtctggggagtgccggggaccgtgcagatggactacatttccccgcaggcctcgcggcagacccttcccccaagtgcggctccttgccgccagggctgat

SEQ ID NO: 23153 - DNA, 34 bp, Homo sapiens
  misc_feature 1..34: note = chr19:54412839-54412873
  misc_feature 1..34: note = hyper
  source 1..34: mol_type = genomic DNA
gggcaacaagggacccgagtggctccaggggtgg

SEQ ID NO: 23154 - skipped

SEQ ID NO: 23155 - DNA, 74 bp, Homo sapiens; identical to SEQ ID NO: 13532
  misc_feature 1..74: note = chr19:54413489-54413563
  misc_feature 1..74: note = hyper
  source 1..74: mol_type = genomic DNA

SEQ ID NO: 23156 - DNA, 30 bp, Homo sapiens; identical to SEQ ID NO: 13533
  misc_feature 1..30: note = chr19:54463032-54463062
  misc_feature 1..30: note = hyper
  source 1..30: mol_type = genomic DNA

SEQ ID NO: 23157 - DNA, 391 bp, Homo sapiens; identical to SEQ ID NO: 13534
  misc_feature 1..391: note = chr19:54466163-54466554
  misc_feature 1..391: note = hyper
  source 1..391: mol_type = genomic DNA

SEQ ID NO: 23158 - DNA, 51 bp, Homo sapiens; identical to SEQ ID NO: 13535
  misc_feature 1..51: note = chr19:54481352-54481403
  misc_feature 1..51: note = hyper
  source 1..51: mol_type = genomic DNA

SEQ ID NO: 23159 - DNA, 229 bp, Homo sapiens; identical to SEQ ID NO: 13537
  misc_feature 1..229: note = chr19:54482817-54483046
  misc_feature 1..229: note = hyper
  source 1..229: mol_type = genomic DNA

SEQ ID NO: 23160 - DNA, 174 bp, Homo sapiens
  misc_feature 1..174: note = chr19:54485823-54485997
  misc_feature 1..174: note = hyper
  source 1..174: mol_type = genomic DNA
gggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcc

SEQ ID NO: 23161 - DNA, 93 bp, Homo sapiens; identical to SEQ ID NO: 13541
  misc_feature 1..93: note = chr19:55684842-55684935
  misc_feature 1..93: note = hyper
  source 1..93: mol_type = genomic DNA

SEQ ID NO: 23162 - DNA, 97 bp, Homo sapiens; identical to SEQ ID NO: 13542
  misc_feature 1..97: note = chr19:55690949-55691046
  misc_feature 1..97: note = hyper
  source 1..97: mol_type = genomic DNA

SEQ ID NO: 23163 - DNA, 40 bp, Homo sapiens; identical to SEQ ID NO: 13543
  misc_feature 1..40: note = chr19:55953904-55953944
  misc_feature 1..40: note = hyper
  source 1..40: mol_type = genomic DNA

SEQ ID NO: 23164 - DNA, 42 bp, Homo sapiens; identical to SEQ ID NO: 13544
  misc_feature 1..42: note = chr19:55954477-55954519
  misc_feature 1..42: note = hyper
  source 1..42: mol_type = genomic DNA

SEQ ID NO: 23165 - DNA, 32 bp, Homo sapiens; identical to SEQ ID NO: 13545
  misc_feature 1..32: note = chr19:55963152-55963184
  misc_feature 1..32: note = hyper
  source 1..32: mol_type = genomic DNA

SEQ ID NO: 23166 - DNA, 121 bp, Homo sapiens; identical to SEQ ID NO: 13546
  misc_feature 1..121: note = chr19:55963603-55963724
  misc_feature 1..121: note = hyper
  source 1..121: mol_type = genomic DNA

SEQ ID NO: 23167 - DNA, 20 bp, Homo sapiens
  misc_feature 1..20: note = chr19:56728658-56728678
  misc_feature 1..20: note = hyper
  source 1..20: mol_type = genomic DNA
cgatgatgactccagctttc

SEQ ID NO: 23168 - DNA, 193 bp, Homo sapiens; identical to SEQ ID NO: 1401
  misc_feature 1..193: note = chr19:56904511-56904704
  misc_feature 1..193: note = hyper
  source 1..193: mol_type = genomic DNA

SEQ ID NO: 23169 - DNA, 17 bp, Homo sapiens
  misc_feature 1..17: note = chr19:56904723-56904740
  misc_feature 1..17: note = hyper
  source 1..17: mol_type = genomic DNA
cgttcttctcaggcctg

SEQ ID NO: 23170 - DNA, 152 bp, Homo sapiens
  misc_feature 1..152: note = chr19:56915168-56915320
  misc_feature 1..152: note = hyper
  source 1..152: mol_type = genomic DNA
gcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctcca

SEQ ID NO: 23171 - DNA, 222 bp, Homo sapiens
  misc_feature 1..222: note = chr19:56915428-56915650
  misc_feature 1..222: note = hyper
  source 1..222: mol_type = genomic DNA
tggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 23172 - DNA, 242 bp, Homo sapiens; identical to SEQ ID NO: 13555
  misc_feature 1..242: note = chr19:56915651-56915893
  misc_feature 1..242: note = hyper
  source 1..242: mol_type = genomic DNA

SEQ ID NO: 23173 - DNA, 47 bp, Homo sapiens; identical to SEQ ID NO: 13557
  misc_feature 1..47: note = chr19:57018744-57018791
  misc_feature 1..47: note = hyper
  source 1..47: mol_type = genomic DNA

SEQ ID NO: 23174 - DNA, 282 bp, Homo sapiens; identical to SEQ ID NO: 13558
  misc_feature 1..282: note = chr19:57019202-57019484
  misc_feature 1..282: note = hyper
  source 1..282: mol_type = genomic DNA

SEQ ID NO: 23175 - DNA, 58 bp, Homo sapiens; identical to SEQ ID NO: 13559
  misc_feature 1..58: note = chr19:57079102-57079160
  misc_feature 1..58: note = hyper
  source 1..58: mol_type = genomic DNA

SEQ ID NO: 23176 - DNA, 30 bp, Homo sapiens; identical to SEQ ID NO: 13560
  misc_feature 1..30: note = chr19:57149347-57149377
  misc_feature 1..30: note = hyper
  source 1..30: mol_type = genomic DNA

SEQ ID NO: 23177 - DNA, 460 bp, Homo sapiens; identical to SEQ ID NO: 13561
  misc_feature 1..460: note = chr19:57154254-57154714
  misc_feature 1..460: note = hyper
  source 1..460: mol_type = genomic DNA

SEQ ID NO: 23178 - DNA, 50 bp, Homo sapiens
  misc_feature 1..50: note = chr19:57182944-57182994
  misc_feature 1..50: note = hyper
  source 1..50: mol_type = genomic DNA
gttgctctcgcctcccggtatcaccttcgaacgcgctggccggccccctc

SEQ ID NO: 23179 - DNA, 87 bp, Homo sapiens; identical to SEQ ID NO: 13563
  misc_feature 1..87: note = chr19:57610741-57610828
  misc_feature 1..87: note = hyper
  source 1..87: mol_type = genomic DNA

SEQ ID NO: 23180 - DNA, 33 bp, Homo sapiens
  misc_feature 1..33: note = chr19:57617489-57617522
  misc_feature 1..33: note = hyper
  source 1..33: mol_type = genomic DNA
ccctgcatcccggagcgcactggggatgaggac

SEQ ID NO: 23181 - DNA, 46 bp, Homo sapiens
  misc_feature 1..46: note = chr19:57618121-57618167
  misc_feature 1..46: note = hyper
  source 1..46: mol_type = genomic DNA
agccgctgggggttcggcccaccccgcgaaccgagctcccggccct

SEQ ID NO: 23182 - DNA, 32 bp, Homo sapiens
  misc_feature 1..32: note = chr19:57683295-57683327
  misc_feature 1..32: note = hyper
  source 1..32: mol_type = genomic DNA
gggcgcgagcgggggtccggggccgcgagctg

SEQ ID NO: 23183 - DNA, 94 bp, Homo sapiens; identical to SEQ ID NO: 13567
  misc_feature 1..94: note = chr19:57683592-57683686
  misc_feature 1..94: note = hyper
  source 1..94: mol_type = genomic DNA

SEQ ID NO: 23184 - DNA, 58 bp, Homo sapiens; identical to SEQ ID NO: 13568
  misc_feature 1..58: note = chr19:57683805-57683863
  misc_feature 1..58: note = hyper
  source 1..58: mol_type = genomic DNA

SEQ ID NO: 23185 - DNA, 94 bp, Homo sapiens
  misc_feature 1..94: note = chr19:57862783-57862877
  misc_feature 1..94: note = hyper
  source 1..94: mol_type = genomic DNA
ccatgacccctgtcgtgggacgggcggcctctcgcggaggtgtctgccggggctgggctcttaccgaggcctccacacacgtcctcttgtcctt

SEQ ID NO: 23186 - DNA, 15 bp, Homo sapiens
  misc_feature 1..15: note = chr19:57989033-57989048
  misc_feature 1..15: note = hyper
  source 1..15: mol_type = genomic DNA
aacactagtaagcgg

SEQ ID NO: 23187 - DNA, 54 bp, Homo sapiens
  misc_feature 1..54: note = chr19:58011070-58011124
  misc_feature 1..54: note = hyper
  source 1..54: mol_type = genomic DNA
atctccatcatctaccgtctccaatctccatctccgaagttatgcccacttcct

SEQ ID NO: 23188 - DNA, 64 bp, Homo sapiens
  misc_feature 1..64: note = chr19:58011281-58011345
  misc_feature 1..64: note = hyper
  source 1..64: mol_type = genomic DNA
aactcagcttgccggaagctggttgttcgctgcggcgaccagctccggaaagcgcggtggggac

SEQ ID NO: 23189 - DNA, 160 bp, Homo sapiens; identical to SEQ ID NO: 13573
  misc_feature 1..160: note = chr19:58011346-58011506
  misc_feature 1..160: note = hyper
  source 1..160: mol_type = genomic DNA

SEQ ID NO: 23190 - DNA, 154 bp, Homo sapiens
  misc_feature 1..154: note = chr19:58038969-58039123
  misc_feature 1..154: note = hyper
  source 1..154: mol_type = genomic DNA
cgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaa

SEQ ID NO: 23191 - DNA, 18 bp, Homo sapiens
  misc_feature 1..18: note = chr19:58094988-58095006
  misc_feature 1..18: note = hyper
  source 1..18: mol_type = genomic DNA
ccccacgtggcctcccgg

SEQ ID NO: 23192 - DNA, 68 bp, Homo sapiens
  misc_feature 1..68: note = chr19:58111564-58111632
  misc_feature 1..68: note = hyper
  source 1..68: mol_type = genomic DNA
gggttttctgcagcccggaccgcactgtccggcacagtgaggcgctggtgctggatctcgtttctggt

SEQ ID NO: 23193 - DNA, 49 bp, Homo sapiens
  misc_feature 1..49: note = chr19:58111783-58111832
  misc_feature 1..49: note = hyper
  source 1..49: mol_type = genomic DNA
actgagtttcaccagcacactgagggccacagcgcgtaggacagaagag

SEQ ID NO: 23194 - DNA, 122 bp, Homo sapiens
  misc_feature 1..122: note = chr19:58125422-58125544
  misc_feature 1..122: note = hyper
  source 1..122: mol_type = genomic DNA
tttctcagcgcccctcgcagtaccatttggcctttgcccagcgtgcaggggagttagccgtcaccacggccaagtgcacatgagaactgcattgcccagaaacctgtgcgccgcccggcggc

SEQ ID NO: 23195 - DNA, 131 bp, Homo sapiens
  misc_feature 1..131: note = chr19:58125881-58126012
  misc_feature 1..131: note = hyper
  source 1..131: mol_type = genomic DNA
cctttcccagactttcgcccgccccaaatcctgaagttccaaatgaggagcgcctgtctgagtccctgcagcgcaggccccagtgtccaaggcagcggggcgctggtgggtgggggcgagtgtgactggca

SEQ ID NO: 23196 - DNA, 140 bp, Homo sapiens; identical to SEQ ID NO: 13579
  misc_feature 1..140: note = chr19:58175834-58175974
  misc_feature 1..140: note = hyper
  source 1..140: mol_type = genomic DNA

SEQ ID NO: 23197 - DNA, 113 bp, Homo sapiens
  misc_feature 1..113: note = chr19:58239088-58239201
  misc_feature 1..113: note = hyper
  source 1..113: mol_type = genomic DNA
gtagagtgtggttcccactgagctatccttcaaggcaggggattctcggcctgggctcttgggaaaactcgaagtaggagggccaagttgtttgggaaaagtaacccgagttt

SEQ ID NO: 23198 - DNA, 239 bp, Homo sapiens; identical to SEQ ID NO: 13585
  misc_feature 1..239: note = chr19:58281000-58281239
  misc_feature 1..239: note = hyper
  source 1..239: mol_type = genomic DNA

SEQ ID NO: 23199 - DNA, 27 bp, Homo sapiens
  misc_feature 1..27: note = chr19:58400052-58400079
  misc_feature 1..27: note = hyper
  source 1..27: mol_type = genomic DNA
agagccgtgaacaggcgctgctacctc

SEQ ID NO: 23200 - DNA, 11 bp, Homo sapiens
  misc_feature 1..11: note = chr19:58400406-58400417
  misc_feature 1..11: note = hyper
  source 1..11: mol_type = genomic DNA
gccgccaccag

SEQ ID NO: 23201 - DNA, 41 bp, Homo sapiens; identical to SEQ ID NO: 13588
  misc_feature 1..41: note = chr19:58446443-58446484
  misc_feature 1..41: note = hyper
  source 1..41: mol_type = genomic DNA

SEQ ID NO: 23202 - DNA, 31 bp, Homo sapiens
  misc_feature 1..31: note = chr19:58459201-58459232
  misc_feature 1..31: note = hyper
  source 1..31: mol_type = genomic DNA
cgcctccacctccttccggaagtaaaggcca

SEQ ID NO: 23203 - DNA, 78 bp, Homo sapiens; identical to SEQ ID NO: 13590
  misc_feature 1..78: note = chr19:58513793-58513871
  misc_feature 1..78: note = hyper
  source 1..78: mol_type = genomic DNA

SEQ ID NO: 23204 - DNA, 128 bp, Homo sapiens; identical to SEQ ID NO: 13591
  misc_feature 1..128: note = chr19:58514138-58514266
  misc_feature 1..128: note = hyper
  source 1..128: mol_type = genomic DNA

SEQ ID NO: 23205 - DNA, 15 bp, Homo sapiens
  misc_feature 1..15: note = chr19:58521301-58521316
  misc_feature 1..15: note = hyper
  source 1..15: mol_type = genomic DNA
cggcagtaccttgcc

SEQ ID NO: 23206 - DNA, 206 bp, Homo sapiens
  misc_feature 1..206: note = chr19:58662094-58662300
  misc_feature 1..206: note = hyper
  source 1..206: mol_type = genomic DNA
gctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactt

SEQ ID NO: 23207 - DNA, 182 bp, Homo sapiens
  misc_feature 1..182: note = chr19:58666313-58666495
  misc_feature 1..182: note = hyper
  source 1..182: mol_type = genomic DNA
cgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 23208 - DNA, 183 bp, Homo sapiens; identical to SEQ ID NO: 13601
  misc_feature 1..183: note = chr19:58666550-58666733
  misc_feature 1..183: note = hyper
  source 1..183: mol_type = genomic DNA

SEQ ID NO: 23209 - DNA, 30 bp, Homo sapiens; identical to SEQ ID NO: 13602
  misc_feature 1..30: note = chr19:58694552-58694582
  misc_feature 1..30: note = hyper
  source 1..30: mol_type = genomic DNA

SEQ ID NO: 23210 - DNA, 30 bp, Homo sapiens; identical to SEQ ID NO: 13603
  misc_feature 1..30: note = chr19:58695225-58695255
  misc_feature 1..30: note = hyper
  source 1..30: mol_type = genomic DNA

SEQ ID NO: 23211 - DNA, 30 bp, Homo sapiens; identical to SEQ ID NO: 13604
  misc_feature 1..30: note = chr19:58951079-58951109
  misc_feature 1..30: note = hyper
  source 1..30: mol_type = genomic DNA

SEQ ID NO: 23212 - DNA, 142 bp, Homo sapiens
  misc_feature 1..142: note = chr19:58951916-58952058
  misc_feature 1..142: note = hyper
  source 1..142: mol_type = genomic DNA
tccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccc

SEQ ID NO: 23213 - DNA, 13 bp, Homo sapiens
  misc_feature 1..13: note = chr20:291135-291148
  misc_feature 1..13: note = hyper
  source 1..13: mol_type = genomic DNA
cgttgccatagaa

SEQ ID NO: 23214 - DNA, 86 bp, Homo sapiens
  misc_feature 1..86: note = chr20:590348-590434
  misc_feature 1..86: note = hyper
  source 1..86: mol_type = genomic DNA
acactcacccccttgcgctggttgctgaggcagaaggtgcagatggagcgcggctggcggccgccgtcggcggcggcggggacggc

SEQ ID NO: 23215 - DNA, 39 bp, Homo sapiens
  misc_feature 1..39: note = chr20:644787-644826
  misc_feature 1..39: note = hyper
  source 1..39: mol_type = genomic DNA
cgcccgcctgcgcccccgcgcgccccgcgcgccccccgg

SEQ ID NO: 23216 - DNA, 320 bp, Homo sapiens; identical to SEQ ID NO: 1419
  misc_feature 1..320: note = chr20:644985-645305
  misc_feature 1..320: note = hyper
  source 1..320: mol_type = genomic DNA

SEQ ID NO: 23217 - DNA, 139 bp, Homo sapiens; identical to SEQ ID NO: 13613
  misc_feature 1..139: note = chr20:656937-657076
  misc_feature 1..139: note = hyper
  source 1..139: mol_type = genomic DNA

SEQ ID NO: 23218 - DNA, 47 bp, Homo sapiens; identical to SEQ ID NO: 13614
  misc_feature 1..47: note = chr20:708643-708690
  misc_feature 1..47: note = hyper
  source 1..47: mol_type = genomic DNA

SEQ ID NO: 23219 - DNA, 22 bp, Homo sapiens
  misc_feature 1..22: note = chr20:982727-982749
  misc_feature 1..22: note = hyper
  source 1..22: mol_type = genomic DNA
ccttgcttcttccttcggttca

SEQ ID NO: 23220 - DNA, 155 bp, Homo sapiens
  misc_feature 1..155: note = chr20:982989-983144
  misc_feature 1..155: note = hyper
  source 1..155: mol_type = genomic DNA
gcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgc

SEQ ID NO: 23221 - DNA, 38 bp, Homo sapiens; identical to SEQ ID NO: 13617
  misc_feature 1..38: note = chr20:1783339-1783377
  misc_feature 1..38: note = hyper
  source 1..38: mol_type = genomic DNA

SEQ ID NO: 23222 - DNA, 153 bp, Homo sapiens
  misc_feature 1..153: note = chr20:1783608-1783761
  misc_feature 1..153: note = hyper
  source 1..153: mol_type = genomic DNA
gccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaaggg

SEQ ID NO: 23223 - skipped

SEQ ID NO: 23224 - DNA, 35 bp, Homo sapiens; identical to SEQ ID NO: 13622
  misc_feature 1..35: note = chr20:2731640-2731675
  misc_feature 1..35: note = hyper
  source 1..35: mol_type = genomic DNA

SEQ ID NO: 23225 - DNA, 260 bp, Homo sapiens
  misc_feature 1..260: note = chr20:2781452-2781712
  misc_feature 1..260: note = hyper
  source 1..260: mol_type = genomic DNA
tcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattg

SEQ ID NO: 23226 - DNA, 30 bp, Homo sapiens; identical to SEQ ID NO: 13625
  misc_feature 1..30: note = chr20:2781916-2781946
  misc_feature 1..30: note = hyper
  source 1..30: mol_type = genomic DNA

SEQ ID NO: 23227 - DNA, 43 bp, Homo sapiens
  misc_feature 1..43: note = chr20:3052540-3052583
  misc_feature 1..43: note = hyper
  source 1..43: mol_type = genomic DNA
gcccttgaccgcggtcgaggcccccacggcgccccagcgcgtc

SEQ ID NO: 23228 - DNA, 237 bp, Homo sapiens
  misc_feature 1..237: note = chr20:3052836-3053073
  misc_feature 1..237: note = hyper
  source 1..237: mol_type = genomic DNA
aactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatg

SEQ ID NO: 23229 - DNA, 73 bp, Homo sapiens; identical to SEQ ID NO: 13629
  misc_feature 1..73: note = chr20:3063708-3063781
  misc_feature 1..73: note = hyper
  source 1..73: mol_type = genomic DNA

SEQ ID NO: 23230 - DNA, 107 bp, Homo sapiens; identical to SEQ ID NO: 4731
  misc_feature 1..107: note = chr20:3073285-3073392
  misc_feature 1..107: note = hyper
  source 1..107: mol_type = genomic DNA

SEQ ID NO: 23231 - DNA, 58 bp, Homo sapiens; identical to SEQ ID NO: 13632
  misc_feature 1..58: note = chr20:3218776-3218834
  misc_feature 1..58: note = hyper
  source 1..58: mol_type = genomic DNA

SEQ ID NO: 23232 - DNA, 19 bp, Homo sapiens
  misc_feature 1..19: note = chr20:3220874-3220893
  misc_feature 1..19: note = hyper
  source 1..19: mol_type = genomic DNA
ggaacggggacaggccggg

SEQ ID NO: 23233 - DNA, 49 bp, Homo sapiens; identical to SEQ ID NO: 13636
  misc_feature 1..49: note = chr20:3662664-3662713
  misc_feature 1..49: note = hyper
  source 1..49: mol_type = genomic DNA

SEQ ID NO: 23234 - DNA, 130 bp, Homo sapiens; identical to SEQ ID NO: 13638
  misc_feature 1..130: note = chr20:3713321-3713451
  misc_feature 1..130: note = hyper
  source 1..130: mol_type = genomic DNA

SEQ ID NO: 23235 - DNA, 30 bp, Homo sapiens; identical to SEQ ID NO: 13639
  misc_feature 1..30: note = chr20:3759057-3759087
  misc_feature 1..30: note = hyper
  source 1..30: mol_type = genomic DNA

SEQ ID NO: 23236 - DNA, 93 bp, Homo sapiens; identical to SEQ ID NO: 13640
  misc_feature 1..93: note = chr20:4202639-4202732
  misc_feature 1..93: note = hyper
  source 1..93: mol_type = genomic DNA

SEQ ID NO: 23237 - DNA, 10 bp, Homo sapiens
  misc_feature 1..10: note = chr20:4229392-4229402
  misc_feature 1..10: note = hyper
  source 1..10: mol_type = genomic DNA
tcccccgcgg

SEQ ID NO: 23238 - DNA, 73 bp, Homo sapiens
  misc_feature 1..73: note = chr20:4229432-4229505
  misc_feature 1..73: note = hyper
  source 1..73: mol_type = genomic DNA
ccaccacgccgccgccgccgcccgcgccccccggcacgccgcccaccgccgggccctccgagggggccgcgcc

SEQ ID NO: 23239 - DNA, 230 bp, Homo sapiens
  misc_feature 1..230: note = chr20:4803650-4803880
  misc_feature 1..230: note = hyper
  source 1..230: mol_type = genomic DNA
tagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggc

SEQ ID NO: 23240 - DNA, 148 bp, Homo sapiens
  misc_feature 1..148: note = chr20:5296900-5297048
  misc_feature 1..148: note = hyper
  source 1..148: mol_type = genomic DNA
cccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 23241 - DNA, 223 bp, Homo sapiens; identical to SEQ ID NO: 13648
  misc_feature 1..223: note = chr20:6032982-6033205
  misc_feature 1..223: note = hyper
  source 1..223: mol_type = genomic DNA

SEQ ID NO: 23242 - DNA, 256 bp, Homo sapiens; identical to SEQ ID NO: 13649
  misc_feature 1..256: note = chr20:6033206-6033462
  misc_feature 1..256: note = hyper
  source 1..256: mol_type = genomic DNA

SEQ ID NO: 23243 - DNA, 43 bp, Homo sapiens
  misc_feature 1..43: note = chr20:8112335-8112378
  misc_feature 1..43: note = hyper
  source 1..43: mol_type = genomic DNA
atgggctttctgtctcgaaagcacaacgtaaccgtttgcccgg

SEQ ID NO: 23244 - DNA, 204 bp, Homo sapiens
  misc_feature 1..204: note = chr20:8112408-8112612
  misc_feature 1..204: note = hyper
  source 1..204: mol_type = genomic DNA
ggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagccca

SEQ ID NO: 23245 - DNA, 96 bp, Homo sapiens
  misc_feature 1..96: note = chr20:8113461-8113557
  misc_feature 1..96: note = hyper
  source 1..96: mol_type = genomic DNA
gggtggggcaaggggcgcgttatgcaatgggcgcactgggagcgggcaggggcagcctcgggcgcacaggttggcatctgccaaagcggatgtcca

SEQ ID NO: 23246 - DNA, 44 bp, Homo sapiens
  misc_feature 1..44: note = chr20:9488332-9488376
  misc_feature 1..44: note = hyper
  source 1..44: mol_type = genomic DNA
cctggcgggctggaccgggacagggggcggtgcgcaccggggct

SEQ ID NO: 23247 - DNA, 30 bp, Homo sapiens; identical to SEQ ID NO: 13658
  misc_feature 1..30: note = chr20:9496079-9496109
  misc_feature 1..30: note = hyper
  source 1..30: mol_type = genomic DNA

SEQ ID NO: 23248 - DNA, 164 bp, Homo sapiens; identical to SEQ ID NO: 13660
  misc_feature 1..164: note = chr20:9819538-9819702
  misc_feature 1..164: note = hyper
  source 1..164: mol_type = genomic DNA

SEQ ID NO: 23249 - DNA, 131 bp, Homo sapiens
  misc_feature 1..131: note = chr20:10198600-10198731
  misc_feature 1..131: note = hyper
  source 1..131: mol_type = genomic DNA
agacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 23250 - DNA, 295 bp, Homo sapiens; identical to SEQ ID NO: 13663
  misc_feature 1..295: note = chr20:10199333-10199628
  misc_feature 1..295: note = hyper
  source 1..295: mol_type = genomic DNA

SEQ ID NO: 23251 - DNA, 37 bp, Homo sapiens; identical to SEQ ID NO: 13664
  misc_feature 1..37: note = chr20:10200078-10200115
  misc_feature 1..37: note = hyper
  source 1..37: mol_type = genomic DNA

SEQ ID NO: 23252 - DNA, 75 bp, Homo sapiens
  misc_feature 1..75: note = chr20:17208510-17208585
  misc_feature 1..75: note = hyper
  source 1..75: mol_type = genomic DNA
cccacccccatcccccggagaaagaatagtttcctacagacgaggctggacgtttggacactgcaattcacctcg

SEQ ID NO: 23253 - DNA, 37 bp, Homo sapiens
  misc_feature 1..37: note = chr20:17208620-17208657
  misc_feature 1..37: note = hyper
  source 1..37: mol_type = genomic DNA
cccagggacttcggtccctgctcctctccgggaacaa

SEQ ID NO: 23254 - DNA, 64 bp, Homo sapiens; identical to SEQ ID NO: 13668
  misc_feature 1..64: note = chr20:17208739-17208803
  misc_feature 1..64: note = hyper
  source 1..64: mol_type = genomic DNA

SEQ ID NO: 23255 - DNA, 57 bp, Homo sapiens; identical to SEQ ID NO: 13669
  misc_feature 1..57: note = chr20:19192824-19192881
  misc_feature 1..57: note = hyper
  source 1..57: mol_type = genomic DNA

SEQ ID NO: 23256 - DNA, 39 bp, Homo sapiens; identical to SEQ ID NO: 13671
  misc_feature 1..39: note = chr20:20344449-20344488
  misc_feature 1..39: note = hyper
  source 1..39: mol_type = genomic DNA

SEQ ID NO: 23257 - DNA, 377 bp, Homo sapiens; identical to SEQ ID NO: 13672
  misc_feature 1..377: note = chr20:20344800-20345177
  misc_feature 1..377: note = hyper
  source 1..377: mol_type = genomic DNA

SEQ ID NO: 23258 - DNA, 10 bp, Homo sapiens
  misc_feature 1..10: note = chr20:20346166-20346176
  misc_feature 1..10: note = hyper
  source 1..10: mol_type = genomic DNA
gggtggtgaa

SEQ ID NO: 23259 - DNA, 127 bp, Homo sapiens
  misc_feature 1..127: note = chr20:20347333-20347460
  misc_feature 1..127: note = hyper
  source 1..127: mol_type = genomic DNA
gggtgggggtgggggcggggggaatcttcgctgttgtctcttcctggtggcacaggggaggcggcttgtcctctcggaggcctcagcctgcctcagagtacagattgccccccctccccccgtccag

SEQ ID NO: 23260 - DNA, 68 bp, Homo sapiens
  misc_feature 1..68: note = chr20:20348154-20348222
  misc_feature 1..68: note = hyper
  source 1..68: mol_type = genomic DNA
ttcccaaacaccacgcggagccactgcgcctccgcaacgatctcccccgcaccgccccggcgcgcccc

SEQ ID NO: 23261 - DNA, 26 bp, Homo sapiens
  misc_feature 1..26: note = chr20:20348257-20348283
  misc_feature 1..26: note = hyper
  source 1..26: mol_type = genomic DNA
cggctccggctcgcggattgaaccct

SEQ ID NO: 23262 - DNA, 304 bp, Homo sapiens
  misc_feature 1..304: note = chr20:20348849-20349153
  misc_feature 1..304: note = hyper
  source 1..304: mol_type = genomic DNA
gccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgca

SEQ ID NO: 23263 - DNA, 158 bp, Homo sapiens
  misc_feature 1..158: note = chr20:20349255-20349413
  misc_feature 1..158: note = hyper
  source 1..158: mol_type = genomic DNA
cttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctca

SEQ ID NO: 23264 - DNA, 446 bp, Homo sapiens; identical to SEQ ID NO: 13678
  misc_feature 1..446: note = chr20:20349851-20350297
  misc_feature 1..446: note = hyper
  source 1..446: mol_type = genomic DNA

SEQ ID NO: 23265 - DNA, 38 bp, Homo sapiens
  misc_feature 1..38: note = chr20:21080676-21080714
  misc_feature 1..38: note = hyper
  source 1..38: mol_type = genomic DNA
gcctatcaattaccccgcccgcagtgaaagcgaaagcg

SEQ ID NO: 23266 - DNA, 279 bp, Homo sapiens
  misc_feature 1..279: note = chr20:21082253-21082532
  misc_feature 1..279: note = hyper
  source 1..279: mol_type = genomic DNA
cgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgc

SEQ ID NO: 23267 - DNA, 39 bp, Homo sapiens
  misc_feature 1..39: note = chr20:21082917-21082956
  misc_feature 1..39: note = hyper
  source 1..39: mol_type = genomic DNA
aaaagatcctggagctaaagcctgcgcctacaccagaga

SEQ ID NO: 23268 - DNA, 44 bp, Homo sapiens
  misc_feature 1..44: note = chr20:21085787-21085831
  misc_feature 1..44: note = hyper
  source 1..44: mol_type = genomic DNA
caccgggtcccctttcgaatgccatttcccagctgaaaatccag

SEQ ID NO: 23269 - DNA, 288 bp, Homo sapiens
  misc_feature 1..288: note = chr20:21085864-21086152
  misc_feature 1..288: note = hyper
  source 1..288: mol_type = genomic DNA
cctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 23270 - skipped

SEQ ID NO: 23271 - DNA, 43 bp, Homo sapiens
  misc_feature 1..43: note = chr20:21376207-21376250
  misc_feature 1..43: note = hyper
  source 1..43: mol_type = genomic DNA
ttttatagttacaaacgccaacaaagtttccaactttgagagc

SEQ ID NO: 23272 - DNA, 23 bp, Homo sapiens
  misc_feature 1..23: note = chr20:21378551-21378574
  misc_feature 1..23: note = hyper
  source 1..23: mol_type = genomic DNA
tataattgcggaatggggaacgt

SEQ ID NO: 23273 - DNA, 416 bp, Homo sapiens
  misc_feature 1..416: note = chr20:21485959-21486375
  misc_feature 1..416: note = hyper
  source 1..416: mol_type = genomic DNA
gtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgcc

SEQ ID NO: 23274 - DNA, 36 bp, Homo sapiens
  misc_feature 1..36: note = chr20:21486881-21486917
  misc_feature 1..36: note = hyper
  source 1..36: mol_type = genomic DNA
cgaacacaggtcgactcgcacctcccaggcacccgc

SEQ ID NO: 23275 - DNA, 199 bp, Homo sapiens
  misc_feature 1..199: note = chr20:21486954-21487153
  misc_feature 1..199: note = hyper
  source 1..199: mol_type = genomic DNA
cgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcg

SEQ ID NO: 23276 - DNA, 32 bp, Homo sapiens; identical to SEQ ID NO: 13699
  misc_feature 1..32: note = chr20:21488385-21488417
  misc_feature 1..32: note = hyper
  source 1..32: mol_type = genomic DNA

SEQ ID NO: 23277 - DNA, 30 bp, Homo sapiens; identical to SEQ ID NO: 13700
  misc_feature 1..30: note = chr20:21488767-21488797
  misc_feature 1..30: note = hyper
  source 1..30: mol_type = genomic DNA

SEQ ID NO: 23278 - DNA, 78 bp, Homo sapiens
  misc_feature 1..78: note = chr20:21493230-21493308
  misc_feature 1..78: note = hyper
  source 1..78: mol_type = genomic DNA
ctggcagcccagccccgctgcctttgccatgacccctgccttcctctacgcctgacgaagacgtcgggacctcccagg

SEQ ID NO: 23279 - DNA, 59 bp, Homo sapiens
  misc_feature 1..59: note = chr20:21494703-21494762
  misc_feature 1..59: note = hyper
  source 1..59: mol_type = genomic DNA
ccattgcccgagcgatcagtccatataaggctgggctccactcacgaacctggggaggc

SEQ ID NO: 23280 - DNA, 211 bp, Homo sapiens
  misc_feature 1..211: note = chr20:21498638-21498849
  misc_feature 1..211: note = hyper
  source 1..211: mol_type = genomic DNA
aattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgct

SEQ ID NO: 23281 - DNA, 101 bp, Homo sapiens; identical to SEQ ID NO: 13714
  misc_feature 1..101: note = chr20:21499374-21499475
  misc_feature 1..101: note = hyper
  source 1..101: mol_type = genomic DNA

SEQ ID NO: 23282 - DNA, 29 bp, Homo sapiens
  misc_feature 1..29: note = chr20:21501724-21501753
  misc_feature 1..29: note = hyper
  source 1..29: mol_type = genomic DNA
ctaagggctggttccgggaaggacaggga

SEQ ID NO: 23283 - DNA, 147 bp, Homo sapiens
  misc_feature 1..147: note = chr20:21502443-21502590
  misc_feature 1..147: note = hyper
  source 1..147: mol_type = genomic DNA
cgctccgccttctactcccggagctgcggcgacagccccgccgcatttcaaggcgcgtctttatctagtactccacctacccggacccccctcgctctgcgcccttcccccaccgcgcgccctaccaggcggggctcaggggaccgc

SEQ ID NO: 23284 - DNA, 125 bp, Homo sapiens
  misc_feature 1..125: note = chr20:21503773-21503898
  misc_feature 1..125: note = hyper
  source 1..125: mol_type = genomic DNA
caaggtcgccatctataaattgctcggtcgctaagacgccataaaaccaaagggccagatgtggcacgttatttatgtgtgaaaccgcgtttacactagatacgcggatccaaggccgatagcac

SEQ ID NO: 23285 - DNA, 21 bp, Homo sapiens
  misc_feature 1..21: note = chr20:21503899-21503920
  misc_feature 1..21: note = hyper
  source 1..21: mol_type = genomic DNA
acttcgcgggaggtcacagac

SEQ ID NO: 23286 - DNA, 121 bp, Homo sapiens
  misc_feature 1..121: note = chr20:21683651-21683772
  misc_feature 1..121: note = hyper
  source 1..121: mol_type = genomic DNA
gctaagctgcctccttgggaggtgggagagacgtttcttttccttctgcaatctcatcttagggccatctctcaccaagcctagcctgcagctcgggaacccgcgatacccggccggggga

SEQ ID NO: 23287 - DNA, 17 bp, Homo sapiens
  misc_feature 1..17: note = chr20:21683899-21683916
  misc_feature 1..17: note = hyper
  source 1..17: mol_type = genomic DNA
cgcggactctgctaccg

SEQ ID NO: 23288 - DNA, 51 bp, Homo sapiens
  misc_feature 1..51: note = chr20:21686184-21686235
  misc_feature 1..51: note = hyper
  source 1..51: mol_type = genomic DNA
ggtagagtttcagggcggggaggggggcgctggggcgcagtgacgggaacc

SEQ ID NO: 23289 - DNA, 11 bp, Homo sapiens
  misc_feature 1..11: note = chr20:21689945-21689956
  misc_feature 1..11: note = hyper
  source 1..11: mol_type = genomic DNA
gggcggcggct

SEQ ID NO: 23290 - DNA, 31 bp, Homo sapiens
  misc_feature 1..31: note = chr20:21694529-21694560
  misc_feature 1..31: note = hyper
  source 1..31: mol_type = genomic DNA
caactgcctcctacgtcggaggaatccaggc

SEQ ID NO: 23291 - DNA, 25 bp, Homo sapiens
  misc_feature 1..25: note = chr20:21748491-21748516
  misc_feature 1..25: note = hyper
  source 1..25: mol_type = genomic DNA
ccctcaaatgcgtgtttgccctgct

SEQ ID NO: 23292 - DNA, 14 bp, Homo sapiens
  misc_feature 1..14: note = chr20:22558669-22558683
  misc_feature 1..14: note = hyper
  source 1..14: mol_type = genomic DNA
gtcaccatgctccg

SEQ ID NO: 23293 - DNA, 149 bp, Homo sapiens; identical to SEQ ID NO: 13736
  misc_feature 1..149: note = chr20:22567416-22567565
  misc_feature 1..149: note = hyper
  source 1..149: mol_type = genomic DNA

SEQ ID NO: 23294 - DNA, 30 bp, Homo sapiens; identical to SEQ ID NO: 13739
  misc_feature 1..30: note = chr20:23030745-23030775
  misc_feature 1..30: note = hyper
  source 1..30: mol_type = genomic DNA

SEQ ID NO: 23295 - DNA, 30 bp, Homo sapiens; identical to SEQ ID NO: 13740
  misc_feature 1..30: note = chr20:23031047-23031077
  misc_feature 1..30: note = hyper
  source 1..30: mol_type = genomic DNA

SEQ ID NO: 23296 - DNA, 163 bp, Homo sapiens; identical to SEQ ID NO: 13741
  misc_feature 1..163: note = chr20:23031307-23031470
  misc_feature 1..163: note = hyper
  source 1..163: mol_type = genomic DNA

SEQ ID NO: 23297 - DNA, 331 bp, Homo sapiens
  misc_feature 1..331: note = chr20:24449900-24450231
  misc_feature 1..331: note = hyper
  source 1..331: mol_type = genomic DNA
gttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagag

SEQ ID NO: 23298 - DNA, 191 bp, Homo sapiens
  misc_feature 1..191: note = chr20:24450513-24450704
  misc_feature 1..191: note = hyper
  source 1..191: mol_type = genomic DNA
tggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggaga

SEQ ID NO: 23299 - DNA, 24 bp, Homo sapiens
  misc_feature 1..24: note = chr20:24451426-24451450
  misc_feature 1..24: note = hyper
  source 1..24: mol_type = genomic DNA
acgcagaggcttgggcgcttggca

SEQ ID NO: 23300 - DNA, 61 bp, Homo sapiens
  misc_feature 1..61: note = chr20:25062880-25062941
  misc_feature 1..61: note = hyper
  source 1..61: mol_type = genomic DNA
gaccccgcgagatggggacgccaccagttcccctcccctcggttaccgcccacccagctgc

SEQ ID NO: 23301 - DNA, 53 bp, Homo sapiens
  misc_feature 1..53: note = chr20:25063727-25063780
  misc_feature 1..53: note = hyper
  source 1..53: mol_type = genomic DNA
tattgtccaatttcacgattattcaaagaaagcctgattctttgaataatcag

SEQ ID NO: 23302 - DNA, 53 bp, Homo sapiens
  misc_feature 1..53: note = chr20:25064458-25064511
  misc_feature 1..53: note = hyper
  source 1..53: mol_type = genomic DNA
aggcagggtagtcgattctaaggtggcccgaccggggtcgcccgcgaatggaa

SEQ ID NO: 23303 - DNA, 30 bp, Homo sapiens; identical to SEQ ID NO: 13753
  misc_feature 1..30: note = chr20:25064790-25064820
  misc_feature 1..30: note = hyper
  source 1..30: mol_type = genomic DNA

SEQ ID NO: 23304 - DNA, 29 bp, Homo sapiens
  misc_feature 1..29: note = chr20:25129464-25129493
  misc_feature 1..29: note = hyper
  source 1..29: mol_type = genomic DNA
cgcccatccccgtgcgcacgtgttcgctg

SEQ ID NO: 23305 - DNA, 206 bp, Homo sapiens; identical to SEQ ID NO: 13757
  misc_feature 1..206: note = chr20:25565991-25566197
  misc_feature 1..206: note = hyper
  source 1..206: mol_type = genomic DNA

SEQ ID NO: 23306 - skipped

SEQ ID NO: 23307 - DNA, 19 bp, Homo sapiens
  misc_feature 1..19: note = chr20:26189582-26189601
  misc_feature 1..19: note = hyper
  source 1..19: mol_type = genomic DNA
ggcccgcagaggcgctcag

SEQ ID NO: 23308 - DNA, 30 bp, Homo sapiens; identical to SEQ ID NO: 13760
  misc_feature 1..30: note = chr20:26189977-26190007
  misc_feature 1..30: note = hyper
  source 1..30: mol_type = genomic DNA

SEQ ID NO: 23309 - DNA, 136 bp, Homo sapiens; identical to SEQ ID NO: 13761
  misc_feature 1..136: note = chr20:30063113-30063249
  misc_feature 1..136: note = hyper
  source 1..136: mol_type = genomic DNA

SEQ ID NO: 23310 - DNA, 262 bp, Homo sapiens; identical to SEQ ID NO: 13762
  misc_feature 1..262: note = chr20:30063250-30063512
  misc_feature 1..262: note = hyper
  source 1..262: mol_type = genomic DNA

SEQ ID NO: 23311 - DNA, 189 bp, Homo sapiens
  misc_feature 1..189: note = chr20:30639847-30640036
  misc_feature 1..189: note = hyper
  source 1..189: mol_type = genomic DNA
atggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctg

SEQ ID NO: 23312 - DNA, 90 bp, Homo sapiens
  misc_feature 1..90: note = chr20:30640270-30640360
  misc_feature 1..90: note = hyper
  source 1..90: mol_type = genomic DNA
acgaggagcgggcgcccaggtgagtgccgcgcacaggggaccgggaatacccggcccgcgaggggtcccaggaggcggagggagcccagg

SEQ ID NO: 23313 - DNA, 68 bp, Homo sapiens
  misc_feature 1..68: note = chr20:30777956-30778024
  misc_feature 1..68: note = hyper
  source 1..68: mol_type = genomic DNA
cgccccccagcttctcgggcccgggccgcggggaccgtgcgcgcgtccccctcccgggcaaggccggg

SEQ ID NO: 23314 - DNA, 38 bp, Homo sapiens; identical to SEQ ID NO: 13769
  misc_feature 1..38: note = chr20:32804098-32804136
  misc_feature 1..38: note = hyper
  source 1..38: mol_type = genomic DNA

SEQ ID NO: 23315 - DNA, 254 bp, Homo sapiens; identical to SEQ ID NO: 13770
  misc_feature 1..254: note = chr20:33146323-33146577
  misc_feature 1..254: note = hyper
  source 1..254: mol_type = genomic DNA

SEQ ID NO: 23316 - skipped

SEQ ID NO: 23317 - DNA, 101 bp, Homo sapiens
  misc_feature 1..101: note = chr20:34189391-34189492
  misc_feature 1..101: note = hyper
  source 1..101: mol_type = genomic DNA
cctatggagccctatggaccgaggcgagtgaggccagatttgccgcggccagaagcgctcacccgcgcggcccggatgggagatccgcctcaggtccggca

SEQ ID NO: 23318 - DNA, 144 bp, Homo sapiens
  misc_feature 1..144: note = chr20:34189910-34190054
  misc_feature 1..144: note = hyper
  source 1..144: mol_type = genomic DNA
cctaggggagggggcaccgagcggggggggagaaactgggatctcggcccctccccttatccgcgccccacggccacccccggatccatgtcctcctccccacctcaccccggctcacttctcgatgtccgaacagtgccctgg

SEQ ID NO: 23319 - DNA, 74 bp, Homo sapiens; identical to SEQ ID NO: 13775
  misc_feature 1..74: note = chr20:35491337-35491411
  misc_feature 1..74: note = hyper
  source 1..74: mol_type = genomic DNA

SEQ ID NO: 23320 - DNA, 40 bp, Homo sapiens; identical to SEQ ID NO: 13776
  misc_feature 1..40: note = chr20:36013211-36013251
  misc_feature 1..40: note = hyper
  source 1..40: mol_type = genomic DNA

SEQ ID NO: 23321 - DNA, 76 bp, Homo sapiens
  misc_feature 1..76: note = chr20:36531910-36531986
  misc_feature 1..76: note = hyper
  source 1..76: mol_type = genomic DNA
aaccccaacccgggccgcgccactccaacttggccgccccggggctcgaaccggcgccagtcgtggcgggcatccc

SEQ ID NO: 23322 - DNA, 69 bp, Homo sapiens; identical to SEQ ID NO: 13778
  misc_feature 1..69: note = chr20:36888892-36888961
  misc_feature 1..69: note = hyper
  source 1..69: mol_type = genomic DNA

SEQ ID NO: 23323 - DNA, 117 bp, Homo sapiens
  misc_feature 1..117: note = chr20:37302580-37302697
  misc_feature 1..117: note = hyper
  source 1..117: mol_type = genomic DNA
tggagcctgatcactcggggtcttactggccacggtgaggagtcagggtttcatgcgcccctgcagtcagaaagcatggcccaaccccagtgccctaagtccggaaacattcaaagc

SEQ ID NO: 23324 - DNA, 33 bp, Homo sapiens
  misc_feature 1..33: note = chr20:37303343-37303376
  misc_feature 1..33: note = hyper
  source 1..33: mol_type = genomic DNA
cgtcgcgcgctcgccccacgctaggaatgcaaa

SEQ ID NO: 23325 - DNA, 92 bp, Homo sapiens
  misc_feature 1..92: note = chr20:37351701-37351793
  misc_feature 1..92: note = hyper
  source 1..92: mol_type = genomic DNA
acttccagtcacagccgctacttctccattcaggctgggactgccaggtggagccctgcggtttactgctcaggaggagcccggccaggaca

SEQ ID NO: 23326 - DNA, 216 bp, Homo sapiens
  misc_feature 1..216: note = chr20:37352977-37353193
  misc_feature 1..216: note = hyper
  source 1..216: mol_type = genomic DNA
cgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtcca

SEQ ID NO: 23327 - DNA, 20 bp, Homo sapiens
  misc_feature 1..20: note = chr20:37353435-37353455
  misc_feature 1..20: note = hyper
  source 1..20: mol_type = genomic DNA
gatgagcggcatgttcgcca

SEQ ID NO: 23328 - DNA, 339 bp, Homo sapiens
  misc_feature 1..339: note = chr20:37353806-37354145
  misc_feature 1..339: note = hyper
  source 1..339: mol_type = genomic DNA
cgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaa

SEQ ID NO: 23329 - DNA, 30 bp, Homo sapiens
  misc_feature 1..30: note = chr20:37355202-37355232
  misc_feature 1..30: note = hyper
  source 1..30: mol_type = genomic DNA
ccctacagccctgtccgcctgaccctgaag

SEQ ID NO: 23330 - DNA, 345 bp, Homo sapiens
  misc_feature 1..345: note = chr20:37355502-37355847
  misc_feature 1..345: note = hyper
  source 1..345: mol_type = genomic DNA
accctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacc

SEQ ID NO: 23331 - DNA, 196 bp, Homo sapiens
  misc_feature 1..196: note = chr20:37357353-37357549
  misc_feature 1..196: note = hyper
  source 1..196: mol_type = genomic DNA
agtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctct

SEQ ID NO: 23332 - DNA, 224 bp, Homo sapiens; identical to SEQ ID NO: 1473
  misc_feature 1..224: note = chr20:37434129-37434353
  misc_feature 1..224: note = hyper
  source 1..224: mol_type = genomic DNA

SEQ ID NO: 23333 - DNA, 64 bp, Homo sapiens
  misc_feature 1..64: note = chr20:37434488-37434552
  misc_feature 1..64: note = hyper
  source 1..64: mol_type = genomic DNA
cgggggatgaggatggggcggggaggtggtcccagcctgctatcacctagctgggggccggggc

SEQ ID NO: 23334 - DNA, 150 bp, Homo sapiens
  misc_feature 1..150: note = chr20:37434744-37434894
  misc_feature 1..150: note = hyper
  source 1..150: mol_type = genomic DNA
gggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcg

SEQ ID NO: 23335 - DNA, 174 bp, Homo sapiens
  misc_feature 1..174: note = chr20:37434930-37435104
  misc_feature 1..174: note = hyper
  source 1..174: mol_type = genomic DNA
cgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggc

SEQ ID NO: 23336 - DNA, 152 bp, Homo sapiens
  misc_feature 1..152: note = chr20:37435218-37435370
  misc_feature 1..152: note = hyper
  source 1..152: mol_type = genomic DNA
gagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcc

SEQ ID NO: 23337 - DNA, 96 bp, Homo sapiens
  misc_feature 1..96: note = chr20:39316107-39316203
  misc_feature 1..96: note = hyper
  source 1..96: mol_type = genomic DNA
gcgcggactactctccgggcagcaaagcagctgtcccggcttaacgcgcaaagttcagaaagccaggagtctccagatggccttggtgacttctcg

SEQ ID NO: 23338 - DNA, 13 bp, Homo sapiens
  misc_feature 1..13: note = chr20:39316322-39316335
  misc_feature 1..13: note = hyper
  source 1..13: mol_type = genomic DNA
ccttagccaaggt

SEQ ID NO: 23339 - DNA, 175 bp, Homo sapiens
  misc_feature 1..175: note = chr20:39317392-39317567
  misc_feature 1..175: note = hyper
  source 1..175: mol_type = genomic DNA
ttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcggg

SEQ ID NO: 23340 - DNA, 68 bp, Homo sapiens
  misc_feature 1..68: note = chr20:39319058-39319126
  misc_feature 1..68: note = hyper
  source 1..68: mol_type = genomic DNA
gccccgttgaaattccgtgccccagcgttcgggggtgcccgtcggctgctccctgggccggaaggtcc

SEQ ID NO: 23341 - DNA, 112 bp, Homo sapiens
  misc_feature 1..112: note = chr20:39995034-39995146
  misc_feature 1..112: note = hyper
  source 1..112: mol_type = genomic DNA
gcgggcaggtgggagcggcgacgcgcgcgggcccatccctccctcttcccgcccgccgcccgcccgcgcttacttgtgcggccccgggcgcagccgcgggcgccatcccgtc

SEQ ID NO: 23342 - skipped

SEQ ID NO: 23343 - DNA, 54 bp, Homo sapiens
  misc_feature 1..54: note = chr20:41818513-41818567
  misc_feature 1..54: note = hyper
  source 1..54: mol_type = genomic DNA
tcctgcgttccaagccgaggcgcggcgcgaactgaggcgggaggctgggcgggg

SEQ ID NO: 23344 - DNA, 101 bp, Homo sapiens
  misc_feature 1..101: note = chr20:41818914-41819015
  misc_feature 1..101: note = hyper
  source 1..101: mol_type = genomic DNA
gaagctgcagcagccgtttgaactcggggtggggaacaggtgaatgggggttcggtggcgagaagagggagggagggagcagccctcgcaactcaagataa

SEQ ID NO: 23345 - DNA, 102 bp, Homo sapiens; identical to SEQ ID NO: 13807
  misc_feature 1..102: note = chr20:42136090-42136192
  misc_feature 1..102: note = hyper
  source 1..102: mol_type = genomic DNA

SEQ ID NO: 23346 - DNA, 63 bp, Homo sapiens
  misc_feature 1..63: note = chr20:42136411-42136474
  misc_feature 1..63: note = hyper
  source 1..63: mol_type = genomic DNA
gaccttgcgtcccctgggcgccgcgccaccccgctccgtccagggcggcgagggctcaggtct

SEQ ID NO: 23347 - DNA, 56 bp, Homo sapiens
  misc_feature 1..56: note = chr20:42543698-42543754
  misc_feature 1..56: note = hyper
  source 1..56: mol_type = genomic DNA
gctcccggggtcacacggggccgcgcacatcagccccgccgacgggcacgggcggc

SEQ ID NO: 23348 - DNA, 238 bp, Homo sapiens
  misc_feature 1..238: note = chr20:42543853-42544091
  misc_feature 1..238: note = hyper
  source 1..238: mol_type = genomic DNA
tcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgt

SEQ ID NO: 23349 - DNA, 170 bp, Homo sapiens; identical to SEQ ID NO: 13811
  misc_feature 1..170: note = chr20:42587835-42588005
  misc_feature 1..170: note = hyper
  source 1..170: mol_type = genomic DNA

SEQ ID NO: 23350 - DNA, 516 bp, Homo sapiens
  misc_feature 1..516: note = chr20:43438466-43438982
  misc_feature 1..516: note = hyper
  source 1..516: mol_type = genomic DNA
gcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggcc

SEQ ID NO: 23351 - DNA, 110 bp, Homo sapiens
  misc_feature 1..110: note = chr20:43439022-43439132
  misc_feature 1..110: note = hyper
  source 1..110: mol_type = genomic DNA
cggcggcccggggccgggccgaggctccgctgcggggctggcgggcgcggcggggccggcgggcgggccaggagctggcggcgcgcggagcccgaggcgcgctgtgctgc

SEQ ID NO: 23352 - DNA, 27 bp, Homo sapiens
  misc_feature 1..27: note = chr20:43439192-43439219
  misc_feature 1..27: note = hyper
  source 1..27: mol_type = genomic DNA
gcggcgccccccgccggcagcgcgagg

SEQ ID NO: 23353 - DNA, 44 bp, Homo sapiens
  misc_feature 1..44: note = chr20:43439247-43439291
  misc_feature 1..44: note = hyper
  source 1..44: mol_type = genomic DNA
cgtgccgccgggggagggggcgccgctgcggggcgtgggagccc

SEQ ID NO: 23354 - skipped

SEQ ID NO: 23355 - DNA, 24 bp, Homo sapiens
  misc_feature 1..24: note = chr20:43726764-43726788
  misc_feature 1..24: note = hyper
  source 1..24: mol_type = genomic DNA
cgagtagcccgggttctccatggt

SEQ ID NO: 23356 - DNA, 30 bp, Homo sapiens; identical to SEQ ID NO: 13818
  misc_feature 1..30: note = chr20:44540105-44540135
  misc_feature 1..30: note = hyper
  source 1..30: mol_type = genomic DNA

SEQ ID NO: 23357 - DNA, 37 bp, Homo sapiens; identical to SEQ ID NO: 13819
  misc_feature 1..37: note = chr20:44540652-44540689
  misc_feature 1..37: note = hyper
  source 1..37: mol_type = genomic DNA

SEQ ID NO: 23358 - DNA, 233 bp, Homo sapiens; identical to SEQ ID NO: 13821
  misc_feature 1..233: note = chr20:44650230-44650463
  misc_feature 1..233: note = hyper
  source 1..233: mol_type = genomic DNA

SEQ ID NO: 23359 - DNA, 47 bp, Homo sapiens; identical to SEQ ID NO: 13822
  misc_feature 1..47: note = chr20:44659209-44659256
  misc_feature 1..47: note = hyper
  source 1..47: mol_type = genomic DNA

SEQ ID NO: 23360 - DNA, 72 bp, Homo sapiens
  misc_feature 1..72: note = chr20:44660877-44660949
  misc_feature 1..72: note = hyper
  source 1..72: mol_type = genomic DNA
gcagggtctcgggccaggaagcccctattcctgtcccctgagcgccacccgcccccgcgaaggaggaggcgc

SEQ ID NO: 23361 - DNA, 29 bp, Homo sapiens
  misc_feature 1..29: note = chr20:44686762-44686791
  misc_feature 1..29: note = hyper
  source 1..29: mol_type = genomic DNA
tgtacaggagacatcgcgtgtatttttaa

SEQ ID NO: 23362 - DNA, 41 bp, Homo sapiens; identical to SEQ ID NO: 13826
  misc_feature 1..41: note = chr20:44687186-44687227
  misc_feature 1..41: note = hyper
  source 1..41: mol_type = genomic DNA

SEQ ID NO: 23363-23364 - skipped (2 entries)

SEQ ID NO: 23365 - DNA, 59 bp, Homo sapiens
  misc_feature 1..59: note = chr20:44803675-44803734
  misc_feature 1..59: note = hyper
  source 1..59: mol_type = genomic DNA
cttgtggtggcgcctgagggtgaggatcagcagcaccagcactgcgagggggacagagg

SEQ ID NO: 23366 - DNA, 91 bp, Homo sapiens
  misc_feature 1..91: note = chr20:44880076-44880167
  misc_feature 1..91: note = hyper
  source 1..91: mol_type = genomic DNA
acgggcccgcggccctgaacgccgcccagccgcgggggtacccggctggagggggagggggcgcggccgcatccggggcatggacagcccc

SEQ ID NO: 23367 - DNA, 157 bp, Homo sapiens; identical to SEQ ID NO: 13830
  misc_feature 1..157: note = chr20:44936314-44936471
  misc_feature 1..157: note = hyper
  source 1..157: mol_type = genomic DNA

SEQ ID NO: 23368 - DNA, 18 bp, Homo sapiens
  misc_feature 1..18: note = chr20:44941500-44941518
  misc_feature 1..18: note = hyper
  source 1..18: mol_type = genomic DNA
gcccttggctgggggcgc

SEQ ID NO: 23369 - DNA, 71 bp, Homo sapiens; identical to SEQ ID NO: 13832
  misc_feature 1..71: note = chr20:45141858-45141929
  misc_feature 1..71: note = hyper
  source 1..71: mol_type = genomic DNA

SEQ ID NO: 23370 - DNA, 410 bp, Homo sapiens; identical to SEQ ID NO: 13836
  misc_feature 1..410: note = chr20:45523248-45523658
  misc_feature 1..410: note = hyper
  source 1..410: mol_type = genomic DNA

SEQ ID NO: 23371 - DNA, 140 bp, Homo sapiens; identical to SEQ ID NO: 13837
  misc_feature 1..140: note = chr20:45523893-45524033
  misc_feature 1..140: note = hyper
  source 1..140: mol_type = genomic DNA

SEQ ID NO: 23372 - DNA, 25 bp, Homo sapiens
  misc_feature 1..25: note = chr20:45524553-45524578
  misc_feature 1..25: note = hyper
  source 1..25: mol_type = genomic DNA
gagttgacagcgtgcaccctgccgc

SEQ ID NO: 23373 - DNA, 10 bp, Homo sapiens
  misc_feature 1..10: note = chr20:47443719-47443729
  misc_feature 1..10: note = hyper
  source 1..10: mol_type = genomic DNA
atcctactcc

SEQ ID NO: 23374 - DNA, 146 bp, Homo sapiens
  misc_feature 1..146: note = chr20:47444282-47444428
  misc_feature 1..146: note = hyper
  source 1..146: mol_type = genomic DNA
ccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttc

SEQ ID NO: 23375 - DNA, 129 bp, Homo sapiens; identical to SEQ ID NO: 4825
  misc_feature 1..129: note = chr20:47444452-47444581
  misc_feature 1..129: note = hyper
  source 1..129: mol_type = genomic DNA

SEQ ID NO: 23376 - DNA, 184 bp, Homo sapiens; identical to SEQ ID NO: 4826
  misc_feature 1..184: note = chr20:47444609-47444793
  misc_feature 1..184: note = hyper
  source 1..184: mol_type = genomic DNA

SEQ ID NO: 23377 - DNA, 295 bp, Homo sapiens; identical to SEQ ID NO: 4827
  misc_feature 1..295: note = chr20:47444920-47445215
  misc_feature 1..295: note = hyper
  source 1..295: mol_type = genomic DNA

SEQ ID NO: 23378 - DNA, 227 bp, Homo sapiens
  misc_feature 1..227: note = chr20:47935268-47935495
  misc_feature 1..227: note = hyper
  source 1..227: mol_type = genomic DNA
ggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctc

SEQ ID NO: 23379 - DNA, 27 bp, Homo sapiens
  misc_feature 1..27: note = chr20:47935567-47935594
  misc_feature 1..27: note = hyper
  source 1..27: mol_type = genomic DNA
gagcacaagaggcgcaggcaggaagga

SEQ ID NO: 23380 - DNA, 30 bp, Homo sapiens; identical to SEQ ID NO: 13848
  misc_feature 1..30: note = chr20:48099143-48099173
  misc_feature 1..30: note = hyper
  source 1..30: mol_type = genomic DNA

SEQ ID NO: 23381 - DNA, 30 bp, Homo sapiens; identical to SEQ ID NO: 13849
  misc_feature 1..30: note = chr20:48099543-48099573
  misc_feature 1..30: note = hyper
  source 1..30: mol_type = genomic DNA

SEQ ID NO: 23382 - DNA, 171 bp, Homo sapiens
  misc_feature 1..171: note = chr20:48184435-48184606
  misc_feature 1..171: note = hyper
  source 1..171: mol_type = genomic DNA
cccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagc

SEQ ID NO: 23383 - DNA, 54 bp, Homo sapiens; identical to SEQ ID NO: 13851
  misc_feature 1..54: note = chr20:48788965-48789019
  misc_feature 1..54: note = hyper
  source 1..54: mol_type = genomic DNA

SEQ ID NO: 23384 - DNA, 255 bp, Homo sapiens; identical to SEQ ID NO: 13852
  misc_feature 1..255: note = chr20:49639257-49639512
  misc_feature 1..255: note = hyper
  source 1..255: mol_type = genomic DNA

SEQ ID NO: 23385 - skipped

SEQ ID NO: 23386 - DNA, 48 bp, Homo sapiens; identical to SEQ ID NO: 13855
  misc_feature 1..48: note = chr20:49836918-49836966
  misc_feature 1..48: note = hyper
  source 1..48: mol_type = genomic DNA

SEQ ID NO: 23387 - DNA, 30 bp, Homo sapiens; identical to SEQ ID NO: 13856
  misc_feature 1..30: note = chr20:50157990-50158020
  misc_feature 1..30: note = hyper
  source 1..30: mol_type = genomic DNA

SEQ ID NO: 23388 - DNA, 30 bp, Homo sapiens; identical to SEQ ID NO: 13857
  misc_feature 1..30: note = chr20:50158389-50158419
  misc_feature 1..30: note = hyper
  source 1..30: mol_type = genomic DNA

SEQ ID NO: 23389 - DNA, 45 bp, Homo sapiens
  misc_feature 1..45: note = chr20:50720392-50720437
  misc_feature 1..45: note = hyper
  source 1..45: mol_type = genomic DNA
aacatataagctattcgtttagtggaggcttcattaaactactcc

SEQ ID NO: 23390 - DNA, 48 bp, Homo sapiens; identical to SEQ ID NO: 13863
  misc_feature 1..48: note = chr20:53091752-53091800
  misc_feature 1..48: note = hyper
  source 1..48: mol_type = genomic DNA

SEQ ID NO: 23391 - DNA, 26 bp, Homo sapiens
  misc_feature 1..26: note = chr20:53092166-53092192
  misc_feature 1..26: note = hyper
  source 1..26: mol_type = genomic DNA
gctggatccctcagccgccgccgctc

SEQ ID NO: 23392 - DNA, 32 bp, Homo sapiens; identical to SEQ ID NO: 13867
  misc_feature 1..32: note = chr20:53092763-53092795
  misc_feature 1..32: note = hyper
  source 1..32: mol_type = genomic DNA

SEQ ID NO: 23393 - DNA, 30 bp, Homo sapiens; identical to SEQ ID NO: 13868
  misc_feature 1..30: note = chr20:53093219-53093249
  misc_feature 1..30: note = hyper
  source 1..30: mol_type = genomic DNA

SEQ ID NO: 23394 - DNA, 199 bp, Homo sapiens
  misc_feature 1..199: note = chr20:54580323-54580522
  misc_feature 1..199: note = hyper
  source 1..199: mol_type = genomic DNA
gctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 23395 - DNA, 65 bp, Homo sapiens; identical to SEQ ID NO: 13872
  misc_feature 1..65: note = chr20:54919287-54919352
  misc_feature 1..65: note = hyper
  source 1..65: mol_type = genomic DNA

SEQ ID NO: 23396 - DNA, 137 bp, Homo sapiens
  misc_feature 1..137: note = chr20:55199898-55200035
  misc_feature 1..137: note = hyper
  source 1..137: mol_type = genomic DNA
actgaagaagtcctacgtaccgcttgtcatatacatatgtaaagataatttaaaaccctagggtatacccttttcaaatgcagagtttatagtttccaaggggaggagggcaggggaggagtaaccaggacctttcc

SEQ ID NO: 23397 - skipped

SEQ ID NO: 23398 - DNA, 265 bp, Homo sapiens
  misc_feature 1..265: note = chr20:55201092-55201357
  misc_feature 1..265: note = hyper
  source 1..265: mol_type = genomic DNA
atctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccc

SEQ ID NO: 23399 - skipped

SEQ ID NO: 23400 - DNA, 187 bp, Homo sapiens
  misc_feature 1..187: note = chr20:55204135-55204322
  misc_feature 1..187: note = hyper
  source 1..187: mol_type = genomic DNA
ggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatt

SEQ ID NO: 23401 - DNA, 28 bp, Homo sapiens
  misc_feature 1..28: note = chr20:55204938-55204966
  misc_feature 1..28: note = hyper
  source 1..28: mol_type = genomic DNA
ctcggaaaagtgccccgtctgcaaccct

SEQ ID NO: 23402 - DNA, 73 bp, Homo sapiens; identical to SEQ ID NO: 13883
  misc_feature 1..73: note = chr20:55499791-55499864
  misc_feature 1..73: note = hyper
  source 1..73: mol_type = genomic DNA

SEQ ID NO: 23403 - DNA, 39 bp, Homo sapiens; identical to SEQ ID NO: 13886
  misc_feature 1..39: note = chr20:55501052-55501091
  misc_feature 1..39: note = hyper
  source 1..39: mol_type = genomic DNA

SEQ ID NO: 23404 - DNA, 27 bp, Homo sapiens
  misc_feature 1..27: note = chr20:56803371-56803398
  misc_feature 1..27: note = hyper
  source 1..27: mol_type = genomic DNA
cggcagtttgccactcggaacatctcc

SEQ ID NO: 23405 - DNA, 401 bp, Homo sapiens
  misc_feature 1..401: note = chr20:56803441-56803842
  misc_feature 1..401: note = hyper
  source 1..401: mol_type = genomic DNA
ccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgagg

SEQ ID NO: 23406 - DNA, 205 bp, Homo sapiens
  misc_feature 1..205: note = chr20:56803920-56804125
  misc_feature 1..205: note = hyper
  source 1..205: mol_type = genomic DNA
ctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 23407 - DNA, 26 bp, Homo sapiens
  misc_feature 1..26: note = chr20:57224816-57224842
  misc_feature 1..26: note = hyper
  source 1..26: mol_type = genomic DNA
gcccagccctgctcgcggctctctcg

SEQ ID NO: 23408 - DNA, 88 bp, Homo sapiens
  misc_feature 1..88: note = chr20:57225307-57225395
  misc_feature 1..88: note = hyper
  source 1..88: mol_type = genomic DNA
ccccgacccgctccggccgcgcgctgggccaggcccttggcctcaagcctcccgggcggctccgggccggacccgggtctccgtcgcg

SEQ ID NO: 23409 - DNA, 109 bp, Homo sapiens; identical to SEQ ID NO: 13890
  misc_feature 1..109: note = chr20:57875719-57875828
  misc_feature 1..109: note = hyper
  source 1..109: mol_type = genomic DNA

SEQ ID NO: 23410 - DNA, 60 bp, Homo sapiens; identical to SEQ ID NO: 13891
  misc_feature 1..60: note = chr20:58179203-58179263
  misc_feature 1..60: note = hyper
  source 1..60: mol_type = genomic DNA

SEQ ID NO: 23411 - DNA, 106 bp, Homo sapiens; identical to SEQ ID NO: 13893
  misc_feature 1..106: note = chr20:58180470-58180576
  misc_feature 1..106: note = hyper
  source 1..106: mol_type = genomic DNA

SEQ ID NO: 23412 - DNA, 30 bp, Homo sapiens; identical to SEQ ID NO: 13894
  misc_feature 1..30: note = chr20:58508817-58508847
  misc_feature 1..30: note = hyper
  source 1..30: mol_type = genomic DNA

SEQ ID NO: 23413 - DNA, 147 bp, Homo sapiens; identical to SEQ ID NO: 13897
  misc_feature 1..147: note = chr20:59829066-59829213
  misc_feature 1..147: note = hyper
  source 1..147: mol_type = genomic DNA

SEQ ID NO: 23414 - DNA, 396 bp, Homo sapiens; identical to SEQ ID NO: 13898
  misc_feature 1..396: note = chr20:61339658-61340054
  misc_feature 1..396: note = hyper
  source 1..396: mol_type = genomic DNA

SEQ ID NO: 23415 - DNA, 277 bp, Homo sapiens
  misc_feature 1..277: note = chr20:61340304-61340581
  misc_feature 1..277: note = hyper
  source 1..277: mol_type = genomic DNA
cagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgc

SEQ ID NO: 23416 - DNA, 79 bp, Homo sapiens; identical to SEQ ID NO: 13900
  misc_feature 1..79: note = chr20:61447684-61447763
  misc_feature 1..79: note = hyper
  source 1..79: mol_type = genomic DNA

SEQ ID NO: 23417 - DNA, 332 bp, Homo sapiens; identical to SEQ ID NO: 13903
  misc_feature 1..332: note = chr20:61585342-61585674
  misc_feature 1..332: note = hyper
  source 1..332: mol_type = genomic DNA

SEQ ID NO: 23418 - DNA, 187 bp, Homo sapiens
  misc_feature 1..187: note = chr20:61637281-61637468
  misc_feature 1..187: note = hyper
  source 1..187: mol_type = genomic DNA
cgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcag

SEQ ID NO: 23419 - DNA, 21 bp, Homo sapiens
  misc_feature 1..21: note = chr20:61638631-61638652
  misc_feature 1..21: note = hyper
  source 1..21: mol_type = genomic DNA
ccctagcgcaagagtccctgg

SEQ ID NO: 23420 - DNA, 160 bp, Homo sapiens
  misc_feature 1..160: note = chr20:61703875-61704035
  misc_feature 1..160: note = hyper
  source 1..160: mol_type = genomic DNA
tcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctca

SEQ ID NO: 23421 - DNA, 180 bp, Homo sapiens; identical to SEQ ID NO: 13910
  misc_feature 1..180: note = chr20:61733260-61733440
  misc_feature 1..180: note = hyper
  source 1..180: mol_type = genomic DNA

SEQ ID NO: 23422 - DNA, 346 bp, Homo sapiens; identical to SEQ ID NO: 13911
  misc_feature 1..346: note = chr20:61733715-61734061
  misc_feature 1..346: note = hyper
  source 1..346: mol_type = genomic DNA

SEQ ID NO: 23423 - DNA, 49 bp, Homo sapiens
  misc_feature 1..49: note = chr20:61747845-61747894
  misc_feature 1..49: note = hyper
  source 1..49: mol_type = genomic DNA
agctgcagggagctgcgcggggggagccgcagagctgggcacttgcgaa

SEQ ID NO: 23424 - DNA, 357 bp, Homo sapiens; identical to SEQ ID NO: 13913
  misc_feature 1..357: note = chr20:61806443-61806800
  misc_feature 1..357: note = hyper
  source 1..357: mol_type = genomic DNA

SEQ ID NO: 23425 - DNA, 133 bp, Homo sapiens; identical to SEQ ID NO: 13914
  misc_feature 1..133: note = chr20:61807785-61807918
  misc_feature 1..133: note = hyper
  source 1..133: mol_type = genomic DNA

SEQ ID NO: 23426 - DNA, 111 bp, Homo sapiens
  misc_feature 1..111: note = chr20:61808270-61808381
  misc_feature 1..111: note = hyper
  source 1..111: mol_type = genomic DNA
atcccggtctgaaactgtgagaaccgcaagctccgatgggggcggggaaggacgacctttaattcccaccccactgtacggagcccagcagggccatccgcaggaggccgg

SEQ ID NO: 23427 - DNA, 46 bp, Homo sapiens
  misc_feature 1..46: note = chr20:61810089-61810135
  misc_feature 1..46: note = hyper
  source 1..46: mol_type = genomic DNA
gccggggatctggccgcgggacacaaaggggcccgcacgcctctgg

SEQ ID NO: 23428 - skipped

SEQ ID NO: 23429 - DNA, 265 bp, Homo sapiens; identical to SEQ ID NO: 4857
  misc_feature 1..265: note = chr20:61884691-61884956
  misc_feature 1..265: note = hyper
  source 1..265: mol_type = genomic DNA

SEQ ID NO: 23430 - DNA, 38 bp, Homo sapiens
  misc_feature 1..38: note = chr20:61886030-61886068
  misc_feature 1..38: note = hyper
  source 1..38: mol_type = genomic DNA
ccgttcttaaaggggcgatggcgcggcctctcgggtag

SEQ ID NO: 23431 - DNA, 49 bp, Homo sapiens; identical to SEQ ID NO: 13924
  misc_feature 1..49: note = chr20:62103577-62103626
  misc_feature 1..49: note = hyper
  source 1..49: mol_type = genomic DNA

SEQ ID NO: 23432 - DNA, 91 bp, Homo sapiens; identical to SEQ ID NO: 13925
  misc_feature 1..91: note = chr20:62103667-62103758
  misc_feature 1..91: note = hyper
  source 1..91: mol_type = genomic DNA

SEQ ID NO: 23433 - DNA, 150 bp, Homo sapiens
  misc_feature 1..150: note = chr20:62461475-62461625
  misc_feature 1..150: note = hyper
  source 1..150: mol_type = genomic DNA
tccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattcccc

SEQ ID NO: 23434 - DNA, 101 bp, Homo sapiens; identical to SEQ ID NO: 13928
  misc_feature 1..101: note = chr20:62947884-62947985
  misc_feature 1..101: note = hyper
  source 1..101: mol_type = genomic DNA

SEQ ID NO: 23435 - DNA, 157 bp, Homo sapiens; identical to SEQ ID NO: 13929
  misc_feature 1..157: note = chr20:62948007-62948164
  misc_feature 1..157: note = hyper
  source 1..157: mol_type = genomic DNA

SEQ ID NO: 23436 - DNA, 215 bp, Homo sapiens; identical to SEQ ID NO: 13930
  misc_feature 1..215: note = chr21:15588524-15588739
  misc_feature 1..215: note = hyper
  source 1..215: mol_type = genomic DNA

SEQ ID NO: 23437 - DNA, 24 bp, Homo sapiens
  misc_feature 1..24: note = chr21:22370664-22370688
  misc_feature 1..24: note = hyper
  source 1..24: mol_type = genomic DNA
ttctgccgccgctgccgccgccgc

SEQ ID NO: 23438 - DNA, 27 bp, Homo sapiens
  misc_feature 1..27: note = chr21:27012346-27012373
  misc_feature 1..27: note = hyper
  source 1..27: mol_type = genomic DNA
gaaacccagggtgcccgcgagcggacg

SEQ ID NO: 23439 - DNA, 277 bp, Homo sapiens
  misc_feature 1..277: note = chr21:27012431-27012708
  misc_feature 1..277: note = hyper
  source 1..277: mol_type = genomic DNA
gttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaa

SEQ ID NO: 23440 - DNA, 82 bp, Homo sapiens
  misc_feature 1..82: note = chr21:27944913-27944995
  misc_feature 1..82: note = hyper
  source 1..82: mol_type = genomic DNA
caaatcccctaaacacgagactgctatttccaaggtggaaagggaaagaaaagaaatgcaaaaggtaaaagttaaaggaaaa

SEQ ID NO: 23441 - DNA, 67 bp, Homo sapiens
  misc_feature 1..67: note = chr21:27945081-27945148
  misc_feature 1..67: note = hyper
  source 1..67: mol_type = genomic DNA
ttctgcaaaggtcccggtccgtccagctcaacccacgttagcccggaccgtgacccaagggcagccc

SEQ ID NO: 23442 - DNA, 81 bp, Homo sapiens; identical to SEQ ID NO: 13938
  misc_feature 1..81: note = chr21:28218267-28218348
  misc_feature 1..81: note = hyper
  source 1..81: mol_type = genomic DNA

SEQ ID NO: 23443 - DNA, 30 bp, Homo sapiens; identical to SEQ ID NO: 13939
  misc_feature 1..30: note = chr21:28218688-28218718
  misc_feature 1..30: note = hyper
  source 1..30: mol_type = genomic DNA

SEQ ID NO: 23444 - DNA, 30 bp, Homo sapiens
  misc_feature 1..30: note = chr21:28340318-28340348
  misc_feature 1..30: note = hyper
  source 1..30: mol_type = genomic DNA
tcttagagggaattccgctcattttttttc

SEQ ID NO: 23445 - DNA, 81 bp, Homo sapiens
  misc_feature 1..81: note = chr21:31311553-31311634
  misc_feature 1..81: note = hyper
  source 1..81: mol_type = genomic DNA
tgtgtagcctcccatgagcactgacctccaccttccccagctccggctcctgcgccgccgcgcgctgcctcgcccgggacc

SEQ ID NO: 23446 - DNA, 76 bp, Homo sapiens
  misc_feature 1..76: note = chr21:31312105-31312181
  misc_feature 1..76: note = hyper
  source 1..76: mol_type = genomic DNA
ggagcccagagaccagctgaggaaagttgctgccccgatctgcaggaacgtctccctcattcgtcctttggtcaga

SEQ ID NO: 23447 - DNA, 207 bp, Homo sapiens; identical to SEQ ID NO: 13945
  misc_feature 1..207: note = chr21:32716260-32716467
  misc_feature 1..207: note = hyper
  source 1..207: mol_type = genomic DNA

SEQ ID NO: 23448 - DNA, 508 bp, Homo sapiens
  misc_feature 1..508: note = chr21:34392566-34393074
  misc_feature 1..508: note = hyper
  source 1..508: mol_type = genomic DNA
ggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctg

SEQ ID NO: 23449 - DNA, 472 bp, Homo sapiens
  misc_feature 1..472: note = chr21:34396269-34396741
  misc_feature 1..472: note = hyper
  source 1..472: mol_type = genomic DNA
ccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaa

SEQ ID NO: 23450 - DNA, 33 bp, Homo sapiens; identical to SEQ ID NO: 13949
  misc_feature 1..33: note = chr21:34397670-34397703
  misc_feature 1..33: note = hyper
  source 1..33: mol_type = genomic DNA

SEQ ID NO: 23451 - DNA, 80 bp, Homo sapiens
  misc_feature 1..80: note = chr21:34397990-34398070
  misc_feature 1..80: note = hyper
  source 1..80: mol_type = genomic DNA
tccccaagaatctcccggccacgggcgcccattggttgtgcgcagggaggaggcgtgtgcccggcctggcgagtttcatt

SEQ ID NO: 23452 - DNA, 18 bp, Homo sapiens
  misc_feature 1..18: note = chr21:34401167-34401185
  misc_feature 1..18: note = hyper
  source 1..18: mol_type = genomic DNA
taagctgtttgctcacgt

SEQ ID NO: 23453 - DNA, 58 bp, Homo sapiens; identical to SEQ ID NO: 13958
  misc_feature 1..58: note = chr21:34442191-34442249
  misc_feature 1..58: note = hyper
  source 1..58: mol_type = genomic DNA

SEQ ID NO: 23454 - DNA, 438 bp, Homo sapiens
  misc_feature 1..438: note = chr21:34442665-34443103
  misc_feature 1..438: note = hyper
  source 1..438: mol_type = genomic DNA
caggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgcc

SEQ ID NO: 23455 - DNA, 247 bp, Homo sapiens
  misc_feature 1..247: note = chr21:34443262-34443509
  misc_feature 1..247: note = hyper
  source 1..247: mol_type = genomic DNA
cggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtc

SEQ ID NO: 23456 - DNA, 182 bp, Homo sapiens
  misc_feature 1..182: note = chr21:34443981-34444163
  misc_feature 1..182: note = hyper
  source 1..182: mol_type = genomic DNA
cggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttaga

SEQ ID NO: 23457 - DNA, 52 bp, Homo sapiens
  misc_feature 1..52: note = chr21:36041933-36041985
  misc_feature 1..52: note = hyper
  source 1..52: mol_type = genomic DNA
actgaggccgaggagggagccccggagggtgccgaggtgccccaaggagggg

SEQ ID NO: 23458 - DNA, 77 bp, Homo sapiens
  misc_feature 1..77: note = chr21:36042238-36042315
  misc_feature 1..77: note = hyper
  source 1..77: mol_type = genomic DNA
ccgggtgggggacagcgtagacgcggaaggtccggcgggggacagcgtagacgcggagggcccgctgggggacaaca

SEQ ID NO: 23459 - DNA, 26 bp, Homo sapiens
  misc_feature 1..26: note = chr21:36042632-36042658
  misc_feature 1..26: note = hyper
  source 1..26: mol_type = genomic DNA
ggggagagtgcggggcgcagccccgg

SEQ ID NO: 23460 - DNA, 293 bp, Homo sapiens
  misc_feature 1..293: note = chr21:36042861-36043154
  misc_feature 1..293: note = hyper
  source 1..293: mol_type = genomic DNA
aatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaaccc

SEQ ID NO: 23461 - DNA, 156 bp, Homo sapiens
  misc_feature 1..156: note = chr21:38065799-38065955
  misc_feature 1..156: note = hyper
  source 1..156: mol_type = genomic DNA
cggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgaccc

SEQ ID NO: 23462 - DNA, 30 bp, Homo sapiens; identical to SEQ ID NO: 13968
  misc_feature 1..30: note = chr21:38066830-38066860
  misc_feature 1..30: note = hyper
  source 1..30: mol_type = genomic DNA

SEQ ID NO: 23463 - DNA, 256 bp, Homo sapiens
  misc_feature 1..256: note = chr21:38069203-38069459
  misc_feature 1..256: note = hyper
  source 1..256: mol_type = genomic DNA
tatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccggg

SEQ ID NO: 23464 - DNA, 52 bp, Homo sapiens
  misc_feature 1..52: note = chr21:38069496-38069548
  misc_feature 1..52: note = hyper
  source 1..52: mol_type = genomic DNA
cgcattaaatcctcccgaagcccaggaggtgccagagcgggctcagggggcc

SEQ ID NO: 23465 - DNA, 124 bp, Homo sapiens
  misc_feature 1..124: note = chr21:38070581-38070705
  misc_feature 1..124: note = hyper
  source 1..124: mol_type = genomic DNA
cacctgcgccacctgcgcccaccctgtgaccctggctcagcgaccttggcccttaatcgcccaacgccgattcctcaaaattccggctgcgctgaatcgggctgcttttgccgccgccccggca

SEQ ID NO: 23466 - DNA, 71 bp, Homo sapiens; identical to SEQ ID NO: 13972
  misc_feature 1..71: note = chr21:38072282-38072353
  misc_feature 1..71: note = hyper
  source 1..71: mol_type = genomic DNA

SEQ ID NO: 23467 - DNA, 80 bp, Homo sapiens
  misc_feature 1..80: note = chr21:38072927-38073007
  misc_feature 1..80: note = hyper
  source 1..80: mol_type = genomic DNA
agtcagcggggatcacggtgaggcccaagcactgcaggctgaggccacagagcgaacacttgtgctgagccgggccctct

SEQ ID NO: 23468 - DNA, 100 bp, Homo sapiens
  misc_feature 1..100: note = chr21:38073070-38073170
  misc_feature 1..100: note = hyper
  source 1..100: mol_type = genomic DNA
acccggctgaaagagaggggtccgattaattcgaaaatggcagacagagctgagcgctgccgttcttttcaggattgaaaatgtgccagtgggccagggg

SEQ ID NO: 23469 - DNA, 61 bp, Homo sapiens
  misc_feature 1..61: note = chr21:38073239-38073300
  misc_feature 1..61: note = hyper
  source 1..61: mol_type = genomic DNA
cgcccacgccggttgccgctggtgacagtggctgcccggccaggcacctccgagcagcagg

SEQ ID NO: 23470 - DNA, 35 bp, Homo sapiens; identical to SEQ ID NO: 13975
  misc_feature 1..35: note = chr21:38076386-38076421
  misc_feature 1..35: note = hyper
  source 1..35: mol_type = genomic DNA

SEQ ID NO: 23471 - DNA, 56 bp, Homo sapiens
  misc_feature 1..56: note = chr21:38079932-38079988
  misc_feature 1..56: note = hyper
  source 1..56: mol_type = genomic DNA
aagggtttgcgaagccgctgccctgggccgaggtgcattttacgcttccagaggtc

SEQ ID NO: 23472 - DNA, 11 bp, Homo sapiens
  misc_feature 1..11: note = chr21:38081835-38081846
  misc_feature 1..11: note = hyper
  source 1..11: mol_type = genomic DNA
gtcaagtgctt

SEQ ID NO: 23473 - DNA, 45 bp, Homo sapiens; identical to SEQ ID NO: 13980
  misc_feature 1..45: note = chr21:38082684-38082729
  misc_feature 1..45: note = hyper
  source 1..45: mol_type = genomic DNA

SEQ ID NO: 23474 - DNA, 150 bp, Homo sapiens
  misc_feature 1..150: note = chr21:38119754-38119904
  misc_feature 1..150: note = hyper
  source 1..150: mol_type = genomic DNA
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttg

SEQ ID NO: 23475 - DNA, 23 bp, Homo sapiens
  misc_feature 1..23: note = chr21:38120312-38120335
  misc_feature 1..23: note = hyper
  source 1..23: mol_type = genomic DNA
agccccgccgccacctccccgcc

SEQ ID NO: 23476 - DNA, 30 bp, Homo sapiens; identical to SEQ ID NO: 13983
  misc_feature 1..30: note = chr21:38593435-38593465
  misc_feature 1..30: note = hyper
  source 1..30: mol_type = genomic DNA

SEQ ID NO: 23477 - DNA, 160 bp, Homo sapiens; identical to SEQ ID NO: 4881
  misc_feature 1..160: note = chr21:39286695-39286855
  misc_feature 1..160: note = hyper
  source 1..160: mol_type = genomic DNA

SEQ ID NO: 23478 - DNA, 37 bp, Homo sapiens; identical to SEQ ID NO: 13985
  misc_feature 1..37: note = chr21:39288011-39288048
  misc_feature 1..37: note = hyper
  source 1..37: mol_type = genomic DNA

SEQ ID NO: 23479 - DNA, 30 bp, Homo sapiens; identical to SEQ ID NO: 13986
  misc_feature 1..30: note = chr21:39288362-39288392
  misc_feature 1..30: note = hyper
  source 1..30: mol_type = genomic DNA

SEQ ID NO: 23480 - DNA, 32 bp, Homo sapiens; identical to SEQ ID NO: 13987
  misc_feature 1..32: note = chr21:40032174-40032206
  misc_feature 1..32: note = hyper
  source 1..32: mol_type = genomic DNA

SEQ ID NO: 23481 - DNA, 73 bp, Homo sapiens; identical to SEQ ID NO: 13988
  misc_feature 1..73: note = chr21:40033138-40033211
  misc_feature 1..73: note = hyper
  source 1..73: mol_type = genomic DNA

SEQ ID NO: 23482 - DNA, 241 bp, Homo sapiens; identical to SEQ ID NO: 13989
  misc_feature 1..241: note = chr21:42688845-42689086
  misc_feature 1..241: note = hyper
  source 1..241: mol_type = genomic DNA

SEQ ID NO: 23483 - DNA, 56 bp, Homo sapiens; identical to SEQ ID NO: 13990
  misc_feature 1..56: note = chr21:42878736-42878792
  misc_feature 1..56: note = hyper
  source 1..56: mol_type = genomic DNA

SEQ ID NO: 23484 - DNA, 38 bp, Homo sapiens; identical to SEQ ID NO: 1512
  misc_feature 1..38: note = chr21:44494740-44494778
  misc_feature 1..38: note = hyper
  source 1..38: mol_type = genomic DNA

SEQ ID NO: 23485 - DNA, 282 bp, Homo sapiens; identical to SEQ ID NO: 13994
  misc_feature 1..282: note = chr21:44495327-44495609
  misc_feature 1..282: note = hyper
  source 1..282: mol_type = genomic DNA

SEQ ID NO: 23486 - DNA, 218 bp, Homo sapiens; identical to SEQ ID NO: 13995
  misc_feature 1..218: note = chr21:44496505-44496723
  misc_feature 1..218: note = hyper
  source 1..218: mol_type = genomic DNA

SEQ ID NO: 23487 - DNA, 48 bp, Homo sapiens
  misc_feature 1..48: note = chr21:44847543-44847591
  misc_feature 1..48: note = hyper
  source 1..48: mol_type = genomic DNA
cgcgcgtggggctggcggcgcggatgccctggggcgctgcagaccccg

SEQ ID NO: 23488 - DNA, 152 bp, Homo sapiens
  misc_feature 1..152: note = chr21:44847622-44847774
  misc_feature 1..152: note = hyper
  source 1..152: mol_type = genomic DNA
cttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgc

SEQ ID NO: 23489 - DNA, 225 bp, Homo sapiens
  misc_feature 1..225: note = chr21:45148390-45148615
  misc_feature 1..225: note = hyper
  source 1..225: mol_type = genomic DNA
ttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggag

SEQ ID NO: 23490 - DNA, 64 bp, Homo sapiens; identical to SEQ ID NO: 13999
  misc_feature 1..64: note = chr21:45148943-45149007
  misc_feature 1..64: note = hyper
  source 1..64: mol_type = genomic DNA

SEQ ID NO: 23491 - DNA, 51 bp, Homo sapiens; identical to SEQ ID NO: 14000
  misc_feature 1..51: note = chr21:45875681-45875732
  misc_feature 1..51: note = hyper
  source 1..51: mol_type = genomic DNA

SEQ ID NO: 23492 - DNA, 211 bp, Homo sapiens; identical to SEQ ID NO: 14003
  misc_feature 1..211: note = chr21:46127234-46127445
  misc_feature 1..211: note = hyper
  source 1..211: mol_type = genomic DNA

SEQ ID NO: 23493 - DNA, 30 bp, Homo sapiens; identical to SEQ ID NO: 14004
  misc_feature 1..30: note = chr21:46128279-46128309
  misc_feature 1..30: note = hyper
  source 1..30: mol_type = genomic DNA

SEQ ID NO: 23494 - DNA, 107 bp, Homo sapiens; identical to SEQ ID NO: 4887
  misc_feature 1..107: note = chr21:46128961-46129068
  misc_feature 1..107: note = hyper
  source 1..107: mol_type = genomic DNA

SEQ ID NO: 23495 - DNA, 37 bp, Homo sapiens; identical to SEQ ID NO: 14006
  misc_feature 1..37: note = chr21:46129376-46129413
  misc_feature 1..37: note = hyper
  source 1..37: mol_type = genomic DNA

SEQ ID NO: 23496 - DNA, 40 bp, Homo sapiens; identical to SEQ ID NO: 14007
  misc_feature 1..40: note = chr21:46352791-46352831
  misc_feature 1..40: note = hyper
  source 1..40: mol_type = genomic DNA

SEQ ID NO: 23497 - DNA, 85 bp, Homo sapiens; identical to SEQ ID NO: 14008
  misc_feature 1..85: note = chr21:46825637-46825722
  misc_feature 1..85: note = hyper
  source 1..85: mol_type = genomic DNA

SEQ ID NO: 23498 - DNA, 30 bp, Homo sapiens
  misc_feature 1..30: note = chr21:47010451-47010481
  misc_feature 1..30: note = hyper
  source 1..30: mol_type = genomic DNA
ggtcggcggcgtcagcggcagctcccagac

SEQ ID NO: 23499 - DNA, 288 bp, Homo sapiens
  misc_feature 1..288: note = chr21:47063962-47064250
  misc_feature 1..288: note = hyper
  source 1..288: mol_type = genomic DNA
cggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagag

SEQ ID NO: 23500 - DNA, 250 bp, Homo sapiens; identical to SEQ ID NO: 14012
  misc_feature 1..250: note = chr21:47518063-47518313
  misc_feature 1..250: note = hyper
  source 1..250: mol_type = genomic DNA

SEQ ID NO: 23501 - DNA, 163 bp, Homo sapiens; identical to SEQ ID NO: 14014
  misc_feature 1..163: note = chr21:48087336-48087499
  misc_feature 1..163: note = hyper
  source 1..163: mol_type = genomic DNA
